United States Patent 11,446,398 (REGULATED BIOCIRCUIT SYSTEMS) - sequence listing, part 23

SEQ ID NO: 103149 - DNA, 2689 bp, Homo sapiens
  Payload ID: 118
  Gene Symbol: AAR2
  Gene Name: AAR2 splicing factor homolog
  Uniprot ID: Q9Y312
  ENST ID: ENST00000373932
  CDS Start-End: 347-1501
cggaacgtggggcgaggcggtgagtgtggcctcctggcctctttttcctttcctgattccttgtgtatgtgtggctgggccgcccctcttctcggctcagagtcacggagtgccttgaactaggcccacctcgccggggcggctggttctctgtttgtgggacgctggtgtctctggaggcccttcctgagaagccgtcgccagagttacgtcgcggttttcttaactttagagcctgggggccggagaccctgattgcactcgacctggctctgccctactctctgcgtgacttccactgttcatcaaagaaaaagggttcttttggtcacccaccactggccccatggctgccgtgcagatggatcctgagctagccaagcgcctcttctttgaaggggccactgtggtcatcctgaacatgcccaagggaacagagtttgggattgactataactcctgggaggtcgggcccaagttccggggcgtgaagatgatccctccaggcatccacttcctccactacagctctgtggacaaggctaatccgaaggaagtaggccctcgtatgggtttcttccttagcctgcaccagcgggggctgacagtgctgcgctggagcacactcagggaagaggtagacctgtccccagccccagagtctgaggtggaggccatgagggccaacctccaggagctggaccagttcctggggccttacccatatgccaccctgaagaagtggatctcactcaccaacttcatcagcgaagccacagtggagaagctacagcccgagaatcgacagatctgtgccttttccgatgtgctacctgtgctctccatgaagcacaccaaggaccgcgtggggcagaatctaccccgctgtggcattgagtgcaaaagctaccaagagggcctggcccggctaccagagatgaagcccagagccgggacagagatccgcttctcagagctgcccacgcagatgttcccagagggtgccacgccagctgagataaccaagcacagcatggacctgagctatgccctggagactgtgctcaacaagcagttccccagcagcccccaggatgtgcttggtgaactccagtttgcttttgtgtgcttcctgctggggaatgtgtacgaggcatttgagcattggaagcggctcctgaacctcctgtgccggtcagaagcagccatgatgaagcaccacaccctctacatcaacctcatctccatcctgtaccaccagcttggtgagatccccgctgacttcttcgtagacattgtctcccaagacaacttcctcaccagcaccttacaggttttcttttcctctgcctgcagcattgccgtggatgccaccctgagaaagaaagctgaaaagttccaagctcacctgaccaagaagttccggtgggactttgctgcggaacctgaggactgtgccccggtggtggtggagctccctgagggcatcgagatgggctaactcggggagcgctctcagctgcgaggggccccttcccacagggctgcagtcctggcctctccatttacttcttcccatcctgggacctgccagggcagcaatctctccaggtcctgcaaagatggagccagaattccctttttcactgataaatatatttcttcattgccaaagaggctgtacccatcctgaaggcacatttgtgggttccccatcagccaggccttggtgctaacctggctgaatttcacacaggctcttacacacacacgctcctaggagacatctgcctacacggcaaccatatttcctctgaatgagaaggaattgaaccaaaagtccaagaaagaactgattgcttgttccataggagcttaggaaacaagaaaccctggattgcccagggggtctgagaagttggttggtgactttttttgcggttaaatgaagggtgatggggagatcagcccgaattgccgcctgcctcttgctaaataggagcagaggacttggcctgcagctccttgggagcccttgattgggaagagagtttcaagggaggcagctggattcaatctagcaggtggtcagcttcagctttctccatcgaaatcccattctcctgtccagaggcccagtgggtcatctcccaaggtgggtgtggaccctggcctcagaggccttgctggtgctgtcacctcccacctgttccattccgaggcctcacccagaagtgggaccctccccttcctcaccagagccaccgtgactgtttctgatgacctggagagtcaacaacaaccagaaaggtttctgcccagagcaggcttcttaaggcctttacgaagttttgtgccttccaagtgctgaagaagacctggtcagcctaaatcttcccagtcccgctgtggagctgtcagtcaccggagtaatgagctcctggttcctcgggagtccttcgtgctgtgtggcagggttcctctctagacaagtacacaggccctgccaccctgacatcaaactgttgtactatgatcacagtccctgtgccatccttttccaagactggggctcacaccatgtttttgaatgagaatccctgctggttgagacttttgcttccacttgtttccttggagatgtttttccaagagcataatgtacattaaagtcttcgagttgagacaa

SEQ ID NO: 103150 - DNA, 1466 bp, Homo sapiens
  Payload ID: 118
  Gene Symbol: AAR2
  Gene Name: AAR2 splicing factor homolog
  ENST ID: ENST00000397286
  CDS Start-End: 94-1290
gaacttccggtgcgtttccgctgtaccggaacgtggggcgaggcgctgttcatcaaagaaaaagggttcttttggtcacccaccactggccccatggctgccgtgcagatggatcctgagctagccaagcgcctcttctttgaaggggccactgtggtcatcctgaacatgcccaagggaacagagtttgggattgactataactcctgggaggtcgggcccaagttccggggcgtgaagatgatccctccaggcatccacttcctccactacagctctgtggacaaggctaatccgaaggaagtaggccctcgtatgggtttcttccttagcctgcaccagcgggggctgacagtgctgcgctggagcacactcagggaagaggtagacctgtccccagccccagagtctgaggtggaggccatgagggccaacctccaggagctggaccagttcctggggccttacccatatgccaccctgaagaagtggatctcactcaccaacttcatcagcgaagccacagtggagaagctacagcccgagaatcgacagatctgtgccttttccgatgtgctacctgtgctctccatgaagcacaccaaggaccgcgtggggcagaatctaccccgctgtggcattgagtgcaaaagctaccaagagggcctggcccggctaccagagatgaagcccagagccgggacagagatccgcttctcagagctgcccacgcagatgttcccagagggtgccacgccagctgagataaccaagcacagcatggacctgagctatgccctggagactgtgctcaacaagcagttccccagcagcccccaggatgtgcttggtgaactccagtttgcttttgtgtgcttcctgctggggaatgtgtacgaggcatttgagcattggaagcggctcctgaacctcctgtgccggtcagaagcagccatgatgaagcaccacaccctctacatcaacctcatctccatcctgtaccaccagcttggtgagatccccgctgacttcttcgtagacattgtctcccaagacaacttcctcaccagcaccttacagagacagagtctcgctgtgtcacccagactgaagtgcagtgacttaatcatagctcgctgcagccttgaactcctgggctcatacgatccacccacctcagcctccagagtagctgggactacaggaagatatcatcacacccggctaattaacaacaacaaaaaaaattgtagggataaagtctttctatgttgcccaggctggtcttgaactcctagcctcaagcaatcctcccactttggcctctcaaaatgttgggattacaggcgtgagtcgccacacccggcccacggcatcacttttatctgccacagcatatttcattctgtgtttataccttggtataaccactctcctgttttggggaactaggtttctggttttgc

SEQ ID NO: 103151 - DNA, 2234 bp, Homo sapiens
  Payload ID: 119
  Gene Symbol: ADCK1
  Gene Name: aarF domain containing kinase 1
  Uniprot ID: Q86TW2
  ENST ID: ENST00000238561
  CDS Start-End: 100-1671
aggtggctgtccccgcacggttcccagctaattccccgctaccgggttgcggccggaagccgggcgccgcggctctgcttccctcggggatctggcgacatggccagaaaggctctcaagcttgcttcgtggaccagcatggctcttgctgcctctggcatctacttctacagtaacaagtacttggaccctaatgactttggcgctgtcagggtgggcagagcagttgctacgacggctgtcatcagttacgactacctcacttccctgaagagtgtcccttatggctcagaggagtacttgcagctgagatctaaggtgcaccttcgctctgccaggcgtctctgtgagctctgctgtgccaaccggggcaccttcatcaaggtgggccagcacctgggggctctggactacctgttgccagaggagtacaccagcacgctgaaggtactgcacagccaggctccacagagcagcatgcaagagatccgccaggtcatccgagaagatctgggcaaggagatccatgatttgttccagagcttcgatgacacccctctggggacggcctccctggcccaggtccacaaggcagtgctgcatgatgggcggacggtggccgtgaaggtccagcacccaaaggtgcgggctcagagctcgaaggacattctcctgatggaggtgctcgttctggctgtgaagcagctgttcccagagtttgagtttatgtggcttgtggatgaagccaagaagaacctgcctttggagctggatttcctcaatgaagggaggaatgctgagaaggtgtcccagatgctcaggcattttgacttcttgaaggtcccccgaatccactgggacctgtccacggagcgggtcctcctgatggagtttgtggatggcgggcaggtcaatgacagagactacatggagaggaacaagatcgacgtcaatgagatctcacgccacctgggcaagatgtatagtgagatgatcttcgtcaatggcttcgtgcactgcgatccccaccccggcaatgtactggtgcggaagcaccccggcacgggaaaggcggagattgtcctgttggaccatgggctttaccagatgctcacggaagaattccgcctgaattactgccacctctggcagtctctgatctggactgacatgaagagagtgaaggagtacagccagcgactgggagccggggatctctaccccttgtttgcctgcatgctgacggcgcgatcgtgggactcggtcaacagaggcatcagccaagctcccgtcactgccactgaggacttagagattcgcaacaacgcggccaactacctcccccagatcagccatctcctcaaccacgtgccgcgccagatgctgctcatcttgaagaccaacgacctgctgcgtggcattgaggccgccctgggcacccgcgccagcgccagctcctttctcaacatgtcacgttgctgcatcagagcgctagctgagcacaagaagaagaatacctgttcattcttcagaaggacccagatctctttcagcgaggccttcaacttatggcagatcaacctccatgagctcatcctgcgtgtgaaggggttgaagctggctgaccgggtcttggccctaatatgctggctgttccctgctccactctgagtggaattgctctccctgccccattctggtgtctttccactcctcagcccctcatcttgcctccacccagctgctccatttttgccacatcgtggcccgcagccccagagtcactgtccatgtcaccatccttctcctcctttggaatcctctccgcacactgtggcccttgtctcagggcccacaagctgaactgtggcatagctctctcttcttctccaagaagactcagcagcctacattcccattcctggtatgtgccattgggttggatgtccccactacttccgttaacccttcccattgtcaagatgtgccacgggtgccactgggggcacactgaacttgtagggagtgtgattttgttggaggtgcacatggtctctgaatttgacagagaacaccttccctttccttgccatgtcaccctccagaggaagtcacacctcagcgaggtggtttggcatctggggccaactccattacagctatgagctcactgctgtcagtgacgtttggtgttttctgtactgtgtttcaataaaaactccttcaaggttgca

SEQ ID NO: 103152 - DNA, 1972 bp, Homo sapiens
  Payload ID: 119
  Gene Symbol: ADCK1
  Gene Name: aarF domain containing kinase 1
  Uniprot ID: Q86TW2
  ENST ID: ENST00000341211
  CDS Start-End: 44-1411
aagccgggcgccgcggctctgcttccctcggggatctggcgacatggccagaaaggctctcaagcttgcttcgtggaccagcatggctcttgctgcctctggcatctacttctacagtaacaagtacttggaccctaatgactttggcgctgtcagggtgggcagagcagttgctacgacggctgtcatcagttacgactacctcacttccctgaagagtgtcccttatggctcagaggagtacttgcagctgagatctaagatccatgatttgttccagagcttcgatgacacccctctggggacggcctccctggcccaggtccacaaggcagtgctgcatgatgggcggacggtggccgtgaaggtccagcacccaaaggtgcgggctcagagctcgaaggacattctcctgatggaggtgctcgttctggctgtgaagcagctgttcccagagtttgagtttatgtggcttgtggatgaagccaagaagaacctgcctttggagctggatttcctcaatgaagggaggaatgctgagaaggtgtcccagatgctcaggcattttgacttcttgaaggtcccccgaatccactgggacctgtccacggagcgggtcctcctgatggagtttgtggatggcgggcaggtcaatgacagagactacatggagaggaacaagatcgacgtcaatgagatctcacgccacctgggcaagatgtatagtgagatgatcttcgtcaatggcttcgtgcactgcgatccccaccccggcaatgtactggtgcggaagcaccccggcacgggaaaggcggagattgtcctgttggaccatgggctttaccagatgctcacggaagaattccgcctgaattactgccacctctggcagtctctgatctggactgacatgaagagagtgaaggagtacagccagcgactgggagccggggatctctaccccttgtttgcctgcatgctgacggcgcgatcgtgggactcggtcaacagaggcatcagccaagctcccgtcactgccactgaggacttagagattcgcaacaacgcggccaactacctcccccagatcagccatctcctcaaccacgtgccgcgccagatgctgctcatcttgaagaccaacgacctgctgcgtggcattgaggccgccctgggcacccgcgccagcgccagctcctttctcaacatgtcacgttgctgcatcagagcgctagctgagcacaagaagaagaatacctgttcattcttcagaaggacccagatctctttcagcgaggccttcaacttatggcagatcaacctccatgagctcatcctgcgtgtgaaggggttgaagctggctgaccgggtcttggccctaatatgctggctgttccctgctccactctgagtggaattgctctccctgccccattctggtgtctttccactcctcagcccctcatcttgcctccacccagctgctccatttttgccacatcgtggcccgcagccccagagtcactgtccatgtcaccatccttctcctcctttggaatcctctccgcacactgtggcccttgtctcagggcccacaagctgaactgtggcatagctctctcttcttctccaagaagactcagcagcctacattcccattcctggtatgtgccattgggttggatgtccccactacttccgttaacccttcccattgtcaagatgtgccacgggtgccactgggggcacactgaacttgtagggagtgtgattttgttggaggtgcacatggtctctgaatttgacagagaacaccttccctttccttgccatgtcaccctccagaggaagtcacacctcagcgaggtggtttggcatctggggccaactccattacagctatgagctcactgctgtcagtgacgtttggtgttttctgtactgtgtttcaataaaaactccttcaaggttg

SEQ ID NO: 103153 - DNA, 1225 bp, Homo sapiens
  Payload ID: 119
  Gene Symbol: ADCK1
  Gene Name: aarF domain containing kinase 1
  ENST ID: ENST00000393639
  CDS Start-End: 63-719
gctaccgggttgcggccggaagccgggcgccgcggctctgcttccctcggggatctggcgacatggccagaaaggctctcaagcttgcttcgtggaccagcatggctcttgctgcctctggcatctacttctacagtaacaagtacttggaccctaatgactttggcgctgtcagggtgggcagagcagttgctacgacggctgtcatcagttacgactacctcacttccctgaagagtgtcccttatggctcagaggagtacttgcagctgagatctaaggtgcaccttcgctctgccaggcgtctctgtgagctctgctgtgccaaccggggcaccttcatcaaggtgggccagcacctgggggctctggactacctgttgccagaggagtacaccagcacgctgaaggtactgcacagccaggctccacagagcagcatgcaagagatccgccaggtcatccgagaagatctgggcaaggaggtgctcgttctggctgtgaagcagctgttcccagagtttgagtttatgtggcttgtggatgaagccaagaagaacctgcctttggagctggatttcctcaatgaagggaggaatgctgagaaggtgtcccagatgctcaggcattttgacttcttgaagcctgggcaacagagcgagactgcgtctcaaggaacaacaacaacaacaaaaaagaaatgggacagaaagttgtaaggccagatgtgggtgactcaccgactcgcagcgatgtcgaggtcccccgaatccactgggacctgtccacggagcgggtcctcctgatggagtttgtggatggcgggcaggtcaatgacagagactacatggagaggaacaagatcgacgtcaatgagatctcacgccacctgggcaagatgtatagtgagatgatcttcgtcaatggcttcgtgcactgcgatccccaccccggcaatgtactggtgcggaagcaccccggcacgggaaaggcggagattgtcctgttggaccatgggctttaccagatgctcacggaagaattccgcctgaattactgccacctctggcagtctctgatctggactgacatgaagagagtgaaggagtacagccagcgactgggagccggggatctctaccccttgtttgcctgcatgctgacggcgcgatcgtgggactcggtcaacagaggcatcagccaagctcccgtcactgccactgag

SEQ ID NO: 103154 - DNA, 765 bp, Homo sapiens
  Payload ID: 119
  Gene Symbol: ADCK1
  Gene Name: aarF domain containing kinase 1
  ENST ID: ENST00000556048
  CDS Start-End: 66-434
cccgctaccgggttgcggccggaagccgggcgccgcggctctgcttccctcggggatctggcgacatggccagaaaggctctcaagcttgcttcgtggaccagcatggctcttgctgcctctggcatctacttctacagtaacaagtacttggaccctaatgactttggcgctgtcagggtgggcagagcagttgctacgacggctgtcatcagttacgactacctcacttccctgaagagtgtcccttatggctcagaggagtacttgcagctgagatctaagagtcttgctgtatctcccaggctggagtgcattggcgtgatctcggctcactgcaacctctacctcctgggttcaagtgattctcctgcctcagcctcccaagtagctgggactacaggtgcaccttcgctctgccaggcgtctctgtgagctctgctgtgccaaccggggcaccttcatcaaggtgggccagcacctgggggctctggactacctgttgccagaggagtacaccagcacgctgaaggtactgcacagccaggctccacagagcagcatgcaagagatccgccaggtcatccgagaagatctgggcaaggagatccatgatttgttccagagcttcgatgacacccctctggggacggcctccctggcccaggtccacaaggcagtgctgcatgatgggcggacggtggccgtgaaggtccagcacccaaaggtgcgggctcagagctcgaaggacattctcctgatggag

SEQ ID NO: 103155 - DNA, 844 bp, Homo sapiens
  Payload ID: 119
  Gene Symbol: ADCK1
  Gene Name: aarF domain containing kinase 1
  ENST ID: ENST00000557501
  CDS Start-End: 48-844
ccggaagccgggcgccgcggctctgcttccctcggggatctggcgacatggccagaaaggctctcaagcttgcttcgtggaccagcatggctcttgctgcctctggcatctacttctacagtaacaagtacttggaccctaatgactttggcgctgtcagggtgggcagagcagttgctacgacggctgtcatcagttacgactacctcacttccctgaagagtgtcccttatggctcagaggagtacttgcagctgagatctaaggtgcaccttcgctctgccaggcgtctctgtgagctctgctgtgccaaccggggcaccttcatcaaggtgggccagcacctgggggctctggactacctgttgccagaggagtacaccagcacgctgaaggtactgcacagccaggctccacagagcagcatgcaagagatccgccaggtcatccgagaagatctgggcaaggagatccatgatttgttccagagcttcgatgacacccctctggggacggcctccctggcccaggtccacaaggcagtgctgcatgatgggcggacggtggccgtgaaggtccagcacccaaaggtgcgggctcagagctcgaaggacattctcctgatggaggtgctcgttctggctgtgaagcagctgttcccagagtttgagtttatgtggcttgtggatgaagccaagaagaacctgcctttggagctggatttcctcaatgaagggaggaatgctgagaaggtgtcccagatgctcaggcattttgacttcttgaagatctcacgccacctgggcaagatgtatagtgagatgatcttcgtcaatggcttcgt

SEQ ID NO: 103156 - DNA, 2377 bp, Homo sapiens
  Payload ID: 120
  Gene Symbol: ADCK2
  Gene Name: aarF domain containing kinase 2
  Uniprot ID: Q7Z695
  ENST ID: ENST00000072869
  CDS Start-End: 179-2059
ggcgcgggcctccggcctgaggcccggcgaggtgctggagggagcggggcgcggatccggcccagatgggcagctccgtccgcggggtcagggccgggcttcggcttcaccgcagcctcgcctgagcgggcgcctctgaagtggagggcgggccgcctgggccgcgggcctcgggaggatggtggcgccctggcgcgtctccgtcagggtttgcctgtcgcacctgaggtgcttcgagctcagacagggactcagcctcctgaggccctccgagtgccctcgcgatgccaggctctgctggcttctgctgggcactttgcccaaggtcgtctccctgtgcggggacgtgggtgagggggcccctgacgttctgagtcggcgaagggtccgctgcagcggggcggctggcgcggggcccgcggagagcctcccccgagcgggacctctgggcggcgtcttcctgcatctccgcctctggcttcgcgccggcgctctgttggtgaaattcttccccctcctactcctctaccccctcacctacctggctcccagcgtctccaccctctggctccacctgcttctgaaagccaccgagacctcaggcccaacctacatcaaactgggccagtgggccagcacccggcgcgatctgttttcggaggctttctgtgcccaattttccaagctgcatgtccgagtgacgccccacccgtggactcacactgagcgcttccttcggcaggcttttggggatgactgggggagcatcctctcttttgagaaccgggaacctgtgggctcaggctgcgtggcccaggtgtacaaagcatacgccaacactgccttcctggagactgacagcgtccagagacttggcagggcctcctgtctgccgcccttctcacatactggggcagtcggtgggctgagagagctctttggataccttggaaatggccggaaacctccagaaaatctcgcagaccagtcgtttctagaaaggctgctcctccctaaagctgacctggttggatcaaatgcaggggtgtctcgggctcaggtccctggccaccaacctgaggccaccaacctcatctccgtggcagtgaaagtgttgcaccctggcctgctcgctcaggtgcatatggacctgctgctgatgaagattggcagccgagtcctgggagttttgccaggcatcaagtggcttagcttgcctgagattgtggaggaatttgagaagctgatggtccaacagattgacctgcgttacgaagctcagaatctagaacacttccaggtcaacttccggaatgtgaaagccgtcaagttccccacccctctgcgcccctttgtcaccagagaagtcttggtggaaacgtatgaagagagtgtgcctgtgtccagttaccagcaggcaggaattcccgtggacttgaaaaggaagattgcacggctggggatcaacatgctcctgaagatgatatttgtggataactttgtccatgcagaccttcaccctggaaacatcctggttcagggtgccaacggcctgtcctcgagtcaggaggcgcagctgcagcaggcggacatctgtgacactctggtggtggccgtgccatcttccctctgcccgctgcgactggtgctgctggatgctggcattgtggcggagctgcaggcccctgacctgaggaatttccgggcagttttcatggctgtggtgatggggcagggccagagagtggctgagctgatcctgcatcatgcccgggccagcgagtgcagggacgtggaggggttcaaaaccgagatggccatgctggtgacccaggccaggaagaacaccatcaccctggagaagcttcatgtgtccagccttctctctagtgtctttaagttgctgatgactcacaaggtaaagcttgagagcaactttgcctccattgtgtttgccatcatggtgttggaggggcttggccgctcactggaccccaaactggacatcctggaggcagcgaggcccttcctcctcacgggcccagtgtgccccccgtgatggggcagtggcctctgtgggcccttgtcaagagctggaggccactcccaagagcctctcctatggcagctgggacgttttaaaattgggacaccaatttcaaatgtaaccctccagtggtggaaggcacaccatggcttcctctgcttggtttgagggtctgttcaaaagctttgggccaattagggagtaaaaggagggaaggggcctatccattccattgtggaagctgggccaggtgccagggacactctccttcagggaaaatgttatgtggaggaggacgaataaatttattttgttttcctgtttttctca

SEQ ID NO: 103157 - DNA, 1487 bp, Homo sapiens
  Payload ID: 120
  Gene Symbol: ADCK2
  Gene Name: aarF domain containing kinase 2
  ENST ID: ENST00000483369
  CDS Start-End: 1-1411
ctgtgcccaattttccaagctgcatgtccgagtgacgccccacccgtggactcacactgagcgcttccttcggcaggcttttggggatgactgggggagcatcctctcttttgagaaccgggaacctgtgggctcaggctgcgtggcccaggtgtacaaagcatacgccaacactgccttcctggagactgacagcgtccagagacttggcagggcctcctgtctgccgcccttctcacatactggggcagtcggtgggctgagagagctctttggataccttggaaatggccggaaacctccagaaaatctcgcagaccagtcgtttctagaaaggctgctcctccctaaagctgacctggttggatcaaatgcaggggtgtctcgggctcaggtccctggccaccaacctgaggccaccaacctcatctccgtggcagtgaaagtgttgcaccctggcctgctcgctcaggtgcatatggacctgctgctgatgaagattggcagccgagtcctgggagttttgccaggcatcaagtggcttagcttgcctgagattgtggaggaatttgagaagctgatggtccaacagattgacctgcgttacgaagctcagaatctagaacacttccaggtcaacttccggaatgtgaaagccgtcaagttccccacccctctgcgcccctttgtcaccagagaagtcttggtggaaacgtatgaagagagtgtgcctgtgtccagttaccagcaggcaggaattcccgtggacttgaaaaggaagattgcacggctggggatcaacatgctcctgaagatgatatttgtggataactttgtccatgcagaccttcaccctggaaacatcctggttcagggtgccaacggcctgtcctcgagtcaggaggcgcagctgcagcaggcggacatctgtgacactctggtggtggccgtgccatcttccctctgcccgctgcgactggtgctgctggatgctggcattgtggcggagctgcaggcccctgacctgaggaatttccgggcagttttcatggctgtggtgatggggcagggccagagagtggctgagctgatcctgcatcatgcccgggccagcgagtgcagggacgtggaggggttcaaaaccgagatggccatgctggtgacccaggccaggaagaacaccatcaccctggagaagcttcatgtgtccagccttctctctagtgtctttaagttgctgatgactcacaaggtcttgaggggacattcaaagcaggcagagaggggttgggatggctccagatggctgggagggagaacaccagctggtcacgcagcccctcgtgccagtgcgcatcaggtacagtgtggaggcgggaaagggacaaaaagacggcagtctcttccctgagcctatgccaacccagccttaaagccagtggatcgaatcaagccatttgtggcattatctattgctgcgtacgaac

SEQ ID NO: 103158 - DNA, 950 bp, Homo sapiens
  Payload ID: 120
  Gene Symbol: ADCK2
  Gene Name: aarF domain containing kinase 2
  ENST ID: ENST00000473512
  CDS Start-End: 1-672
attgacctgcgttacgaagctcagaatctagaacacttccaggtcaacttccggaatgtgaaagccgtcaagttccccacccctctgcgcccctttgtcaccagagaagtcttggtggaaacgtatgaagagagtgtgcctgtgtccagttaccagcaggcaggaattcccgtggacttgaaaaggaagattgcacggctggggatcaacatgctcctgaagatgatatttgtggataactttgtccatgcagaccttcaccctggaaacatcctggttcagggtgccaacggcctgtcctcgagtcaggaggcgcagctgcagcaggcggacatctgtgacactctggtggtggccgtgccatcttccctctgcccgctgcgactggtgctgctggatgctggcattgtggcggagctgcaggcccctgacctgaggaatttccgggcagttttcatggctgtggtgatggggcagcttcatgtgtccagccttctctctagtgtctttaagttgctgatgactcacaaggtaaagcttgagagcaactttgcctccattgtgtttgccatcatggtgttggaggggcttggccgctcactggaccccaaactggacatcctggaggcagcgaggcccttcctcctcacgggcccagtgtgccccccgtgatggggcagtggcctctgtgggcccttgtcaagagctggaggccactcccaagagcctctcctatggcagctgggacgttttaaaattgggacaccaatttcaaatgtaaccctccagtggtggaaggcacaccatggcttcctctgcttggtttgagggtctgttcaaaagctttgggccaattagggagtaaaaggagggaaggggcctatccattccattgtggaagctgggccaggtgccagggacactctccttcagggaaaatgttatgtgga

SEQ ID NO: 103159 - DNA, 2092 bp, Homo sapiens
  Payload ID: 120
  Gene Symbol: ADCK2
  Gene Name: aarF domain containing kinase 2
  ENST ID: ENST00000476491
  CDS Start-End: 179-1951
ggcgcgggcctccggcctgaggcccggcgaggtgctggagggagcggggcgcggatccggcccagatgggcagctccgtccgcggggtcagggccgggcttcggcttcaccgcagcctcgcctgagcgggcgcctctgaagtggagggcgggccgcctgggccgcgggcctcgggaggatggtggcgccctggcgcgtctccgtcagggtttgcctgtcgcacctgaggtgcttcgagctcagacagggactcagcctcctgaggccctccgagtgccctcgcgatgccaggctctgctggcttctgctgggcactttgcccaaggtcgtctccctgtgcggggacgtgggtgagggggcccctgacgttctgagtcggcgaagggtccgctgcagcggggcggctggcgcggggcccgcggagagcctcccccgagcgggacctctgggcggcgtcttcctgcatctccgcctctggcttcgcgccggcgctctgttggtgaaattcttccccctcctactcctctaccccctcacctacctggctcccagcgtctccaccctctggctccacctgcttctgaaagccaccgagacctcaggcccaacctacatcaaactgggccagtgggccagcacccggcgcgatctgttttcggaggctttctgtgcccaattttccaagctgcatgtccgagtgacgccccacccgtggactcacactgagcgcttccttcggcaggcttttggggatgactgggggagcatcctctcttttgagaaccgggaacctgtgggctcaggctgcgtggcccaggtgtacaaagcatacgccaacactgccttcctggagactgacagcgtccagagacttggcagggcctcctgtctgccgcccttctcacatactggggcagtcggtgggctgagagagctctttggataccttggaaatggccggaaacctccagaaaatctcgcagaccagtcgtttctagaaaggctgctcctccctaaagctgacctggttggatcaaatgcaggggtgtctcgggctcaggtccctggccaccaacctgaggccaccaacctcatctccgtggcagtgaaagtgttgcaccctggcctgctcgctcaggtgcatatggacctgctgctgatgaagattggcagccgagtcctgggagttttgccaggcatcaagtggcttagcttgcctgagattgtggaggaatttgagaagctgatggtccaacagattgacctgcgttacgaagctcagaatctagaacacttccaggtcaacttccggaatgtgaaagccgtcaagttccccacccctctgcgcccctttgtcaccagagaagtcttggtggaaacgtatgaagagagtgtgcctgtgtccagttaccagcaggcaggaattcccgtggacttgaaaaggaagattgcacggctggggatcaacatgctcctgaagatgatatttgtggataactttgtccatgcagaccttcaccctggaaacatcctggttcagggtgccaacggcctgtcctcgagtcaggaggcgcagctgcagcaggcggacatctgtgacactctggtggtggccgtgccatcttccctctgcccgctgcgactggtgctgctggatgctggcattgtggcggagctgcaggcccctgacctgaggaatttccgggcagttttcatggctgtggtgatggggcagggccagagagtggctgagctgatcctgcatcatgcccgggccagcgagtgcagggacgtggaggggttcaaaaccgagatggccatgctggtgacccaggccaggaagaacaccatcaccctggagaagcttcatgtgtccagccttctctctagtgtctttaagttgctgatgactcacaaggtaaaatcacagtttatccctgcaccttcatagattatgttgctcgtcttagagaccaccaggcagcgaatggagtcaagcccttgcgctctccgagagtcctgccctgactacaggactagtttctcccattctttccttctccaggataaagttcctcattcctgtctttta

SEQ ID NO: 103160 - DNA, 1595 bp, Homo sapiens
  Payload ID: 120
  Gene Symbol: ADCK2
  Gene Name: aarF domain containing kinase 2
  ENST ID: ENST00000622666
  CDS Start-End: 176-1399
gcgggcctccggcctgaggcccggcgaggtgctggagggagcggggcgcggatccggcccagatgggcagctccgtccgcggggtcagggccgggcttcggcttcaccgcagcctcgcctgagcgggcgcctctgaagtggagggcgggccgcctgggccgcgggcctcgggaggatggtggcgccctggcgcgtctccgtcagggtttgcctgtcgcacctgaggtgcttcgagctcagacagggactcagcctcctgaggccctccgagtgccctcgcgatgccaggctctgctggcttctgctgggcactttgcccaaggtcgtctccctgtgcggggacgtgggtgagggggcccctgacgttctgagtcggcgaagggtccgctgcagcggggcggctggcgcggggcccgcggagagcctcccccgagcgggacctctgggcggcgtcttcctgcatctccgcctctggcttcgcgccggcgctctgttggtgaaattcttccccctcctactcctctaccccctcacctacctggctcccagcgtctccaccctctggctccacctgcttctgaaagccaccgagacctcaggcccaacctacatcaaactgggccagtgggccagcacccggcgcgatctgttttcggaggctttctgtgcccaattttccaagctgcatgtccgagtgacgccccacccgtggactcacactgagcgcttccttcggcaggcttttggggatgactgggggagcatcctctcttttgagaaccgggaacctgtgggctcaggctgcgtggcccaggtgtacaaagcatacgccaacactgccttcctggagactgacagcgtccagagacttggcagggcctcctgtctgccgcccttctcacatactggggcagtcggtgggctgagagagctctttggataccttggaaatggccggaaacctccagaaaatctcgcagaccagtcgtttctagaaaggctgctcctccctaaagctgacctggttggatcaaatgcaggggtgtctcgggctcaggtccctggccaccaacctgaggccaccaacctcatctccgtggcagtgaaagtgttgcaccctggcctgctcgctcaggtgcatatggacctgctgctgatgaagattggcagccgagtcctgggagttttgccaggcatcaagtggcttagcttgcctgagattgtggaggaatttgagaagctgatggtccaacagattgacctgcgttacgaagctcagaatctagaacacttccaggtcaacttccggaatgtgaaagccgtcaagttccccacccctctgcgcccctcctatggcagctgggacgttttaaaattgggacaccaatttcaaatgtaaccctccagtggtggaaggcacaccatggcttcctctgcttggtttgagggtctgttcaaaagctttgggccaattagggagtaaaaggagggaaggggcctatccattccattgtggaagctgggccaggtgccagggacactctccttcagggaaaatgttatgtggaggaggacgaataaatttattttgtttt

SEQ ID NO: 103161 - DNA, 2872 bp, Homo sapiens
  Payload ID: 121
  Gene Symbol: ADCK3
  Gene Name: aarF domain containing kinase 3
  Uniprot ID: Q8NI60
  ENST ID: ENST00000366777
  CDS Start-End: 122-2065
gttggtaaacagatccggagcgcgtggcgggcgtcagcgcggtggccagcgcgcagaggcgggcgcggaggcggctagaaggtgaccgcggatcccagcttcctgcagccagccctgaaggatggctgccatattgggagacaccatcatggtggctaaaggccttgtcaagctgacccaggcggccgtggaaacccacctgcagcacttgggcatcggaggggagctgatcatggcggccagggccctgcagtccacggctgtggagcagattggcatgttcttggggaaggtgcagggtcaggataaacatgaagaatattttgctgagaacttcggcggcccagaaggggagttccacttctcagtcccgcatgcagccggagcctccacagacttctcttcagcctccgctcccgaccagtcagcgcccccatccctgggtcatgcccacagcgagggcccagctcctgcctacgtggccagtggaccctttagagaagccgggttccccggccaggcctcctcccctctgggcagggccaacgggaggctctttgcaaaccccagagactcattctctgccatgggctttcagcgaaggttcttccaccaggaccaatcccctgttgggggcctcacagccgaggacattgagaaggcccggcaggctaaggctcgccccgagaacaagcagcacaaacagacgctcagcgagcatgcccgggagcggaaggtgcctgtgacgaggattggccggctggccaacttcggaggtctggccgtgggcctgggcttcggggcactggcagaggtcgccaagaagagcctgcgctccgaggacccctcagggaagaaggccgtgctgggttccagtcctttcctgtccgaggccaatgcagagcggatcgtgcgcacgctctgcaaggtgcgtggtgcggcactcaagctgggccagatgctgagcatccaggatgatgcctttatcaacccccacctggctaagatcttcgagcgggtgcggcagagcgcggacttcatgccactgaagcagatgatgaaaactctcaacaacgacctgggccccaactggcgggacaagttggaatacttcgaggagcggcccttcgccgccgcatccattgggcaggtgcacttggcccgaatgaagggcggccgcgaggtggccatgaagatccagtaccctggcgtggcccagagcatcaacagtgatgtcaacaacctcatggccgtgttgaacatgagcaacatgcttccagaaggcctgttccccgagcacctgatcgacgtgctgaggcgggagctggccctggagtgtgactaccagcgagaggccgcctgtgcccgcaagttcagggacctgctgaagggccaccccttcttctatgtgcctgagattgtggatgagctctgcagcccacatgtgctgaccacagagctggtgtctggcttccccctggaccaggccgaagggctcagccaggagattcggaacgagatctgctacaacatcctggttctgtgcctgagggagctgttcgagttccacttcatgcaaacagaccccaactggtccaacttcttctatgacccccagcagcacaaggtggctcttttggattttggggcaacgcgggaatatgacagatccttcaccgacctctacattcagatcatcagggctgctgccgacagggacagggagactgtgcgggcgaaatccatagagatgaagttcctcaccggctacgaggtcaaggtcatggaagacgcccacttggatgccatcctcatcctgggggaggccttcgcctctgatgagccttttgattttggcactcagagcaccaccgagaagatccacaacctgattcccgtcatgctgaggcaccgtctcgtccccccacccgaggaaacctactccctgcacaggaagatggggggctccttcctcatctgctccaagctgaaggcccgcttcccctgcaaggccatgttcgaggaggcctacagcaactactgcaagaggcaggcccagcagtagggctgcgggccacgcccaggccggctccgcgggaactctctccctcagacaggccaaaaaccagtagcgaggtcgtggtgatgctctttttaactcctttgcccaataaggggggtggctgcctggagccccgtagccagcgctttccacggtttctgttgctaaatggttgtagggtgagaagtgcaagaatgaagatgaagccccactgctcggtcagtctgcctccgtgtgtcctctgaaataagcagatgaagatgaaagggcaactttgttttcttctttttcctgatgtgaatgttaagcagaagggagagagtccttactcccttccaatctctgttcagtgcaaaacccagaaacatgaacagatacgattgtgggattttatcatctgtgtagtaggtgtgtgtatgtgtttctagagtgagatttgtgttttctgcccttttcctctccagccgatgggctggagctgggagaggtgctgagctaacagtgccaacaagtgctccttaagcctgcgaggcccaggcctgtggggctggttctcacctttgacagctgaatgttcctaaagaactgctgccccacagtgagggtgggagcagcggaacagggaatgccagacacaggctcgctgctgctggaaggcggggtgggacttccttcctctgtccggagaggcacaggtgtcaccagttccagccaaaggctcctcacaggcgctgtgaatttttgtacaagtcttgtaattatcgaatcaacaacttgtttcaatttaataaaaatgctcatgggaagtgc

SEQ ID NO: 103162 - DNA, 2743 bp, Homo sapiens
  Payload ID: 121
  Gene Symbol: ADCK3
  Gene Name: aarF domain containing kinase 3
  Uniprot ID: Q8NI60
  ENST ID: ENST00000366778
  CDS Start-End: 149-1936
gagttggtaaacagatccggagcgcgtggcgggcgtcagcgcggtggccagcgcgcagaggcgggcgcggaggcggctagaaggtgaccgcggatcccagcttcctgcagccagggccctgcagtccacggctgtggagcagattggcatgttcttggggaaggtgcagggtcaggataaacatgaagaatattttgctgagaacttcggcggcccagaaggggagttccacttctcagtcccgcatgcagccggagcctccacagacttctcttcagcctccgctcccgaccagtcagcgcccccatccctgggtcatgcccacagcgagggcccagctcctgcctacgtggccagtggaccctttagagaagccgggttccccggccaggcctcctcccctctgggcagggccaacgggaggctctttgcaaaccccagagactcattctctgccatgggctttcagcgaaggttcttccaccaggaccaatcccctgttgggggcctcacagccgaggacattgagaaggcccggcaggctaaggctcgccccgagaacaagcagcacaaacagacgctcagcgagcatgcccgggagcggaaggtgcctgtgacgaggattggccggctggccaacttcggaggtctggccgtgggcctgggcttcggggcactggcagaggtcgccaagaagagcctgcgctccgaggacccctcagggaagaaggccgtgctgggttccagtcctttcctgtccgaggccaatgcagagcggatcgtgcgcacgctctgcaaggtgcgtggtgcggcactcaagctgggccagatgctgagcatccaggatgatgcctttatcaacccccacctggctaagatcttcgagcgggtgcggcagagcgcggacttcatgccactgaagcagatgatgaaaactctcaacaacgacctgggccccaactggcgggacaagttggaatacttcgaggagcggcccttcgccgccgcatccattgggcaggtgcacttggcccgaatgaagggcggccgcgaggtggccatgaagatccagtaccctggcgtggcccagagcatcaacagtgatgtcaacaacctcatggccgtgttgaacatgagcaacatgcttccagaaggcctgttccccgagcacctgatcgacgtgctgaggcgggagctggccctggagtgtgactaccagcgagaggccgcctgtgcccgcaagttcagggacctgctgaagggccaccccttcttctatgtgcctgagattgtggatgagctctgcagcccacatgtgctgaccacagagctggtgtctggcttccccctggaccaggccgaagggctcagccaggagattcggaacgagatctgctacaacatcctggttctgtgcctgagggagctgttcgagttccacttcatgcaaacagaccccaactggtccaacttcttctatgacccccagcagcacaaggtggctcttttggattttggggcaacgcgggaatatgacagatccttcaccgacctctacattcagatcatcagggctgctgccgacagggacagggagactgtgcgggcgaaatccatagagatgaagttcctcaccggctacgaggtcaaggtcatggaagacgcccacttggatgccatcctcatcctgggggaggccttcgcctctgatgagccttttgattttggcactcagagcaccaccgagaagatccacaacctgattcccgtcatgctgaggcaccgtctcgtccccccacccgaggaaacctactccctgcacaggaagatggggggctccttcctcatctgctccaagctgaaggcccgcttcccctgcaaggccatgttcgaggaggcctacagcaactactgcaagaggcaggcccagcagtagggctgcgggccacgcccaggccggctccgcgggaactctctccctcagacaggccaaaaaccagtagcgaggtcgtggtgatgctctttttaactcctttgcccaataaggggggtggctgcctggagccccgtagccagcgctttccacggtttctgttgctaaatggttgtagggtgagaagtgcaagaatgaagatgaagccccactgctcggtcagtctgcctccgtgtgtcctctgaaataagcagatgaagatgaaagggcaactttgttttcttctttttcctgatgtgaatgttaagcagaagggagagagtccttactcccttccaatctctgttcagtgcaaaacccagaaacatgaacagatacgattgtgggattttatcatctgtgtagtaggtgtgtgtatgtgtttctagagtgagatttgtgttttctgcccttttcctctccagccgatgggctggagctgggagaggtgctgagctaacagtgccaacaagtgctccttaagcctgcgaggcccaggcctgtggggctggttctcacctttgacagctgaatgttcctaaagaactgctgccccacagtgagggtgggagcagcggaacagggaatgccagacacaggctcgctgctgctggaaggcggggtgggacttccttcctctgtccggagaggcacaggtgtcaccagttccagccaaaggctcctcacaggcgctgtgaatttttgtacaagtcttgtaattatcgaatcaacaacttgtttcaatttaataaaaatgctcatgggaagtgc

SEQ ID NO: 103163 - DNA, 5523 bp, Homo sapiens
  Payload ID: 121
  Gene Symbol: ADCK3
  Gene Name: aarF domain containing kinase 3
  Uniprot ID: Q8NI60
  ENST ID: ENST00000366779
  CDS Start-End: 2772-4715
cttggaggtccccagagagcagggagacaaatgaacccagaacacaaatggcaaagaagaaaaatgagagaatttgtaaaagacagcattcgaacatgccgaacaagagcagggtactggtgttcaaacacctgtatctcccccgtgtaacccgtcaactaatatctttccatatttgctccagatttgtctttagaaataaaacccacgttctgaagtcctgtttgtatgtggccccagtcctgttgcctccgcctcctgtcctgaagtcgatttctgcccttctcatctatggttagttttgttttgtatgttggcatgttttcttaactttacagaaatggtatcatactgtacatatttgataattttttaaaatattgcattctggaggcatgtataaatgtagctccagttcatttattttatttattttttgagatggagttttgctcttgtcacccaggctagagtgcaatggcgtgatgttggctcactgcaacctctgcctcctgggttcaagcaattctcctgtctcaatttcctgagtagctgggattacagttgcccgccaccatgcctggctaattttgtattttagtagagacggggtttcaccacgttagccaggctggtctcaaactcctgactgcaggtgatccacgcaccttggcctccaaaagtgctgggattacaggcgtgagccaccgtgcccagcccagttattttaactattgtatagtgttccattgtatgagttctactgtttatatgctattgatcgacctgtaggggttttgcagtgtttctgtattacagctgtgctgcagtgagcatcccatcacattgtgtggatttgaggaagtattggaattcccccaattgactggacattcccaattaccctccaagtatgtgtctgtttatccttccatccgcaatctgagagttccccaactctataatacttggtgtcatcagacttttcatcttgtctgattggatgggtgtcatttcctttaggttttataattatcttttcatatgtgtattggctgtacaaggttccttctctgttcattattattaatttttttagacagagtctcgcgctgtcgcccaggctggagtgcagcagcgtgatcttggctcactgcaagctccgcctcccgggttcatgccattctcctgcctcagcctcctgagtagctgggattacaggtgcctgccatcacgcccggctagtttttttgtattttgagtagagatggggtttcaccgtgttagccaggagggtctcgatctcctgacctcgtgatccacccgcctcggcctcccaaagtgctgggattacaggtgtgagtcactgcgcccagcccaagtttccttctctgttacttgttcatatcctctgcccatttttcacttggattttttgtcttacggatatttaagcctcttaaaatatatattctggagagatgctaatctttgattaattatatgcattgcaaatgtctggtacattgtggcttgcctctcttccctgcctttaggagtgttttgctggacccaagtaatttttaaatgttaatgttattaaatctatcagttttttgcttgtatggcttatgccattgaatcttgttttaagagatccttccctaccctcaaggttttctaaatttttattttcataataagatttttagttcatctgaaatgtatttttatgattgtatttagtagggacctaattttgtttttctttgtaaccaggtgtcccagcactgtttactgaacagtctctcctttctcgctggtctgtagaactctcctgacatataccaagtttccataagtgggtggatgggttcctgagctctctactgttaatagaacttgctctctcgcaggccaatgcctcaccaggtgattgaagcagagaaacttaggtggtgaaaggagaagatggggcctgtcctgagagtttctgttcctgagatgctagaggcagaggtttccagaaccacaagacagacccaagagggctgtgttggcaaaacaaatggcagagtggagctggccagaggcatctgtgcgtggcgactccaagagagcacccgactccagatggcgacactgcaggatggagcggggcatgcctgcagacaggtgtcagagacggggtcttgctgtattgcccaggctagatttgaactcctggcctgaagtaatcctcccaccttggcctcccaaagttctgggactacagaccattcgtatatatcttctttggagaaatgtgtggtgcaatcttggttcactgcaacttccacctcctgagttccagcaattctccagtctcagcctctcgagtagctgggattacaggcatgtgccaccatgcctggccatcttcgctcttgagcacctgtgtcatgatggcgtctcactcttgttgcccaggctggagtgcaatggtgcgatttggctcactgtggcctctgcctcccgggttcaagcgattctcctgcctcagcctcccataccagttcaactttttcagattccacgtgagggagtgacggggcaaatctgcgtgctgctggtggcggtgcctcccagggctgctcggcggggacgccgagggctgcacccgagctccatcccgtgttggctgcgcgccctccaaaaccccggctgtcagcgactgcgggcacctgcacgccgacgagaccggcgggcggacagcgactccgccctgaaggatggctgccatattgggagacaccatcatggtggctaaaggccttgtcaagctgacccaggcggccgtggaaacccacctgcagcacttgggcatcggaggggagctgatcatggcggccagggccctgcagtccacggctgtggagcagattggcatgttcttggggaaggtgcagggtcaggataaacatgaagaatattttgctgagaacttcggcggcccagaaggggagttccacttctcagtcccgcatgcagccggagcctccacagacttctcttcagcctccgctcccgaccagtcagcgcccccatccctgggtcatgcccacagcgagggcccagctcctgcctacgtggccagtggaccctttagagaagccgggttccccggccaggcctcctcccctctgggcagggccaacgggaggctctttgcaaaccccagagactcattctctgccatgggctttcagcgaaggttcttccaccaggaccaatcccctgttgggggcctcacagccgaggacattgagaaggcccggcaggctaaggctcgccccgagaacaagcagcacaaacagacgctcagcgagcatgcccgggagcggaaggtgcctgtgacgaggattggccggctggccaacttcggaggtctggccgtgggcctgggcttcggggcactggcagaggtcgccaagaagagcctgcgctccgaggacccctcagggaagaaggccgtgctgggttccagtcctttcctgtccgaggccaatgcagagcggatcgtgcgcacgctctgcaaggtgcgtggtgcggcactcaagctgggccagatgctgagcatccaggatgatgcctttatcaacccccacctggctaagatcttcgagcgggtgcggcagagcgcggacttcatgccactgaagcagatgatgaaaactctcaacaacgacctgggccccaactggcgggacaagttggaatacttcgaggagcggcccttcgccgccgcatccattgggcaggtgcacttggcccgaatgaagggcggccgcgaggtggccatgaagatccagtaccctggcgtggcccagagcatcaacagtgatgtcaacaacctcatggccgtgttgaacatgagcaacatgcttccagaaggcctgttccccgagcacctgatcgacgtgctgaggcgggagctggccctggagtgtgactaccagcgagaggccgcctgtgcccgcaagttcagggacctgctgaagggccaccccttcttctatgtgcctgagattgtggatgagctctgcagcccacatgtgctgaccacagagctggtgtctggcttccccctggaccaggccgaagggctcagccaggagattcggaacgagatctgctacaacatcctggttctgtgcctgagggagctgttcgagttccacttcatgcaaacagaccccaactggtccaacttcttctatgacccccagcagcacaaggtggctcttttggattttggggcaacgcgggaatatgacagatccttcaccgacctctacattcagatcatcagggctgctgccgacagggacagggagactgtgcgggcgaaatccatagagatgaagttcctcaccggctacgaggtcaaggtcatggaagacgcccacttggatgccatcctcatcctgggggaggccttcgcctctgatgagccttttgattttggcactcagagcaccaccgagaagatccacaacctgattcccgtcatgctgaggcaccgtctcgtccccccacccgaggaaacctactccctgcacaggaagatggggggctccttcctcatctgctccaagctgaaggcccgcttcccctgcaaggccatgttcgaggaggcctacagcaactactgcaagaggcaggcccagcagtagggctgcgggccacgcccaggccggctccgcgggaactctctccctcagacaggccaaaaaccagtagcgaggtcgtggtgatgctctttttaactcctttgcccaataaggggggtggctgcctggagccccgtagccagcgctttccacggtttctgttgctaaatggttgtagggtgagaagtgcaagaatgaagatgaagccccactgctcggtcagtctgcctccgtgtgtcctctgaaataagcagatgaagatgaaagggcaactttgttttcttctttttcctgatgtgaatgttaagcagaagggagagagtccttactcccttccaatctctgttcagtgcaaaacccagaaacatgaacagatacgattgtgggattttatcatctgtgtagtaggtgtgtgtatgtgtttctagagtgagatttgtgttttctgcccttttcctctccagccgatgggctggagctgggagaggtgctgagctaacagtgccaacaagtgctccttaagcctgcgaggcccaggcctgtggggctggttctcacctttgacagctgaatgttcctaaagaactgctgccccacagtgagggtgggagcagcggaacagggaatgccagacacaggctcgctgctgctggaaggcggggtgggacttccttcctctgtccggagaggcacaggtgtcaccagttccagccaaaggctcctcacaggcgctgtgaatttttgtacaagtcttgtaattatcgaatcaacaacttgtttcaatttaataaaaatgctcatgggaagtgct

SEQ ID NO: 103164 - DNA, 2041 bp, Homo sapiens
  Payload ID: 122
  Gene Symbol: ADCK4
  Gene Name: aarF domain containing kinase 4
  Uniprot ID: Q96D53
  ENST ID: ENST00000243583
  CDS Start-End: 25-1536
ctcggaggctgagagcagtgggcaatgtggctgaaggtggggggcctacttcgggggaccggtggacagctgggccagactgttggttggccttgtggggccctggggcctgggccccaccgctggggaccatgtggaggttcttgggcccaaaagttttaccaggatgggcctgggagaggcctgggtgaggaggacattcgcagggcacgggaggcccgtcccaggaagacaccccggccccagctgagtgaccgctctcgagaacgcaaggtgcctgcctcccgcatcagccgcttggccaactttgggggactggctgtgggcttggggctaggagtactggccgagatggctaagaagtccatgccaggaggtcgtctgcagtcagacaacagcttcatcagccctcagctgcagcacatctttgagcgggtccgccagagcgccgacttcatgccccgctggcagatgctgagagttcttgaagaggagctcggcagggactggcaggccaaggtggcctccttggaggaggtgccctttgccgctgcctcaattgggcaggtgcaccagggcctgctgagggacgggacggaggtggccgtgaagatccagtaccccggcatagcccagagcattcagagcgatgtccagaacctgctggcggtactcaagatgagcgcggccctgcccgcgggcctgtttgccgagcagagcctgcaggccttgcagcaggagctggcttgggagtgtgactaccgtcgtgaggcggcttgtgcccagaatttcaggcagctgctggcaaatgaccccttcttccgggtcccagccgtggttaaggagctgtgcacgacacgggtgctgggcatggagctggctggaggggtccccctggaccagtgccagggcctaagccaggacctgcggaaccagatttgcttccagctcctgacgctgtgtctgcgggagctgtttgagttccgattcatgcagactgaccccaactgggccaacttcctgtatgatgcctccagccaccaggtgaccctgctggactttggtgcaagccgggagtttgggacagagttcacagaccattacatcgaggtggtgaaggctgcagctgatggagacagagactgtgtcctgcagaagtccagggacctcaaattcctcacaggctttgaaaccaaggcattctccgacgcccacgtggaggcagtgatgatcctgggggagcctttcgccacccagggcccttatgactttgggtcgggggaaacggcccgccgcatacaggacctcatcccggtgctgctgcggcaccggctgtgtcccccacccgaggagacctatgccctgcaccgcaagctggcaggggctttcctggcctgtgcccacctccgagcccacatcgcctgcagggacctcttccaggacacctaccaccgctactgggccagtcgccagccagacgcagccactgccggcagcctccccaccaaaggggactcctgggtggatccctcatgacagcctccatgggggattcagtccccagagcaggccgtaccctgctgtagtgcctcttatcccttccccgtctgccctgggtcagaggagcccccttgggcttcccagtcttgcctggctctcctccttggcccaggagctcaggatccctggggctggggaactcccaacttcgtgccctagatcctgcacctccccactcgaaagtgggtatccgaaaactaagccagggaagcggttaacttatctttgccaacatttgagggagccttgggccgctgcatgtcgttatgcagatcagactcatcagggggagccctcacctctgcctcaagcctcccgtggaaggcgagatggtcctggaggcagtcctcacctctgcctccctcgctcctccaacagctgccttctcccgggttccagcctctcagtgtgttggagaggtaggggtgcggggtgggggggagctgaatcttcaatcggaataaaagcagccctccccttc

SEQ ID NO: 103165 - DNA, 2443 bp, Homo sapiens
  Payload ID: 122
  Gene Symbol: ADCK4
  Gene Name: aarF domain containing kinase 4
  Uniprot ID: Q96D53
  ENST ID: ENST00000324464
  CDS Start-End: 303-1937
tctgagcatccgaagcgcggccaggtatgcatctagggcaccggggtcctggtggcgcgccagtgggccccctccctccacccctgtgactaaaccaccctccctacacggttgaatgacaagttcaaccttccctaaaacccccggtgacgagtccagccgcgcgcccattcttcacgcaggggcgggacggactttcaaagacttggagttcccacgggtgtgggttcgagaccttcctctgccagttcccagctccgctaccctgagcaaatgacttacgctccattggattttccgcaatgtggctgaaggtggggggcctacttcgggggaccggtggacagctgggccagactgttggttggccttgtggggccctggggcctgggccccaccgctggggaccatgtggaggttcttgggcccaaaagttttaccaggatgggcctgggagaggcctgggtgaggaggacattcgcagggcacgggaggcccgtcccaggaagacaccccggccccagctgagtgaccgctctcgagaacgcaaggtgcctgcctcccgcatcagccgcttggccaactttgggggactggctgtgggcttggggctaggagtactggccgagatggctaagaagtccatgccaggaggtcgtctgcagtcagagggtggttctgggctggactccagccccttcctgtcggaggccaatgccgagcggattgtgcagaccttatgtacagttcgaggggccgccctcaaggttggccagatgctcagcatccaggacaacagcttcatcagccctcagctgcagcacatctttgagcgggtccgccagagcgccgacttcatgccccgctggcagatgctgagagttcttgaagaggagctcggcagggactggcaggccaaggtggcctccttggaggaggtgccctttgccgctgcctcaattgggcaggtgcaccagggcctgctgagggacgggacggaggtggccgtgaagatccagtaccccggcatagcccagagcattcagagcgatgtccagaacctgctggcggtactcaagatgagcgcggccctgcccgcgggcctgtttgccgagcagagcctgcaggccttgcagcaggagctggcttgggagtgtgactaccgtcgtgaggcggcttgtgcccagaatttcaggcagctgctggcaaatgaccccttcttccgggtcccagccgtggttaaggagctgtgcacgacacgggtgctgggcatggagctggctggaggggtccccctggaccagtgccagggcctaagccaggacctgcggaaccagatttgcttccagctcctgacgctgtgtctgcgggagctgtttgagttccgattcatgcagactgaccccaactgggccaacttcctgtatgatgcctccagccaccaggtgaccctgctggactttggtgcaagccgggagtttgggacagagttcacagaccattacatcgaggtggtgaaggctgcagctgatggagacagagactgtgtcctgcagaagtccagggacctcaaattcctcacaggctttgaaaccaaggcattctccgacgcccacgtggaggcagtgatgatcctgggggagcctttcgccacccagggcccttatgactttgggtcgggggaaacggcccgccgcatacaggacctcatcccggtgctgctgcggcaccggctgtgtcccccacccgaggagacctatgccctgcaccgcaagctggcaggggctttcctggcctgtgcccacctccgagcccacatcgcctgcagggacctcttccaggacacctaccaccgctactgggccagtcgccagccagacgcagccactgccggcagcctccccaccaaaggggactcctgggtggatccctcatgacagcctccatgggggattcagtccccagagcaggccgtaccctgctgtagtgcctcttatcccttccccgtctgccctgggtcagaggagcccccttgggcttcccagtcttgcctggctctcctccttggcccaggagctcaggatccctggggctggggaactcccaacttcgtgccctagatcctgcacctccccactcgaaagtgggtatccgaaaactaagccagggaagcggttaacttatctttgccaacatttgagggagccttgggccgctgcatgtcgttatgcagatcagactcatcagggggagccctcacctctgcctcaagcctcccgtggaaggcgagatggtcctggaggcagtcctcacctctgcctccctcgctcctccaacagctgccttctcccgggttccagcctctcagtgtgttggagaggtaggggtgcggggtgggggggagctgaatcttcaatcggaataaaagcagccctccccttcc

SEQ ID NO: 103166 - DNA, 486 bp, Homo sapiens
  Payload ID: 122
  Gene Symbol: ADCK4
  Gene Name: aarF domain containing kinase 4
  ENST ID: ENST00000594720
  CDS Start-End: 39-486
gggggtttgcctctgagcatccgaagcgcggccaggcaatgtggctgaaggtggggggcctacttcgggggaccggtggacagctgggccagactgttggttggccttgtggggccctggggcctgggccccaccgctggggaccatgtggaggttcttgggcccaaaagttttaccaggatgggcctgggagaggcctgggtgaggaggacattcgcagggcacgggaggcccgtcccaggaagacaccccggccccagctgagtgaccgctctcgagaacgcaaggtgcctgcctcccgcatcagccgcttggccaactttgggggactggctgtgggcttggggctaggagtactggccgagatggctaagaagtccatgccaggaggtcgtctgcagtcagagggtggttctgggctggactccagccccttcctgtcggaggccaatgccgagcggattgtgcagaccttatgtacagttc

SEQ ID NO: 103167 - DNA, 867 bp, Homo sapiens
  Payload ID: 122
  Gene Symbol: ADCK4
  Gene Name: aarF domain containing kinase 4
  ENST ID: ENST00000595254
  CDS Start-End: 255-867
gcaggttgcggactcggaggctgagagcaggaccatgtggaggttcttgggcccaaaagttttaccaggatgggcctgggagaggcctgggtgaggaggacattcgcagggcacgggaggcccgtcccaggaagacaccccggccccagctgagtgaccgctctcgagaacgcaaggtgcctgcctcccgcatcagccgcttggccaactttgggggactggctgtgggcttggggctaggagtactggccgagatggctaagaagtccatgccaggaggtcgtctgcagtcagagggtggttctgggctggactccagccccttcctgtcggaggccaatgccgagcggattgtgcagaccttatgtacagttcgaggggccgccctcaaggttggccagatgctcagcatccaggacaacagcttcatcagccctcagctgcagcacatctttgagcgggtccgccagagcgccgacttcatgccccgctggcagatgctgagagttcttgaagaggagctcggcagggactggcaggccaaggtggcctccttggaggaggtgccctttgccgctgcctcaattgggcaggtgcaccagggcctgctgagggacgggacggaggtggccgtgaagatccagtaccccggcatagcccagagcattcagagcgatgtccagaacctgctggcggtactcaagatgagcgcggccctgcccgcgggcctgtttgccgagcagagcctgcaggccttgcagcaggagctggcttgggagtgtgactaccgtcgtgaggcggcttgtgcccagaatttcaggcagctgctggcaaatgaccccttcttccgggtcccagccgtggtta

SEQ ID NO: 103168 - DNA, 735 bp, Homo sapiens
  Payload ID: 122
  Gene Symbol: ADCK4
  Gene Name: aarF domain containing kinase 4
  ENST ID: ENST00000601967
  CDS Start-End: 46-735
caggagggccccagcaggttgcggactcggaggctgagagcagcaatgtggctgaaggtggggggcctacttcgggggaccggtggacagctgggccagactgttggttggccttgtggggccctggggcctgggccccaccgctggggaccatgtggaggttcttgggcccaaaagttttaccaggatgggcctgggagaggcctgggtgaggaggacattcgcagggcacgggaggcccgtcccaggaagacaccccggccccagctgagtgaccgctctcgagaacgcaaggtgcctgcctcccgcatcagccgcttggccaactttgggggactggctgtgggcttggggctaggagtactggccgagatggctaagaagtccatgccaggaggtcgtctgcagtcagagggtggttctgggctggactccagccccttcctgtcggaggccaatgccgagcggattgtgcagaccttatgtacagttcgaggggccgccctcaaggttggccagatgctcagcatccaggacaacagcttcatcagccctcagctgcagcacatctttgagcgggtccgccagagcgccgacttcatgccccgctggcagatgctgagagttcttgaagaggagctcggcagggactggcaggccaaggtggcctccttggaggaggtgccctttgccgctgcctcaattgggcaggtgcaccagggcctgctgagggac

SEQ ID NO: 103169 - DNA, 735 bp, Homo sapiens
  Payload ID: 122
  Gene Symbol: ADCK4
  Gene Name: aarF domain containing kinase 4
  ENST ID: ENST00000599643
  CDS Start-End: 53-400
gggaaagatgccccaaccagatgcctctattccagactgtgagaagtgggcaatgtggctgaaggtggggggcctacttcgggggaccggtggacagctgggccagactgttggttggccttgtggggccctggggcctgggccccaccgctggggaccatgtggaggttcttgggcccaaaagttttaccaggatgggcctgggagaggcctgggtgaggaggacattcgcagggcacgggaggcccgtcccaggaagacaccccggccccagctgagtgaccgctctcgagaacgcaagacaacagcttcatcagccctcagctgcagcacatctttgagcgggtccgccagagcgccgacttcatgccccgctggcagatgctgtaccccggcatagcccagagcattcagagcgatgtccagaacctgctggcggtactcaagatgagcgcggccctgcccgcgggtgaggcgcccacccactcctctgctgacctcccaaaggggctatgcccagagagagaaagcaggagggggagcccagaggagagcacgggcagggtgtgctggcgttgtgagcgggagtgtcagagacagaaaggacaccaaggcggggagagcccagggagcatgagcaggcctgtttgccgagcagagcctgcaggccttgcagcaggagctggcttgggagtgtgactaccgtcgtgaggcggcttgtgcccagaatttcag

SEQ ID NO: 103170 - DNA, 406 bp, Homo sapiens
  Payload ID: 122
  Gene Symbol: ADCK4
  Gene Name: aarF domain containing kinase 4
  ENST ID: ENST00000594490
  CDS Start-End: 4-406
gcaatgtggctgaaggtggggggcctacttcgggggaccggtggacagctgggccagactgttggttggccttgtggggccctggggcctgggccccaccgctggggaccatgtggaggttcttgggcccaaaagttttaccaggatgggcctgggagaggcctgggtgaggaggacattcgcagggcacgggaggcccgtcccaggaagacaccccggccccagctgagtgaccgctctcgagaacgcaaggtgcctgcctcccgcatcagccgcttggccaactttggggagggtggttctgggctggactccagccccttcctgtcggaggccaatgccgagcggattgtgcagaccttatgtacagttcgaggggccgccctcaaggttggccagatgctca

SEQ ID NO: 103171 - DNA, 883 bp, Homo sapiens
  Payload ID: 122
  Gene Symbol: ADCK4
  Gene Name: aarF domain containing kinase 4
  ENST ID: ENST00000601304
  CDS Start-End: 154-399
ggagaaccaggagaaactgtgggaatctattaatagtggaggaagtatttagtgggtgggaatgagagagggtggacacagaggaacatgggggcctggccaagaagccaggcaactcccacctgaataatccctcctcttctcctccaggcaatgtggctgaaggtggggggcctacttcgggggaccggtggacagctgggccagactgttggttggccttgtggggccctggggcctgggccccaccgctggggaccatgtggaggttcttgggcccaaaagttttaccaggatgggcctgggagaggcctgggtgaggaggacattcgcagggcacgggaggcccgtcccaggaagacaccccggccccagaccttgtccccatttcccagctgagtgaccgctctcgagaacgcaaggtgcctgcctcccgcatcagccgcttggccaactttgggggactggctgtgggcttggggctaggagtactggccgagatggctaagaagtccatgccaggaggtcgtctgcagtcagagggtggttctgggctggactccagccccttcctgtcggaggccaatgccgagcggattgtgcagaccttatgtacagttcgaggggccgccctcaaggttggccagatgctcagcatccaggacaacagcttcatcagccctcagctgcagcacatctttgagcgggtccgccagagcgccgacttcatgccccgctggcagatgctgagagttcttgaagaggagctcggcagggactggcaggccaaggtggcctccttggaggaggtgccctttgccgctgcctcaattgggcaggtgcaccagggcctgctgagggacgggacggaggtggccgtgaa

SEQ ID NO: 103172 - DNA, 325 bp, Homo sapiens
  Payload ID: 122
  Gene Symbol: ADCK4
  Gene Name: aarF domain containing kinase 4
  ENST ID: ENST00000593723
  CDS Start-End: 296-325
ggcgtgagcgggaaacagttggcaagcaaggcaagggatttatatgcacaaggaaggaggttgggtgccagaatgtgggtgtttgtgcaaagtggaggggctccatgtgcaagggaaatgtttgctgggaagaatgtgtattcaaaggaattgtgttgagcctgccaggggtaaaaataagaaggggggttggcaagatattcgtgcagaagagaggcgtcaggtttgtaagggagactttgcaagaaagtgtagggaacagaagggtctgtcgcgtacaaggcactttgaggcaatgtggctgaaggtggggggcctacttcgg

SEQ ID NO: 103173 - DNA, 373 bp, Homo sapiens
  Payload ID: 122
  Gene Symbol: ADCK4
  Gene Name: aarF domain containing kinase 4
  ENST ID: ENST00000596357
  CDS Start-End: 43-373
cggaggctgagagcagtgggtgcttagcaacggggggaggcaatgtggctgaaggtggggggcctacttcgggggaccggtggacagctgggccagactgttggttggccttgtggggccctggggcctgggccccaccgctggggaccatgtggaggttcttgggcccaaaagttttaccaggatgggcctgggagaggcctgggtgaggaggacattcgcagggcacgggaggcccgtcccaggaagacaccccggccccagctgagtgaccgctctcgagaacgcaaggtgcctgcctcccgcatcagccgcttggccaactttgggggactggctgtgggcttggggctaggagtactggccgagatgg

SEQ ID NO: 103174 - DNA, 394 bp, Homo sapiens
  Payload ID: 122
  Gene Symbol: ADCK4
  Gene Name: aarF domain containing kinase 4
  ENST ID: ENST00000600707
  CDS Start-End: 31-394
gtgagcgggaaacagttggcaagcaaggcaatgtggctgaaggtggggggcctacttcgggggaccggtggacagctgggccagactgttggttggccttgtggggccctggggcctgggccccaccgctggggaccatgtggaggttcttgggcccaaaagttttaccaggatgggcctgggagaggcctgggtgaggaggacattcgcagggcacgggaggcccgtcccaggaagacaccccggccccagctgagtgaccgctctcgagaacgcaaggtgcctgcctcccgcatcagccgcttggccaactttgggggactggctgtgggcttggggctaggagtactggccgagatggctaagaagtccatgccaggaggtcgtctgcagt

SEQ ID NO: 103175 - DNA, 473 bp, Homo sapiens
  Payload ID: 122
  Gene Symbol: ADCK4
  Gene Name: aarF domain containing kinase 4
  ENST ID: ENST00000600080
  CDS Start-End: 254-473
caggttgcggactcggaggctgagagcaggaccatgtggaggttcttgggcccaaaagttttaccaggatgggcctgggagaggcctgggtgaggaggacattcgcagggcacgggaggcccgtcccaggaagacaccccggccccagctgagtgaccgctctcgagaacgcaaggtgcctgcctcccgcatcagccgcttggccaactttgggggactggctgtgggcttggggctaggagtactggccgagatggctaagaagtccatgccaggaggtcgtctgcagtcagagggtggttctgggctggactccagccccttcctgtcggaggccaatgccgagcggattgtgcagaccttatgtacagttcgaggggccgccctcaaggttggccagatgctcagcatccaggcttcatcagccctcagctgcagcacatctttgagcgggtccgccagagcgccgactt

SEQ ID NO: 103176 - DNA, 594 bp, Homo sapiens
  Payload ID: 122
  Gene Symbol: ADCK4
  Gene Name: aarF domain containing kinase 4
  ENST ID: ENST00000594084
  CDS Start-End: 122-594
agaagccgccgctgcccccctcaacccgggaggggggtcccactggctgggcctcaggctcaggggtctcaggggtaatgatgaggcggggcacagggcacagggggctacacttcaggcaatgtggctgaaggtggggggcctacttcgggggaccggtggacagctgggccagactgttggttggccttgtggggccctggggcctgggccccaccgctggggaccatgtggaggttcttgggcccaaaagttttaccaggatgggcctgggagaggcctgggtgaggaggacattcgcagggcacgggaggcccgtcccaggaagacaccccggccccagctgagtgaccgctctcgagaacgcaaggtgcctgcctcccgcatcagccgcttggccaactttgggggactggctgtgggcttggggctaggagtactggccgagatggctaagaagtccatgccaggaggtcgtctgcagtcagagggtggttctgggctggactccagccccttcctgtcggaggccaatgccgagcggattgtgcagaccttatgtacagttcgaggggccgccctcaaggttggcca

SEQ ID NO: 103177 - DNA, 1949 bp, Homo sapiens
  Payload ID: 123
  Gene Symbol: ADCK5
  Gene Name: aarF domain containing kinase 5
  Uniprot ID: Q3MIX3
  ENST ID: ENST00000308860
  CDS Start-End: 45-1787
gctaagcggcgccgggcgggagaagagcggagcagtggtcggagatgtggcgaccggtgcagctctgtcatttccactctgctctgctgcacagcaggcagaagccctggccgtcccctgctgtgttcttcaggagaaacgtcaggggccttcctccaaggttctccagccccacacccctgtggaggaaggtgctctccaccgcggtagtgggggcgcccctgctcctcggagcccgctatgtcatggcagaggcacgggagaagaggaggatgcggctcgtggtggatggcatggggcgctttggcaggtctctgaaggtcggcctgcagatctccctggactactggtggtgcaccaatgttgtccttcgaggggtggaagagaacagcccaggctacttggaggtgatgtctgcgtgtcaccagcgggcggctgatgccctggtggcaggggccatcagcaacgggggcctctacgtgaagctgggccaggggctgtgctccttcaaccacctgcttccccccgagtatacccggaccctgcgcgtgctagaggacagggccctcaagcggggcttccaggaggtggatgagttgttccttgaggacttccaggccctcccccacgagctcttccaggagtttgactaccagccaattgctgccgccagcctggcacaggtgcacagagccaagctgcacgatggcaccagcgtggctgtgaaggtgcagtacatcgacctgcgggaccgctttgatggggacatccacaccctggagctcctgctgcggctcgttgaggtcatgcaccccagctttggcttcagctgggtcctccaggacctgaaggggaccctggcccaggagctggacttcgagaatgagggccgcaacgcagagcgctgtgcgcgggagctggcgcacttcccctacgtcgtggtgccccgcgtgcactgggacaagtccagcaagcgcgtgctcactgccgacttctgcgccggctgcaaggtcaacgatgtggaggccatcaggagccaggggctggcagtgcatgacatagcagaaaagctcatcaaggcctttgctgagcagatattttacaccggcttcatccactcggacccacatcctggcaacgttctggtgcggaaaggcccggacgggaaagcggagctggtgctgctggaccacgggctctaccagttcctggaggagaaggaccgcgcagccctctgccagctgtggcgggccatcatcctgcgggacgacgccgccatgagggcgcacgcagccgcactgggggtgcaagactacctcctgttcgccgagatgctcatgcagcgccccgtgcgcctggggcagctgtggggctcgcacctactgagccgcgaagaggcggcctacatggtggacatggcccgcgagcgcttcgaggccgtcatggcggtgctcagggagctgccgcggcccatgctgctggtgctgcgcaacatcaacaccgtgcgcgctatcaacgtggccctcggcgcccccgtggaccgctacttccttatggctaaaagggctgtccggggctggagccgcctggcgggcgccacgtatcggggtgtctacggcaccagcctcctgcgccacgccaaggtcgtctgggagatgctcaagtttgaagtggcgctcaggctggagaccttggccatgcggctgaccgccctcctggctcgtgctctggtccacctgagcctcgtgcccccagcggaggagctctaccagtacctggagacctagggtgcagccgcccagggccggcggggcccttttcaccttgggctgacggaggtggcggggctagaggtgtagacaccccgagccccgtgggcactcgcactggggggctgtgacagcagctgggccaggaggccgtgtaatgaccacacactcctctcaagc

SEQ ID NO: 103178 - DNA, 2027 bp, Homo sapiens
  Payload ID: 123
  Gene Symbol: ADCK5
  Gene Name: aarF domain containing kinase 5
  ENST ID: ENST00000529654
  CDS Start-End: 51-440
cgagacgctaagcggcgccgggcgggagaagagcggagcagtggtcggagatgtggcgaccggtgcagctctgtcatttccactctgctctgctgcacagcaggcagaagccctggccgtcccctgctgtgttcttcaggagaaacgtcaggggccttcctccaaggttctccagccccacacccctgtggaggaaggtgctctccaccgcggtagtgggggcgcccctgctcctcggagcccgctatgtcatggcagaggcacgggagaagaggaggatgcggctcgtggtggatggcatggggcgctttggcaggtctctgaaggtcggcctgcagatctccctggactactggtggtgcaccaatgttgtccttcgaggggtggaagagcccaggctacttggaggtgatgtctgcgtgtcaccagcgggcggctgatgccctggtggcaggggccatcagcaacgggggcctctacgtgaagctgggccaggggctgtgctccttcaaccacctgcttccccccgagtatacccggaccctgcgcgtgctagaggacagggccctcaagcggggcttccaggaggtggatgagttgttccttgaggacttccaggccctcccccacgagctcttccaggagtttgactaccagccaattgctgccgccagcctggcacaggtgcacagagccaagctgcacgatggcaccagcgtggctgtgaaggtgcagtacatcgacctgcgggaccgctttgatggggacatccacaccctggagctcctgctgcggctcgttgaggtcatgcaccccagctttggcttcagctgggtcctccaggacctgaaggggaccctggcccaggagctggacttcgagaatgagggccgcaacgcagagcgctgtgcgcgggagctggcgcacttcccctacgtcgtggtgccccgcgtgcactgggacaagtccagcaaggtgggctgggccaggcccttggggtgggcacagcgctgggcctgctgagcccagcctcttgctctccccagcgcgtgctcactgccgacttctgcgccggctgcaaggtcaacgatgtggaggccatcaggagccaggggctggcagtgcatgacatagcagaaaagctcatcaaggcctttgctgagcagatattttacaccggcttcatccactcggacccacatcctggcaacgttctggtgcggaaaggcccggacgggaaagcggagctggtgctgctggaccacgggctctaccagttcctggaggagaaggaccgcgcagccctctgccagctgtggcgggccatcatcctgcgggacgacgccgccatgagggcgcacgcagccgcactgggggtgcaagactacctcctgttcgccgagatgctcatgcagcgccccgtgcgcctggggcagctgtggggctcgcacctactgagccgcgaagaggcggcctacatggtggacatggcccgcgagcgcttcgaggccgtcatggcggtgctcagggagctgccgcggcccatgctgctggtgctgcgcaacatcaacaccgtgcgcgctatcaacgtggccctcggcgcccccgtggaccgctacttccttatggctaaaagggctgtccggggctggagccgcctggcgggcgccacgtatcggggtgtctacggcaccagcctcctgcgccacgccaaggtcgtctgggagatgctcaagtttgaagtggcgctcaggctggagaccttggccatgcggctgaccgccctcctggctcgtgctctggtccacctgagcctcgtgcccccagcggaggagctctaccagtacctggagacctagggtgcagccgcccagggccggcggggcccttttcaccttgggctgacggaggtggcggggctagaggtgtagacaccccgagccccgtgggcactcgcactggggggctgtgacagcagctgggccaggaggccgtgtaatgaccacacactcctctcaagcaaaaaa

SEQ ID NO: 103179 - DNA, 631 bp, Homo sapiens
  Payload ID: 123
  Gene Symbol: ADCK5
  Gene Name: aarF domain containing kinase 5
  ENST ID: ENST00000526833
  CDS Start-End: 21-368
gagcggagcagtggtcggagatgtggcgaccggtgcagctctgtcatttccactctgctctgctgcacagcaggcagaagccctggccgtcccctgctgtgttcttcaggagaaacgtcaggggccttcctccaaggttctccagccccacacccctgtggaggaaggtgctctccaccgcggtagtgggggcgcccctgctcctcggagcccgctatgtcatggcagaggcacgggagaagaggaggatgcggctcgtggtggatggcatggggcgctttggcagaccttgcctccccaggccttggagacccaccctcctggtgtcctcctctcttcctagtggacctcaggctgcaggtctctgaaggtcggcctgcagatctccctggactactggtggtgcaccaatgttgtccttcgaggggtggaagagcccaggctacttggaggtgatgtctgcgtgtcaccagcgggcggctgatgccctggtggcaggggccatcagcaacgggggcctctacgtgaagctgggccaggggctgtgctccttcaaccacctgcttccccccgagtatacccggaccctgcgcgtgctagaggacagggccctcaagcggggcttccagga

SEQ ID NO: 103180 - DNA, 838 bp, Homo sapiens
  Payload ID: 123
  Gene Symbol: ADCK5
  Gene Name: aarF domain containing kinase 5
  ENST ID: ENST00000533715
  CDS Start-End: 55-318
gctgcgagacgctaagcggcgccgggcgggagaagagcggagcagtggtcggagatgtggcgaccggctggagtgcagtgtctcaatcttggctcactgcaatctccgcctaccaagatcaagcgattctcctgtctcagcctcccaactacctgggattacaggtgcagctctgtcatttccactctgctctgctgcacagcaggcagaagccctggccgtcccctgctgtgttcttcaggagaaacgtcaggggccttcctccaaggttctccagccccacacccctgtggaggaaggtgctctccaccgcggtagtgggggcgcccctgctcctcggagcccgctatgtcatggcagaggcacgggagaagaggaggatgcggctcgtggtggatggcatggggcgctttggcaggtctctgaaggtcggcctgcagatctccctggactactggtggtgcaccaatgttgtccttcgaggggtggaagagaacagcccaggctacttggaggtgatgtctgcgtgtcaccagcgggcggctgatgccctggtggcaggggccatcagcaacgggggcctctacgtgaagctgggccaggggctgtgctccttcaaccacctgcttccccccgagtatacccggaccctgcgcgtgctagaggacagggccctcaagcggggcttccaggaggtggatgagttgttccttgaggacttccaggccctcccccacgagctcttccaggagtttgactaccagccaattgctgccgccagcctggcacaggtgcacagagccaagctgcacgatggcaccagcgtggctgtgaaggt

SEQ ID NO: 103181 - DNA, 4335 bp, Homo sapiens
  Payload ID: 124
  Gene Symbol: AHI1
  Gene Name: Abelson helper integration site 1
  Uniprot ID: Q8N157
  ENST ID: ENST00000265602
  CDS Start-End: 396-3986
tgacgtcagcaggcggcgcgctgtccgcactgcggcacagagccgcggcttgctttcaggacacgggtcgctggcgggttaggtggctgcgtggccgcctcacttcgcgcacgcgccgctaggctgggggagttgatttgcactgctccgggtgtcggctccggcgggacgggcggttctgcgtacccctctccagtgtcaacctggggctgaatcttcaacctgtcaaagccttcttaattatgtctgagaaaagtactaaaataggtgccattttaaattcccagacaaggaaaaaccaaggattagaaattaagtagcttgcccaaggccacacatcagatcctgattgagtcaatgctttgcattctcagtcctctgcataaagctgagagatgcctacagctgagagtgaagcaaaagtaaaaaccaaagttcgctttgaagaattgcttaagacccacagtgatctaatgcgtgaaaagaaaaaactgaagaaaaaacttgtcaggtctgaagaaaacatctcacctgacactattagaagcaatcttcactatatgaaagaaactacaagtgatgatcccgacactattagaagcaatcttccccatattaaagaaactacaagtgatgatgtaagtgctgctaacactaacaacctgaagaagagcacgagagtcactaaaaacaaattgaggaacacacagttagcaactgaaaatcctaatggtgatgctagtgtagaggaagacaaacaaggaaagccaaataaaaaggtgataaagacggtgccccagttgactacacaagacctgaaaccggaaactcctgagaataaggttgattctacacaccagaaaacacatacaaagccacagccaggcgttgatcatcagaaaagtgagaaggcaaatgagggaagagaagagactgatttagaagaggatgaagaattgatgcaagcatatcagtgccatgtaactgaagaaatggcaaaggagattaagaggaaaataagaaagaaactgaaagaacagttgacttactttccctcagatactttattccatgatgacaaactaagcagtgaaaaaaggaaaaagaaaaaggaagttccagtcttctctaaagctgaaacaagtacattgaccatctctggtgacacagttgaaggtgaacaaaagaaagaatcttcagttagatcagtttcttcagattctcatcaagatgatgaaataagctcaatggaacaaagcacagaagacagcatgcaagatgatacaaaacctaaaccaaaaaaaacaaaaaagaagactaaagcagttgcagataataatgaagatgttgatggtgatggtgttcatgaaataacaagccgagatagcccggtttatcccaaatgtttgcttgatgatgaccttgtcttgggagtttacattcaccgaactgatagacttaagtcagattttatgatttctcacccaatggtaaaaattcatgtggttgatgagcatactggtcaatatgtcaagaaagatgatagtggacggcctgtttcatcttactatgaaaaagagaatgtggattatattcttcctattatgacccagccatatgattttaaacagttaaaatcaagacttccagagtgggaagaacaaattgtatttaatgaaaattttccctatttgcttcgaggctctgatgagagtcctaaagtcatcctgttctttgagattcttgatttcttaagcgtggatgaaattaagaataattctgaggttcaaaaccaagaatgtggctttcggaaaattgcctgggcatttcttaagcttctgggagccaatggaaatgcaaacatcaactcaaaacttcgcttgcagctatattacccacctactaagcctcgatccccattaagtgttgttgaggcatttgaatggtggtcaaaatgtccaagaaatcattacccatcaacactgtacgtaactgtaagaggactgaaagttccagactgtataaagccatcttaccgctctatgatggctcttcaggaggaaaaaggtaaaccagtgcattgtgaacgtcaccatgagtcaagctcagtagacacagaacctggattagaagagtcaaaggaagtaataaagtggaaacgactccctgggcaggcttgccgtatcccaaacaaacacctcttctcactaaatgcaggagaacgaggatgtttttgtcttgatttctcccacaatggaagaatattagcagcagcttgtgccagccgggatggatatccaattattttatatgaaattccttctggacgtttcatgagagaattgtgtggccacctcaatatcatttatgatctttcctggtcaaaagatgatcactacatccttacttcatcatctgatggcactgccaggatatggaaaaatgaaataaacaatacaaatactttcagagttttacctcatccttcttttgtttacacggctaaattccatccagctgtaagagagctagtagttacaggatgctatgattccatgatacggatatggaaagttgagatgagagaagattctgccatattggtccgacagtttgatgttcacaaaagttttatcaactcactttgttttgatactgaaggtcatcatatgtattcaggagattgtacaggggtgattgttgtttggaatacctatgtcaagattaatgatttggaacattcagtgcaccactggactataaataaggaaattaaagaaactgagtttaagggaattccaataagttatttggagattcatcccaatggaaaacgtttgttaatccataccaaagacagtactttgagaattatggatctccggatattagtagcaaggaagtttgtaggagcagcaaattatcgggagaagattcatagtactttgactccatgtgggacttttctgtttgctggaagtgaggatggtatagtgtatgtttggaacccagaaacaggagaacaagtagccatgtattctgacttgccattcaagtcacccattcgagacatttcttatcatccatttgaaaatatggttgcattctgtgcatttgggcaaaatgagccaattcttctgtatatttacgatttccatgttgcccagcaggaggctgaaatgttcaaacgctacaatggaacatttccattacctggaatacaccaaagtcaagatgccctatgtacctgtccaaaactaccccatcaaggctcttttcagattgatgaatttgtccacactgaaagttcttcaacgaagatgcagctagtaaaacagaggcttgaaactgtcacagaggtgatacgttcctgtgctgcaaaagtcaacaaaaatctctcatttacttcaccaccagcagtttcctcacaacagtctaagttaaagcagtcaaacatgctgaccgctcaagagattctacatcagtttggtttcactcagaccgggattatcagcatagaaagaaagccttgtaaccatcaggtagatacagcaccaacggtagtggctctttatgactacacagcgaatcgatcagatgaactaaccatccatcgcggagacattatccgagtgtttttcaaagataatgaagactggtggtatggcagcataggaaagggacaggaaggttattttccagctaatcatgtggctagtgaaacactgtatcaagaactgcctcctgagataaaggagcgatcccctcctttaagccctgaggaaaaaactaaaatagaaaaatctccagctcctcaaaagcaatcaatcaataagaacaagtcccaggacttcagactaggctcagaatctatgacacattctgaaatgagaaaagaacagagccatgaggaccaaggacacataatggatacacggatgaggaagaacaagcaagcaggcagaaaagtcactctaatagagtaaagaattgaagaaaagttaagagctgccgaaatgcacagaggtgaaaatgacaaaccaaatggaatttctcttcagagttcagaattttcagatactaaggaggaagaaaggatccactacttcttgttcttatgaatgactctagaaaaatcagaatcaagttgtgggtggaaaaatcaacgtggcctttgagttcagttgttataaaccattgtgactattgttggtcaaagtattggtacttatattgttagtaattgcatcataattacattaccagtgttggaaaactaatgaagaaaacactgtaattgctactcagcaaatgtgaataaaaggtgtttgcgtt

SEQ ID NO: 103182 - DNA, 3638 bp, Homo sapiens
  Payload ID: 124
  Gene Symbol: AHI1
  Gene Name: Abelson helper integration site 1
  Uniprot ID: Q8N157
  ENST ID: ENST00000327035
  CDS Start-End: 280-3441
gcggcacagagccgcggcttgctttcaggacacgggtcgctggcgggttaggtggctgcgtggccgcctcacttcgcgcacgcgccgctaggctgggggagttgatttgcactgctccgggtgtcggctccggcgggacgggcggttctgcgtacccctctccagtgtcaacctggggctgaatcttcaacctgtcaaagccttcttaattatgtctgagaaaaggatcctgattgagtcaatgctttgcattctcagtcctctgcataaagctgagagatgcctacagctgagagtgaagcaaaagtaaaaaccaaagttcgctttgaagaattgcttaagacccacagtgatctaatgcgtgaaaagaaaaaactgaagaaaaaacttgtcaggtctgaagaaaacatctcacctgacactattagaagcaatcttcactatatgaaagaaactacaagtgatgatcccgacactattagaagcaatcttccccatattaaagaaactacaagtgatgatgtaagtgctgctaacactaacaacctgaagaagagcacgagagtcactaaaaacaaattgaggaacacacagttagcaactgaaaatcctaatggtgatgctagtgtagaggaagacaaacaaggaaagccaaataaaaaggtgataaagacggtgccccagttgactacacaagacctgaaaccggaaactcctgagaataaggttgattctacacaccagaaaacacatacaaagccacagccaggcgttgatcatcagaaaagtgagaaggcaaatgagggaagagaagagactgatttagaagaggatgaagaattgatgcaagcatatcagtgccatgtaactgaagaaatggcaaaggagattaagaggaaaataagaaagaaactgaaagaacagttgacttactttccctcagatactttattccatgatgacaaactaagcagtgaaaaaaggaaaaagaaaaaggaagttccagtcttctctaaagctgaaacaagtacattgaccatctctggtgacacagttgaaggtgaacaaaagaaagaatcttcagttagatcagtttcttcagattctcatcaagatgatgaaataagctcaatggaacaaagcacagaagacagcatgcaagatgatacaaaacctaaaccaaaaaaaacaaaaaagaagactaaagcagttgcagataataatgaagatgttgatggtgatggtgttcatgaaataacaagccgagatagcccggtttatcccaaatgtttgcttgatgatgaccttgtcttgggagtttacattcaccgaactgatagacttaagtcagattttatgatttctcacccaatggtaaaaattcatgtggttgatgagcatactggtcaatatgtcaagaaagatgatagtggacggcctgtttcatcttactatgaaaaagagaatgtggattatattcttcctattatgacccagccatatgattttaaacagttaaaatcaagacttccagagtgggaagaacaaattgtatttaatgaaaattttccctatttgcttcgaggctctgatgagagtcctaaagtcatcctgttctttgagattcttgatttcttaagcgtggatgaaattaagaataattctgaggttcaaaaccaagaatgtggctttcggaaaattgcctgggcatttcttaagcttctgggagccaatggaaatgcaaacatcaactcaaaacttcgcttgcagctatattacccacctactaagcctcgatccccattaagtgttgttgaggcatttgaatggtggtcaaaatgtccaagaaatcattacccatcaacactgtacgtaactgtaagaggactgaaagttccagactgtataaagccatcttaccgctctatgatggctcttcaggaggaaaaaggtaaaccagtgcattgtgaacgtcaccatgagtcaagctcagtagacacagaacctggattagaagagtcaaaggaagtaataaagtggaaacgactccctgggcaggcttgccgtatcccaaacaaacacctcttctcactaaatgcaggagaacgaggatgtttttgtcttgatttctcccacaatggaagaatattagcagcagcttgtgccagccgggatggatatccaattattttatatgaaattccttctggacgtttcatgagagaattgtgtggccacctcaatatcatttatgatctttcctggtcaaaagatgatcactacatccttacttcatcatctgatggcactgccaggatatggaaaaatgaaataaacaatacaaatactttcagagttttacctcatccttcttttgtttacacggctaaattccatccagctgtaagagagctagtagttacaggatgctatgattccatgatacggatatggaaagttgagatgagagaagattctgccatattggtccgacagtttgatgttcacaaaagttttatcaactcactttgttttgatactgaaggtcatcatatgtattcaggagattgtacaggggtgattgttgtttggaatacctatgtcaagattaatgatttggaacattcagtgcaccactggactataaataaggaaattaaagaaactgagtttaagggaattccaataagttatttggagattcatcccaatggaaaacgtttgttaatccataccaaagacagtactttgagaattatggatctccggatattagtagcaaggaagtttgtaggagcagcaaattatcgggagaagattcatagtactttgactccatgtgggacttttctgtttgctggaagtgaggatggtatagtgtatgtttggaacccagaaacaggagaacaagtagccatgtattctgacttgccattcaagtcacccattcgagacatttcttatcatccatttgaaaatatggttgcattctgtgcatttgggcaaaatgagccaattcttctgtatatttacgatttccatgttgcccagcaggaggctgaaatgttcaaacgctacaatggaacatttccattacctggaatacaccaaagtcaagatgccctatgtacctgtccaaaactaccccatcaaggctcttttcagattgatgaatttgtccacactgaaagttcttcaacgaagatgcagctagtaaaacagaggcttgaaactgtcacagaggtgatacgttcctgtgctgcaaaagtcaacaaaaatctctcatttacttcaccaccagcagtttcctcacaacagtctaagttaaagcagtcaaacatgctgaccgctcaagagattctacatcagtttggtttcactcagaccgacagtcactttgctgaattcaacacatgtatattatggtggaaaaagcactagactcagggtcagccagccagaagaactgagccgacctgggatcccaccacttcctaactgttttgttaggtagttcactttctctcttcggataaatgtctccacatttcctacttcatagaattgtcagaatcaacacaatacatttaatactttgaaactcataaaatattgggagaataaacagtatgaggtta

SEQ ID NO: 103183 - DNA, 2340 bp, Homo sapiens
  Payload ID: 124
  Gene Symbol: AHI1
  Gene Name: Abelson helper integration site 1
  ENST ID: ENST00000367799
  CDS Start-End: 1-2006
cacctactaagcctcgatccccattaagtgttgttgaggcatttgaatggtggtcaaaatgtccaagaaatcattacccatcaacactgtacgtaactgtaagaggactgaaagttccagactgtataaagccatcttaccgctctatgatggctcttcaggaggaaaaaggtaaaccagtgcattgtgaacgtcaccatgagtcaagctcagtagacacagaacctggattagaagagtcaaaggaagtaataaagtggaaacgactccctgggcaggcttgccgtatcccaaacaaacacctcttctcactaaatgcaggagaacgaggatgtttttgtcttgatttctcccacaatggaagaatattagcagcagcttgtgccagccgggatggatatccaattattttatatgaaattccttctggacgtttcatgagagaattgtgtggccacctcaatatcatttatgatctttcctggtcaaaagatgatcactacatccttacttcatcatctgatggcactgccaggatatggaaaaatgaaataaacaatacaaatactttcagagttttacctcatccttcttttgtttacacggctaaattccatccagctgtaagagagctagtagttacaggatgctatgattccatgatacggatatggaaagttgagatgagagaagattctgccatattggtccgacagtttgatgttcacaaaagttttatcaactcactttgttttgatactgaaggtcatcatatgtattcaggagattgtacaggggtgattgttgtttggaatacctatgtcaagattaatgatttggaacattcagtgcaccactggactataaataaggaaattaaagaaactgagtttaagggaattccaataagttatttggagattcatcccaatggaaaacgtttgttaatccataccaaagacagtactttgagaattatggatctccggatattagtagcaaggaagtttgtaggagcagcaaattatcgggagaagattcatagtactttgactccatgtgggacttttctgtttgctggaagtgaggatggtatagtgtatgtttggaacccagaaacaggagaacaagtagccatgtattctgacttgccattcaagtcacccattcgagacatttcttatcatccatttgaaaatatggttgcattctgtgcatttgggcaaaatgagccaattcttctgtatatttacgatttccatgttgcccagcaggaggctgaaatgttcaaacgctacaatggaacatttccattacctggaatacaccaaagtcaagatgccctatgtacctgtccaaaactaccccatcaaggctcttttcagattgatgaatttgtccacactgaaagttcttcaacgaagatgcagctagtaaaacagaggcttgaaactgtcacagaggtgatacgttcctgtgctgcaaaagtcaacaaaaatctctcatttacttcaccaccagcagtttcctcacaacagtctaagttaaagcagtcaaacatgctgaccgctcaagagattctacatcagtttggtttcactcagaccgggattatcagcatagaaagaaagccttgtaaccatcaggtagatacagcaccaacggtagtggctctttatgactacacagcgaatcgatcagatgaactaaccatccatcgcggagacattatccgagtgtttttcaaagataatgaagactggtggtatggcagcataggaaagggacaggaaggttattttccagctaatcatgtggctagtgaaacactgtatcaagaactgcctcctgagataaaggagcgatcccctcctttaagccctgaggaaaaaactaaaatagaaaaatctccagctcctcaaaagcaatcaatcaataagaacaagtcccaggacttcagactaggctcagaatctatgacacataaagaattgaagaaaagttaagagctgccgaaatgcacagaggtgaaaatgacaaaccaaatggaatttctcttcagagttcagaattttcagatactaaggaggaagaaaggatccactacttcttgttcttatgaatgactctagaaaaatcagaatcaagttgtgggtggaaaaatcaacgtggcctttgagttcagttgttataaaccattgtgactattgttggtcaaagtattggtacttatattgttagtaattgcatcataattacattaccagtgttggaaaactaatgaagaaaacactgtaattgctactcagcaaatgtgaataaaaggtgtttgcgttatta

SEQ ID NO: 103184 - DNA, 5921 bp, Homo sapiens
  Payload ID: 124
  Gene Symbol: AHI1
  Gene Name: Abelson helper integration site 1
  Uniprot ID: Q8N157
  ENST ID: ENST00000367800
  CDS Start-End: 218-3808
gcggcacagagccgcggcttgctttcaggacacgggtcgctggcgggttaggtggctgcgtggccgcctcacttcgcgcacgcgccgctaggctgggggagttgatttgcactgctccgggtgtcggctccggcgggacgggcggttctgcgtacccctctccgatcctgattgagtcaatgctttgcattctcagtcctctgcataaagctgagagatgcctacagctgagagtgaagcaaaagtaaaaaccaaagttcgctttgaagaattgcttaagacccacagtgatctaatgcgtgaaaagaaaaaactgaagaaaaaacttgtcaggtctgaagaaaacatctcacctgacactattagaagcaatcttcactatatgaaagaaactacaagtgatgatcccgacactattagaagcaatcttccccatattaaagaaactacaagtgatgatgtaagtgctgctaacactaacaacctgaagaagagcacgagagtcactaaaaacaaattgaggaacacacagttagcaactgaaaatcctaatggtgatgctagtgtagaggaagacaaacaaggaaagccaaataaaaaggtgataaagacggtgccccagttgactacacaagacctgaaaccggaaactcctgagaataaggttgattctacacaccagaaaacacatacaaagccacagccaggcgttgatcatcagaaaagtgagaaggcaaatgagggaagagaagagactgatttagaagaggatgaagaattgatgcaagcatatcagtgccatgtaactgaagaaatggcaaaggagattaagaggaaaataagaaagaaactgaaagaacagttgacttactttccctcagatactttattccatgatgacaaactaagcagtgaaaaaaggaaaaagaaaaaggaagttccagtcttctctaaagctgaaacaagtacattgaccatctctggtgacacagttgaaggtgaacaaaagaaagaatcttcagttagatcagtttcttcagattctcatcaagatgatgaaataagctcaatggaacaaagcacagaagacagcatgcaagatgatacaaaacctaaaccaaaaaaaacaaaaaagaagactaaagcagttgcagataataatgaagatgttgatggtgatggtgttcatgaaataacaagccgagatagcccggtttatcccaaatgtttgcttgatgatgaccttgtcttgggagtttacattcaccgaactgatagacttaagtcagattttatgatttctcacccaatggtaaaaattcatgtggttgatgagcatactggtcaatatgtcaagaaagatgatagtggacggcctgtttcatcttactatgaaaaagagaatgtggattatattcttcctattatgacccagccatatgattttaaacagttaaaatcaagacttccagagtgggaagaacaaattgtatttaatgaaaattttccctatttgcttcgaggctctgatgagagtcctaaagtcatcctgttctttgagattcttgatttcttaagcgtggatgaaattaagaataattctgaggttcaaaaccaagaatgtggctttcggaaaattgcctgggcatttcttaagcttctgggagccaatggaaatgcaaacatcaactcaaaacttcgcttgcagctatattacccacctactaagcctcgatccccattaagtgttgttgaggcatttgaatggtggtcaaaatgtccaagaaatcattacccatcaacactgtacgtaactgtaagaggactgaaagttccagactgtataaagccatcttaccgctctatgatggctcttcaggaggaaaaaggtaaaccagtgcattgtgaacgtcaccatgagtcaagctcagtagacacagaacctggattagaagagtcaaaggaagtaataaagtggaaacgactccctgggcaggcttgccgtatcccaaacaaacacctcttctcactaaatgcaggagaacgaggatgtttttgtcttgatttctcccacaatggaagaatattagcagcagcttgtgccagccgggatggatatccaattattttatatgaaattccttctggacgtttcatgagagaattgtgtggccacctcaatatcatttatgatctttcctggtcaaaagatgatcactacatccttacttcatcatctgatggcactgccaggatatggaaaaatgaaataaacaatacaaatactttcagagttttacctcatccttcttttgtttacacggctaaattccatccagctgtaagagagctagtagttacaggatgctatgattccatgatacggatatggaaagttgagatgagagaagattctgccatattggtccgacagtttgatgttcacaaaagttttatcaactcactttgttttgatactgaaggtcatcatatgtattcaggagattgtacaggggtgattgttgtttggaatacctatgtcaagattaatgatttggaacattcagtgcaccactggactataaataaggaaattaaagaaactgagtttaagggaattccaataagttatttggagattcatcccaatggaaaacgtttgttaatccataccaaagacagtactttgagaattatggatctccggatattagtagcaaggaagtttgtaggagcagcaaattatcgggagaagattcatagtactttgactccatgtgggacttttctgtttgctggaagtgaggatggtatagtgtatgtttggaacccagaaacaggagaacaagtagccatgtattctgacttgccattcaagtcacccattcgagacatttcttatcatccatttgaaaatatggttgcattctgtgcatttgggcaaaatgagccaattcttctgtatatttacgatttccatgttgcccagcaggaggctgaaatgttcaaacgctacaatggaacatttccattacctggaatacaccaaagtcaagatgccctatgtacctgtccaaaactaccccatcaaggctcttttcagattgatgaatttgtccacactgaaagttcttcaacgaagatgcagctagtaaaacagaggcttgaaactgtcacagaggtgatacgttcctgtgctgcaaaagtcaacaaaaatctctcatttacttcaccaccagcagtttcctcacaacagtctaagttaaagcagtcaaacatgctgaccgctcaagagattctacatcagtttggtttcactcagaccgggattatcagcatagaaagaaagccttgtaaccatcaggtagatacagcaccaacggtagtggctctttatgactacacagcgaatcgatcagatgaactaaccatccatcgcggagacattatccgagtgtttttcaaagataatgaagactggtggtatggcagcataggaaagggacaggaaggttattttccagctaatcatgtggctagtgaaacactgtatcaagaactgcctcctgagataaaggagcgatcccctcctttaagccctgaggaaaaaactaaaatagaaaaatctccagctcctcaaaagcaatcaatcaataagaacaagtcccaggacttcagactaggctcagaatctatgacacattctgaaatgagaaaagaacagagccatgaggaccaaggacacataatggatacacggatgaggaagaacaagcaagcaggcagaaaagtcactctaatagagtaaagaattgaagaaaagttaagagctgccgaaatgcacagaggtgaaaatgacaaaccaaatggaatttctcttcagagttcagaattttcagatactaaggaggaagaaaggatccactacttcttgttcttatgaatgactctagaaaaatcagaatcaagttgtgggtggaaaaatcaacgtggcctttgagttcagttgttataaaccattgtgactattgttggtcaaagtattggtacttatattgttagtaattgcatcataattacattaccagtgttggaaaactaatgaagaaaacactgtaattgctactcagcaaatgtgaataaaaggtgtttgcgttattaggatgtctgttaagtaatcatttaatattattatattggtaatggttgtatgtgtgatgctatgcccagaatatgaagtatctgtttttgaaattcactttatttaaaagataagcagctgactgggcacggtgcctcatgcctgtaatcctagcaccttgggaggctgaggcaggtggatcacctaaggtcaggagttcaacaacaccagcctgaccaacatggtgaaaccccatctctactaaaaatacaaaaatcagccgggtctcatggcaggcacctgtaatcccatctactgaggcaggagaattgcttgacccaggaggcagaggttgcagtgagccaagatcacgccattgcactccagcctgggggacagagcaagactctatctccaaaaaacaaaaaagataagcagctttagaatatggcgcattcaaaacagtctcagtaacaaagacattaaaagaaaacaatttactttctaattaaaattttgtgtttcttaagatcaaatcatataggtaacttcatagacctaaattaaaagtgatttttggctggactggcaacaatgttcccaatgtctttactttttaaaaaaggcttttcatatttaagcacatacctattttgtagacttacattgtttaatatttattttaatcttaatatttttacattattatattgcattatttattttttctaagttccagaataatagtgtcattattatagactatatgttttgaagtttgatattataatgggatattcattttttgttcttttcttgactcctttctcaagtgtgtgataaggtctgctgataaaatatttaaccccaagaaagtgaaaactaatataaaattagaaagacctatccaaattagacagtcaattccattaaaataagaagtgagaaaaacaatgttgggcattgaggtgtaaattttgcccagatgtatacccagtgtgaaatatcttctaataaaaatatatttggctcttatccctgcacatgtagaggcataaaaattggtaaacatgtcccgctgtgtagaactttaaaaaaaaggcatttttgaaagtgttgagtggcactgataactggtgaagcctacagccatccgcccaaaagtctgttctgatggcactgagttttcattgttctggatgtataagtctgtgtgtcaggtacagctgggcccagccagcttgagtcactcttgtacaagcttgtttttttctgtcttgtgaatgcacttgataatttaaaaataaaaatatctgtttctctgcagtttcagctaataattttgagatatgtgttgattttctgattgaatcaccaagaatttcaacaagtttagaaataatttaagatgaatgaaaaatatgtcagggggagctaagcatttgctaagctcttgatgtttatatgaaaaataaagggttgtttttatattgcaactactaaagagaaaaatagcagttgaagcaaacaccaggaaaatttggctctactgaaagcccagtccttttcccctttgtctcgctgacaaagtaagactagggttatgttcatgaatagattaataaaagatgtttctttaccacacaatctgagatgagatggggtgggggagatcatgacagtgccctccaagcaatagatccagctgataatcaagcagaaaatcagacaccagaatccatttgatgatgtacggcattaaacatttccttataacaaa

SEQ ID NO: 103185 - DNA, 5549 bp, Homo sapiens
  Payload ID: 124
  Gene Symbol: AHI1
  Gene Name: Abelson helper integration site 1
  Uniprot ID: Q8N157
  ENST ID: ENST00000457866
  CDS Start-End: 300-3890
ggcggcgcgctgtccgcactgcggcacagagccgcggcttgctttcaggacacgggtcgctggcgggttaggtggctgcgtggccgcctcacttcgcgcacgcgccgctaggctgggggagttgatttgcactgctccgggtgtcggctccggcgggacgggcggttctgcgtacccctctccagtgtcaacctggggctgaatcttcaacctgtcaaagccttcttaattatgtctgagaaaaggatcctgattgagtcaatgctttgcattctcagtcctctgcataaagctgagagatgcctacagctgagagtgaagcaaaagtaaaaaccaaagttcgctttgaagaattgcttaagacccacagtgatctaatgcgtgaaaagaaaaaactgaagaaaaaacttgtcaggtctgaagaaaacatctcacctgacactattagaagcaatcttcactatatgaaagaaactacaagtgatgatcccgacactattagaagcaatcttccccatattaaagaaactacaagtgatgatgtaagtgctgctaacactaacaacctgaagaagagcacgagagtcactaaaaacaaattgaggaacacacagttagcaactgaaaatcctaatggtgatgctagtgtagaggaagacaaacaaggaaagccaaataaaaaggtgataaagacggtgccccagttgactacacaagacctgaaaccggaaactcctgagaataaggttgattctacacaccagaaaacacatacaaagccacagccaggcgttgatcatcagaaaagtgagaaggcaaatgagggaagagaagagactgatttagaagaggatgaagaattgatgcaagcatatcagtgccatgtaactgaagaaatggcaaaggagattaagaggaaaataagaaagaaactgaaagaacagttgacttactttccctcagatactttattccatgatgacaaactaagcagtgaaaaaaggaaaaagaaaaaggaagttccagtcttctctaaagctgaaacaagtacattgaccatctctggtgacacagttgaaggtgaacaaaagaaagaatcttcagttagatcagtttcttcagattctcatcaagatgatgaaataagctcaatggaacaaagcacagaagacagcatgcaagatgatacaaaacctaaaccaaaaaaaacaaaaaagaagactaaagcagttgcagataataatgaagatgttgatggtgatggtgttcatgaaataacaagccgagatagcccggtttatcccaaatgtttgcttgatgatgaccttgtcttgggagtttacattcaccgaactgatagacttaagtcagattttatgatttctcacccaatggtaaaaattcatgtggttgatgagcatactggtcaatatgtcaagaaagatgatagtggacggcctgtttcatcttactatgaaaaagagaatgtggattatattcttcctattatgacccagccatatgattttaaacagttaaaatcaagacttccagagtgggaagaacaaattgtatttaatgaaaattttccctatttgcttcgaggctctgatgagagtcctaaagtcatcctgttctttgagattcttgatttcttaagcgtggatgaaattaagaataattctgaggttcaaaaccaagaatgtggctttcggaaaattgcctgggcatttcttaagcttctgggagccaatggaaatgcaaacatcaactcaaaacttcgcttgcagctatattacccacctactaagcctcgatccccattaagtgttgttgaggcatttgaatggtggtcaaaatgtccaagaaatcattacccatcaacactgtacgtaactgtaagaggactgaaagttccagactgtataaagccatcttaccgctctatgatggctcttcaggaggaaaaaggtaaaccagtgcattgtgaacgtcaccatgagtcaagctcagtagacacagaacctggattagaagagtcaaaggaagtaataaagtggaaacgactccctgggcaggcttgccgtatcccaaacaaacacctcttctcactaaatgcaggagaacgaggatgtttttgtcttgatttctcccacaatggaagaatattagcagcagcttgtgccagccgggatggatatccaattattttatatgaaattccttctggacgtttcatgagagaattgtgtggccacctcaatatcatttatgatctttcctggtcaaaagatgatcactacatccttacttcatcatctgatggcactgccaggatatggaaaaatgaaataaacaatacaaatactttcagagttttacctcatccttcttttgtttacacggctaaattccatccagctgtaagagagctagtagttacaggatgctatgattccatgatacggatatggaaagttgagatgagagaagattctgccatattggtccgacagtttgatgttcacaaaagttttatcaactcactttgttttgatactgaaggtcatcatatgtattcaggagattgtacaggggtgattgttgtttggaatacctatgtcaagattaatgatttggaacattcagtgcaccactggactataaataaggaaattaaagaaactgagtttaagggaattccaataagttatttggagattcatcccaatggaaaacgtttgttaatccataccaaagacagtactttgagaattatggatctccggatattagtagcaaggaagtttgtaggagcagcaaattatcgggagaagattcatagtactttgactccatgtgggacttttctgtttgctggaagtgaggatggtatagtgtatgtttggaacccagaaacaggagaacaagtagccatgtattctgacttgccattcaagtcacccattcgagacatttcttatcatccatttgaaaatatggttgcattctgtgcatttgggcaaaatgagccaattcttctgtatatttacgatttccatgttgcccagcaggaggctgaaatgttcaaacgctacaatggaacatttccattacctggaatacaccaaagtcaagatgccctatgtacctgtccaaaactaccccatcaaggctcttttcagattgatgaatttgtccacactgaaagttcttcaacgaagatgcagctagtaaaacagaggcttgaaactgtcacagaggtgatacgttcctgtgctgcaaaagtcaacaaaaatctctcatttacttcaccaccagcagtttcctcacaacagtctaagttaaagcagtcaaacatgctgaccgctcaagagattctacatcagtttggtttcactcagaccgggattatcagcatagaaagaaagccttgtaaccatcaggtagatacagcaccaacggtagtggctctttatgactacacagcgaatcgatcagatgaactaaccatccatcgcggagacattatccgagtgtttttcaaagataatgaagactggtggtatggcagcataggaaagggacaggaaggttattttccagctaatcatgtggctagtgaaacactgtatcaagaactgcctcctgagataaaggagcgatcccctcctttaagccctgaggaaaaaactaaaatagaaaaatctccagctcctcaaaagcaatcaatcaataagaacaagtcccaggacttcagactaggctcagaatctatgacacattctgaaatgagaaaagaacagagccatgaggaccaaggacacataatggatacacggatgaggaagaacaagcaagcaggcagaaaagtcactctaatagagtaaagaattgaagaaaagttaagagctgccgaaatgcacagaggtgaaaatgacaaaccaaatggaatttctcttcagagttcagaattttcagatactaaggaggaagaaaggatccactacttcttgttcttatgaatgactctagaaaaatcagaatcaagttgtgggtggaaaaatcaacgtggcctttgagttcagttgttataaaccattgtgactattgttggtcaaagtattggtacttatattgttagtaattgcatcataattacattaccagtgttggaaaactaatgaagaaaacactgtaattgctactcagcaaatgtgaataaaaggtgtttgcgttattaggatgtctgttaagtaatcatttaatattattatattggtaatggttgtatgtgtgatgctatgcccagaatatgaagtatctgtttttgaaattcactttatttaaaagataagcagctgactgggcacggtgcctcatgcctgtaatcctagcaccttgggaggctgaggcaggtggatcacctaaggtcaggagttcaacaacaccagcctgaccaacatggtgaaaccccatctctactaaaaatacaaaaatcagccgggtctcatggcaggcacctgtaatcccatctactgaggcaggagaattgcttgacccaggaggcagaggttgcagtgagccaagatcacgccattgcactccagcctgggggacagagcaagactctatctccaaaaaacaaaaaagataagcagctttagaatatggcgcattcaaaacagtctcagtaacaaagacattaaaagaaaacaatttactttctaattaaaattttgtgtttcttaagatcaaatcatataggtaacttcatagacctaaattaaaagtgatttttggctggactggcaacaatgttcccaatgtctttactttttaaaaaaggcttttcatatttaagcacatacctattttgtagacttacattgtttaatatttattttaatcttaatatttttacattattatattgcattatttattttttctaagttccagaataatagtgtcattattatagactatatgttttgaagtttgatattataatgggatattcattttttgttcttttcttgactcctttctcaagtgtgtgataaggtctgctgataaaatatttaaccccaagaaagtgaaaactaatataaaattagaaagacctatccaaattagacagtcaattccattaaaataagaagtgagaaaaacaatgttgggcattgaggtgtaaattttgcccagatgtatacccagtgtgaaatatcttctaataaaaatatatttggctcttatccctgcacatgtagaggcataaaaattggtaaacatgtcccgctgtgtagaactttaaaaaaaaggcatttttgaaagtgttgagtggcactgataactggtgaagcctacagccatccgcccaaaagtctgttctgatggcactgagttttcattgttctggatgtataagtctgtgtgtcaggtacagctgggcccagccagcttgagtcactcttgtacaagcttgtttttttctgtcttgtgaatgcacttgataatttaaaaataaaaatatctgtttctctgca

SEQ ID NO: 103186 - DNA, 3655 bp, Homo sapiens
  Payload ID: 124
  Gene Symbol: AHI1
  Gene Name: Abelson helper integration site 1
  Uniprot ID: Q8N157
  ENST ID: ENST00000531788
  CDS Start-End: 275-2104
acagagccgcggcttgctttcaggacacgggtcgctggcgggttaggtggctgcgtggccgcctcacttcgcgcacgcgccgctaggctgggggagttgatttgcactgctccgggtgtcggctccggcgggacgggcggttctgcgtacccctctccagtgtcaacctggggctgaatcttcaacctgtcaaagccttcttaattatgtctgagaaaaggatcctgattgagtcaatgctttgcattctcagtcctctgcataaagctgagagatgcctacagctgagagtgaagcaaaagtaaaaaccaaagttcgctttgaagaattgcttaagacccacagtgatctaatgcgtgaaaagaaaaaactgaagaaaaaacttgtcaggtctgaagaaaacatctcacctgacactattagaagcaatcttcactatatgaaagaaactacaagtgatgatcccgacactattagaagcaatcttccccatattaaagaaactacaagtgatgatgtaagtgctgctaacactaacaacctgaagaagagcacgagagtcactaaaaacaaattgaggaacacacagttagcaactgaaaatcctaatggtgatgctagtgtagaggaagacaaacaaggaaagccaaataaaaaggtgataaagacggtgccccagttgactacacaagacctgaaaccggaaactcctgagaataaggttgattctacacaccagaaaacacatacaaagccacagccaggcgttgatcatcagaaaagtgagaaggcaaatgagggaagagaagagactgatttagaagaggatgaagaattgatgcaagcatatcagtgccatgtaactgaagaaatggcaaaggagattaagaggaaaataagaaagaaactgaaagaacagttgacttactttccctcagatactttattccatgatgacaaactaagcagtgaaaaaaggaaaaagaaaaaggaagttccagtcttctctaaagctgaaacaagtacattgaccatctctggtgacacagttgaaggtgaacaaaagaaagaatcttcagttagatcagtttcttcagattctcatcaagatgatgaaataagctcaatggaacaaagcacagaagacagcatgcaagatgatacaaaacctaaaccaaaaaaaacaaaaaagaagactaaagcagttgcagataataatgaagatgttgatggtgatggtgttcatgaaataacaagccgagatagcccggtttatcccaaatgtttgcttgatgatgaccttgtcttgggagtttacattcaccgaactgatagacttaagtcagattttatgatttctcacccaatggtaaaaattcatgtggttgatgagcatactggtcaatatgtcaagaaagatgatagtggacggcctgtttcatcttactatgaaaaagagaatgtggattatattcttcctattatgacccagccatatgattttaaacagttaaaatcaagacttccagagtgggaagaacaaattgtatttaatgaaaattttccctatttgcttcgaggctctgatgagagtcctaaagtcatcctgttctttgagattcttgatttcttaagcgtggatgaaattaagaataattctgaggttcaaaaccaagaatgtggctttcggaaaattgcctgggcatttcttaagcttctgggagccaatggaaatgcaaacatcaactcaaaacttcgcttgcagctatattacccacctactaagcctcgatccccattaagtgttgttgaggcatttgaatggtggtcaaaatgtccaagaaatcattacccatcaacactgtacgtaactgtaagaggactgaaagttccagactgtataaagccatcttaccgctctatgatggctcttcaggaggaaaaaggtaaaccagtgcattgtgaacgtcaccatgagtcaagctcagtagacacagaacctggattagaagagtcaaaggaagtaataaagtggaaacgactccctgggcaggagaacgaggatgtttttgtcttgatttctcccacaatggaagaatattagcagcagcttgtgccagccgggatggatatccaattattttatatgaaattccttctggacgtttcatgagagaattgtgtggccacctcaatatcatttatgatctttcctggtcaaaagatgatcactacatccttacttcatcatctgatggcactgccagtattgtgaaagcattaactgagtgaaaagagaagcatgtggctagcatcaaaatgacaaggagagttttgaaagaggatatggaaaaatgaaataaacaatacaaatactttcagagttttacctcatccttcttttgtttacacggctaaattccatccagctgtaagagagctagtagttacaggatgctatgattccatgatacggatatggaaagttgagatgagagaagattctgccatattggtccgacagtttgatgttcacaaaagttttatcaactcactttgttttgatactgaaggtcatcatatgtattcaggagattgtacaggggtgattgttgtttggaatacctatgtcaagattaatgatttggaacattcagtgcaccactggactataaataaggaaattaaagaaactgagtttaagggaattccaataagttatttggagattcatcccaatggaaaacgtttgttaatccataccaaagacagtactttgagaattatggatctccggatattagtagcaaggaagtttgtaggagcagcaaattatcgggagaagattcatagtactttgactccatgtgggacttttctgtttgctggaagtgaggatggtatagtgtatgtttggaacccagaaacaggagaacaagtagccatgtattctgacttgccattcaagtcacccattcgagacatttcttatcatccatttgaaaatatggttgcattctgtgcatttgggcaaaatgagccaattcttctgtatatttacgatttccatgttgcccagcaggaggctgaaatgttcaaacgctacaatggaacatttccattacctggaatacaccaaagtcaagatgccctatgtacctgtccaaaactaccccatcaaggctcttttcagattgatgaatttgtccacactgaaagttcttcaacgaagatgcagctagtaaaacagaggcttgaaactgtcacagaggtgatacgttcctgtgctgcaaaagtcaacaaaaatctctcatttacttcaccaccagcagtttcctcacaacagtctaagttaaagcagtcaaacatgctgaccgctcaagagattctacatcagtttggtttcactcagaccgggattatcagcatagaaagaaagccttgtaaccatcaggtagatacagcaccaacgcactgtatcaagaactgcctcctgagataaaggagcgatcccctcctttaagccctgaggaaaaaactaaaatagaaaaatctccagctcctcaaaaggtaaatgtttttgagcatacgtattacatatgtactttgattttcactctctctggataaaatattactttattttttatgctta

SEQ ID NO: 103187 - DNA, 712 bp, Homo sapiens
  Payload ID: 124
  Gene Symbol: AHI1
  Gene Name: Abelson helper integration site 1
  ENST ID: ENST00000488690
  CDS Start-End: 269-433
gggagttgatttgcactgctccgggtgtcggctccggcgggacgggcggttctgcgtacccctctccagtgtcaacctggggctgaatcttcaacctgtcaaagccttcttaattatgtctgagaaaagtactaaaataggtgccattttaaattcccagacaaggaaaaaccaaggattagaaattaagtagcttgcccaaggccacacatcagatcctgattgagtcaatgctttgcattctcagtcctctgcataaagctgagagatgcctacagctgagagtgaagcaaaagtaaaaaccaaagttcgctttgaagaattgcttaagacccacagtgatctaatgcgtgaaaagaaaaaactgaagaaaaaacttgtcaggtctgaagaaaacatctcaaaccaggagaaatcaatggccgtatggtaataattatccttttatgtttgaggcacactttcaaatgatagaatctttggcagcacacttgaaggaattaaaaatacagtgctcaaagactaagcaaatcagcaactaactacaacctgatccccttggaatcataaagagtctgtattggcatccacagttaatgctctatgccctctttatacctatctccctacttgagttgcactttttactactttgaccattatctcttctgtcctcacagaaaaaaataaacaggctcttgtgtaaatggta

SEQ ID NO: 103188 - DNA, 1074 bp, Homo sapiens
  Payload ID: 124
  Gene Symbol: AHI1
  Gene Name: Abelson helper integration site 1
  ENST ID: ENST00000524469
  CDS Start-End: 210-1074
gagccgcggcttgctttcaggacacgggtcgctggcgggttaggtggctgcgtggccgcctcacttcgcgcacgcgccgctaggctgggggagttgatttgcactgctccgggtgtcggctccggcgggacgggcggttctgcgtacccctctccgatcctgattgagtcaatgctttgcattctcagtcctctgcataaagctgagagatgcctacagctgagagtgaagcaaaagtaaaaaccaaagttcgctttgaagaattgcttaagacccacagtgatctaatgcgtgaaaagaaaaaactgaagaaaaaacttgtcaggtctgaagaaaacatctcacccgacactattagaagcaatcttccccatattaaagaaactacaagtgatgatgtaagtgctgctaacactaacaacctgaagaagagcacgagagtcactaaaaacaaattgaggaacacacagttagcaactgaaaatcctaatggtgatgctagtgtagaggaagacaaacaaggaaagccaaataaaaaggtgataaagacggtgccccagttgactacacaagacctgaaaccggaaactcctgagaataaggttgattctacacaccagaaaacacatacaaagccacagccaggcgttgatcatcagaaaagtgagaaggcaaatgagggaagagaagagactgatttagaagaggatgaagaattgatgcaagcatatcagtgccatgtaactgaagaaatggcaaaggagattaagaggaaaataagaaagaaactgaaagaacagttgacttactttccctcagatactttattccatgatgacaaactaagcagtgaaaaaaggaaaaagaaaaaggaagttccagtcttctctaaagctgaaacaagtacattgaccatctctggtgacacagttgaaggtgaacaaaagaaagaatcttcagttagatcagtttcttcagattctcatcaagatgatgaaataagctcaatggaacaaagcacagaagacagcatgcaagatgatacaaaacctaaaccaaaaaaaacaaaaaaga

SEQ ID NO: 103189 - DNA, 550 bp, Homo sapiens
  Payload ID: 124
  Gene Symbol: AHI1
  Gene Name: Abelson helper integration site 1
  ENST ID: ENST00000527681
  CDS Start-End: 1-88
ggacttcagactaggctcagaatctatgacacaaagagagctgaatgagaaggcaggaggaatatgcatagctagagaaggcctctagataaagttctgaaatgagaaaagaacagagccatgaggaccaaggacacataatggatacacggatgaggaagaacaagcaagcaggcagaaaagtcactctaatagagtaaagaattgaagaaaagttaagagctgccgaaatgcacagaggtgaaaatgacaaaccaaatggaatttctcttcagagttcagaattttcagatactaaggaggaagaaaggatccactacttcttgttcttatgaatgactctagaaaaatcagaatcaagttgtgggtggaaaaatcaacgtggcctttgagttcagttgttataaaccattgtgactattgttggtcaaagtattggtacttatattgttagtaattgcatcataattacattaccagtgttggaaaactaatgaagaaaacactgtaattgctactcagcaaatgtgaataaaaggtgtttgcgtta

SEQ ID NO: 103190 - DNA, 428 bp, Homo sapiens
  Payload ID: 124
  Gene Symbol: AHI1
  Gene Name: Abelson helper integration site 1
  ENST ID: ENST00000529865
  CDS Start-End: 1-389
atggaacatttccattacctggaatacaccaaagtcaagatgccctatgtacctgtccaaaactaccccatcaaggctcttttcagattgatgaatttgtccacactgaaagttcttcaacgaagatgcagctagtaaaacagaggcttgaaactgtcacagaggtgatacgttcctgtgctgcaaaagtcaacaaaaatctctcatttacttcaccaccagcagtttcctcacaacagtctaagttaaagcagtcaaacatgctgaccgctcaagagattctacatcagtttggtttcactcagaccggtgagcccctttcttactttgacaattcttttaaatgttcagatgcttgttgtgttgatgaatatcacttatttctttagaaataaagctcataatggtcggtttttacacttgacaaa

SEQ ID NO: 103191 - DNA, 2920 bp, Homo sapiens
  Payload ID: 124
  Gene Symbol: AHI1
  Gene Name: Abelson helper integration site 1
  ENST ID: ENST00000475846
  CDS Start-End: 1-1627
ctcactaaatgcaggagaacgaggatgtttttgtcttgatttctcccacaatggaagaatattagcagcagcttgtgccagccgggatggatatccaattattttatatgaaattccttctggacgtttcatgagagaattgtgtggccacctcaatatcatttatgatctttcctggtcaaaagatgatcactacatccttacttcatcatctgatggcactgccaggatatggaaaaatgaaataaacaatacaaatactttcagagttttacctcatccttcttttgtttacacggctaaattccatccagctgtaagagagctagtagttacaggatgctatgattccatgatacggatatggaaagttgagatgagagaagattctgccatattggtccgacagtttgatgttcacaaaagttttatcaactcactttgttttgatactgaaggtcatcatatgtattcaggagattgtacaggggtgattgttgtttggaatacctatgtcaagattaatgatttggaacattcagtgcaccactggactataaataaggaaattaaagaaactgagtttaagggaattccaataagttatttggagattcatcccaatggaaaacgtttgttaatccataccaaagacagtactttgagaattatggatctccggatattagtagcaaggaagtttgtaggagcagcaaattatcgggagaagattcatagtactttgactccatgtgggacttttctgtttgctggaagtgaggatggtatagtgtatgtttggaacccagaaacaggagaacaagtagccatgtattctgacttgccattcaagtcacccattcgagacatttcttatcatccatttgaaaatatggttgcattctgtgcatttgggcaaaatgagccaattcttctgtatatttacgatttccatgttgcccagcaggaggctgaaatgttcaaacgctacaatggaacatttccattacctggaatacaccaaagtcaagatgccctatgtacctgtccaaaactaccccatcaaggctcttttcagattgatgaatttgtccacactgaaagttcttcaacgaagatgcagctagtaaaacagaggcttgaaactgtcacagaggtgatacgttcctgtgctgcaaaagtcaacaaaaatctctcatttacttcaccaccagcagtttcctcacaacagtctaagttaaagcagtcaaacatgctgaccgctcaagagattctacatcagtttggtttcactcagaccgggattatcagcatagaaagaaagccttgtaaccatcaggtagatacagcaccaacggtagtggctctttatgactacacagcgaatcgatcagatgaactaaccatccatcgcggagacattatccgagtgtttttcaaagataatgaagactggtggtatggcagcataggaaagggacaggaaggttattttccagctaatcatgtggctagtgaaacactgtatcaagaactgcctcctgagataaaggagcgatcccctcctttaagccctgaggaaaaaactaaaatagaaaaatctccagctcctcaaaaggtaaaataaaacaaaacagctcacagagacacctccttcttccccctgcttctgcctccatgagtaactacctatatgacgtgctgctgctgagaccaaggaatgaatagtgccaaatcttgctgaagaatgatcttgcagaaatctgattgtgaagaaggaaatctaaaaaggccaaacaagcttcagtagagataacaccaggaaagcagttactcaaacaagactgaaagagaagcaatcaatcaataagaacaagtcccaggacttcagactaggctcagaatctatgacacattctgaaatgagaaaagaacagagccatgaggaccaaggacacataatggatacacggatgaggaagaacaagcaagcaggcagaaaagtcactctaatagagtgtgccagctgtcacttttctcaggagtggtcgatggagttgactgctaccttaaccagatttgccatcgttctgaaactgccgtgtgttttctaaggacaaccaggtgttaagcctttctctttagaagaaggacagtaacctttctgttaaagaattgaagaaaagttaagagctgccgaaatgcacagaggtgaaaatgacaaaccaaatggaatttctcttcagagttcagaattttcagatactaaggaggaagaaaggatccactacttcttgttcttatgaatgactctagaaaaatcagaatcaagttgtgggtggaaaaatcaacgtggcctttgagttcagttgttataaaccattgtgactattgttggtcaaagtattggtacttatattgttagtaattgcatcataattacattaccagtgttggaaaactaatgaagaaaacactgtaattgctactcagcaaatgtgaataaaaggtgtttgcgttattaggatgtctgttaagtaatcatttaatattattatattggtaatggttgtatgtgtgatgctatgcccagaatatgaagtatctgtttttgaaattcactttatttaaaagataagcagctgactgggcacggtgcctcatgcctgtaatcctagcaccttgggaggctgaggcaggtggatcacctaaggtcaggagttcaacaacaccagcctgaccaacatggtgaaaccccatctctactaaaaatacaaaaatcagccgggtctcatggcaggcacctgtaatcccatctactgaggcaggagaattgcttgacccaggaggcagaggttgcagtgagccaagatcacgccattgcactccagcctgggggacagagcaagactctatctcc

SEQ ID NO: 103192 - DNA, 441 bp, Homo sapiens
  Payload ID: 124
  Gene Symbol: AHI1
  Gene Name: Abelson helper integration site 1
  ENST ID: ENST00000528103
  CDS Start-End: 142-288
tacaatggcatgatcttgtgtgaagaacgttttataatttttatttggaagttccatattacaaatacatctcctttgtttcgataggatcctgattgagtcaatgctttgcattctcagtcctctgcataaagctgagagatgcctacagctgagagtgaagcaaaagtaaaaaccaaagttcgctttgaagaattgcttaagacccacagtgatctaatgcgtgaaaagaaaaaactgaagaaaaaacttgtcaggtctgaagaaaacatctcagtaagtaaatgatcattgggtaatagtgatttacatatgcgcataaaatgcagatatggctgcattttatgttaaaattctaaggaattttgaaaattaaaaacagtaacactatgtcatggtcaataacatgtggtaaaaataaagtttatattagaatcaaca

SEQ ID NO: 103193 - DNA, 680 bp, Homo sapiens
  Payload ID: 124
  Gene Symbol: AHI1
  Gene Name: Abelson helper integration site 1
  ENST ID: ENST00000534469
  CDS Start-End: 383-529
gaacattttaccagggtgaaaattcaaggttgaggtagagggagctacaaagattaaggcaccctggaagcacagaagagaagttcttaaatgcccttcaaggtgagaatgctctctagagaagatatcatttgcctttaaaggatagtgaggagtttgttagagagacaaaggaggaagcacatttttcaggggaggggatatgtgtgtaatgatacaaaagcaagagagaacttggcacacgtgaaggcctgcaggtagtttcacatgtctggaacacagtggatgtgtgaaggggacatttcataaatggccttggacctcactggatcctgattgagtcaatgctttgcattctcagtcctctgcataaagctgagagatgcctacagctgagagtgaagcaaaagtaaaaaccaaagttcgctttgaagaattgcttaagacccacagtgatctaatgcgtgaaaagaaaaaactgaagaaaaaacttgtcaggtctgaagaaaacatctcagtaagtaaatgatcattgggtaatagtgatttacatatgcgcataaaatgcagatatggctgcattttatgttaaaattctaaggaattttgaaaattaaaaacagtaacactatgtcatggtcaataacatgtggtaaaaataaagtttatattagaatcaa

SEQ ID NO: 103194 - DNA, 1836 bp, Homo sapiens
  Payload ID: 125
  Gene Symbol: ABHD14A-ACY1
  Gene Name: ABHD14A-ACY1 readthrough
  ENST ID: ENST00000463721
  CDS Start-End: 87-590
cggctgcggagtgcgcaggcgcgccgagatggccgcgctcctggccgcctagagccggagcggcccgcggagctgcggaggcagccatggtcggggcgctgtgcggctgctggttccgcctgggcggggcccgcccgctcatcccgttgggcccgactgtggtacagacctccatgagccggtcccaggtagccctgctgggcctgagtctgctgctcatgctcctactgtatgtggggctgccaggcccccctgagcagacttcctgcctctggggagaccccaatgtcacagtcctggctggtctcacccctggcaactcgcccatcttttaccgcgaggtgctcccactcaaccaggcacacagggtggaggtggtgctgcttcatggaaaggcctttaactctcacacgtgggagcagctgggcacactgcagctactgtcacagaggggctaccgggccgtggcccttgaccttccagctcaccacgcgcagcgccatgaccagcaagggtcccgaggaggagcacccatcggtgacgctcttccgccagtacctgcgtatccgcactgtccagcccaagcctgactatggagctgctgtggctttctttgaggagacagcccgccagctgggcctgggctgtcagaaagtagaggtggcacctggctatgtggtgaccgtgttgacctggccaggcaccaaccctacactctcctccatcttgctcaactcccacacggatgtggtgcctgtcttcaaggaacattggagtcacgacccctttgaggccttcaaggattctgagggctacatctatgccaggggtgcccaggacatgaagtgcgtcagcatccagtacctggaagctgtgaggaggctgaaggtggagggccaccggttccccagaaccatccacatgacctttgtgcctgatgaggaggttgggggtcaccaaggcatggagctgttcgtgcagcggcctgagttccacgccctgagggcaggctttgccctggatgagggcatagccaatcccactgatgccttcactgtcttttatagtgagcggagtccctggtgggtgcgggttaccagcactgggaggccaggccatgcctcacgcttcatggaggacacagcagcagagaagctgcacaaggttgtaaactccatcctggcattccgggagaaggaatggcagaggctgcagtcaaacccccacctgaaagaggggtccgtgacctccgtgaacctgactaagctagagggtggcgtggcctataacgtgatacctgccaccatgagcgccagctttgacttccgtgtggcaccggatgtggacttcaaggcttttgaggagcagctgcagagctggtgccaggcagctggcgagggggtcaccctagagtttgctcagaagtggatgcacccccaagtgacacctactgatgactcaaacccttggtgggcagcttttagccgggtctgcaaggatatgaacctcactctggagcctgagatcatgcctgctgccactgacaaccgctatatccgcgcggtgggggtcccagctctaggcttctcacccatgaaccgcacacctgtgctgctgcacgaccacgatgaacggctgcatgaggctgtgttcctccgtggggtggacatatatacacgcctgctgcctgcccttgccagtgtgcctgccctgcccagtgacagctgagccctggaactcctaaacctttgcccctggggcttccatcccaaccagtgccaaggacctcctcttcccccttccaaataataaagtctatggacagggctgtctctg

SEQ ID NO: 103195 - DNA, 1017 bp, Homo sapiens
  Payload ID: 125
  Gene Symbol: ABHD14A-ACY1
  Gene Name: ABHD14A-ACY1 readthrough
  ENST ID: ENST00000486081
  CDS Start-End: 87-590
cggctgcggagtgcgcaggcgcgccgagatggccgcgctcctggccgcctagagccggagcggcccgcggagctgcggaggcagccatggtcggggcgctgtgcggctgctggttccgcctgggcggggcccgcccgctcatcccgttgggcccgactgtggtacagacctccatgagccggtcccaggtagccctgctgggcctgagtctgctgctcatgctcctactgtatgtggggctgccaggcccccctgagcagacttcctgcctctggggagaccccaatgtcacagtcctggctggtctcacccctggcaactcgcccatcttttaccgcgaggtgctcccactcaaccaggcacacagggtggaggtggtgctgcttcatggaaaggcctttaactctcacacgtgggagcagctgggcacactgcagctactgtcacagaggggctaccgggccgtggcccttgaccttccagctcaccacgcgcagcgccatgaccagcaagggtcccgaggaggagcacccatcggtgacgctcttccgccagtacctgcgtatccgcactgtccagcccaagcctgactatggtggcacctggctatgtggtgaccgtgttgacctggccaggcaccaaccctacactctcctccatcttgctcaactcccacacggatgtggtgcctgtcttcaaggaacattggagtcacgacccctttgaggccttcaaggattctgagggctacatctatgccaggggtgcccaggacatgaagtgcgtcagcatccagtacctggaagctgtgaggaggctgaaggtggagggccaccggttccccagaaccatccacatgacctttgtgcctgatgaggaggttgggggtcaccaaggcatggagctgttcgtgcagcggcctgagttccacgccctgagggcaggctttgccctggatgagggcatagccaatcccactgatgccttcactgtcttttatagtgagcggagtccctg

SEQ ID NO: 103196 - DNA, 1705 bp, Homo sapiens
  Payload ID: 125
  Gene Symbol: ABHD14A-ACY1
  Gene Name: ABHD14A-ACY1 readthrough
  ENST ID: ENST00000463937
  CDS Start-End: 77-1606
gtgcgcaggcgcgccgagatggccgcgctcctggccgcctagagccggagcggcccgcggagctgcggaggcagccatggtcggggcgctgtgcggctgctggttccgcctgggcggggcccgcccgctcatcccgttgggcccgactgtggtacagacctccatgagccggtcccaggtagccctgctgggcctgagtctgctgctcatgctcctactgtatgtggggctgccaggcccccctgagcagacttcctgcctctggggagaccccaatgtcacagtcctggctggtctcacccctggcaactcgcccatcttttaccgcgaggtgctcccactcaaccaggcacacagggtggaggtggtgctgcttcatggaaaggcctttaactctcacacgtgggagcagctgggcacactgcagctactgtcacagaggggctaccgggccgtggcccttgaccttccaggagctgctgtggctttctttgaggagacagcccgccagctgggcctgggctgtcagaaagtagaggtggcacctggctatgtggtgaccgtgttgacctggccaggcaccaaccctacactctcctccatcttgctcaactcccacacggatgtggtgcctgtcttcaaggaacattggagtcacgacccctttgaggccttcaaggattctgagggctacatctatgccaggggtgcccaggacatgaagtgcgtcagcatccagtacctggaagctgtgaggaggctgaaggtggagggccaccggttccccagaaccatccacatgacctttgtgcctgatgaggaggttgggggtcaccaaggcatggagctgttcgtgcagcggcctgagttccacgccctgagggcaggctttgccctggatgagggcatagccaatcccactgatgccttcactgtcttttatagtgagcggagtccctggtgggtgcgggttaccagcactgggaggccaggccatgcctcacgcttcatggaggacacagcagcagagaagctgcacaaggttgtaaactccatcctggcattccgggagaaggaatggcagaggctgcagtcaaacccccacctgaaagaggggtccgtgacctccgtgaacctgactaagctagagggtggcgtggcctataacgtgatacctgccaccatgagcgccagctttgacttccgtgtggcaccggatgtggacttcaaggcttttgaggagcagctgcagagctggtgccaggcagctggcgagggggtcaccctagagtttgctcagaagtggatgcacccccaagtgacacctactgatgactcaaacccttggtgggcagcttttagccgggtctgcaaggatatgaacctcactctggagcctgagatcatgcctgctgccactgacaaccgctatatccgcgcggtgggggtcccagctctaggcttctcacccatgaaccgcacacctgtgctgctgcacgaccacgatgaacggctgcatgaggctgtgttcctccgtggggtggacatatatacacgcctgctgcctgcccttgccagtgtgcctgccctgcccagtgacagctgagccctggaactcctaaacctttgcccctggggcttccatcccaaccagtgccaaggacctcctcttcccccttccaaataataaagtctatggacaggg

SEQ ID NO: 103197 - DNA, 1400 bp, Homo sapiens
  Payload ID: 126
  Gene Symbol: ABHD1
  Gene Name: abhydrolase domain containing 1
  Uniprot ID: Q96SE0
  ENST ID: ENST00000316470
  CDS Start-End: 115-1332
gcggggaccggacctgcacaggccgcctatggcgggcggcgggtgggaccgcgagttacagccggccaactggggccagccaggagcctgagggtcggaagcccccaacacaagatgctgagctccttcctgagcccccagaatggcacctgggcagacaccttctctctgctcttggctcttgccgttgccctctacttgggctactactgggcatgtgtgcttcagaggcctcggctggtggctgggccgcagtttctggccttcctggagccacactgttccatcaccaccgagactttctacccaacgctgtggtgttttgaggggcgactacaaagcatcttccaagtcctcctgcagtctcagcccctagtcctttatcagagtgacatcctccaaacaccagatggaggccagctcctgctagactgggccaagcagcctgacagcagccaagaccctgatcctactacccagcccattgtgctgctgcttcctggcatcactggcagtagccaggagacatacgtcttgcacctagttaaccaagctctgagggatggctaccaggctgtcgtgtttaacaaccggggctgccgtggggaggaactgcggacccacagggctttttgtgccagcaatactgaagatctagagacagtcgtgaaccacataaagcatcgttatccccaagctccactgctggccgtgggcatctcttttggagggatactggtgctgaatcacctggcacaggccaggcaggctgcagggctggtggcagcactgactctgtctgcatgctgggattcctttgagaccactcgctccctggaaaccccactcaactcactgctcttcaatcagcccctcactgctgggctctgccaacttgtggaacgaaacagaaaggtgattgaaaaggtggtggacatagactttgtactacaggcccgtacaatccgccagtttgatgagcgctacacatctgtggcctttggatatcaagactgtgttacctactacaaagcagcaagccctagaaccaagatagatgccatccggatccctgtgctctatctcagtgcagcagatgaccccttctcccccgtctgtgcccttcccatacaggccgcccaacactccccctacgttgcgctgctcatcacagcccggggtggccacatcggcttcctggaagggctgctcccgtggcagcactggtacatgagccgcctcttgcatcagtacgccaaagccatcttccaggacccagaggggctgcctgacctcagggctctcttaccttctgaggacagaaacagctgacaagagtaccatttggggtctcagttcactctttccttgtttattaaatatcaacttttcctgcctaa

SEQ ID NO: 103198 - DNA, 1167 bp, Homo sapiens
  Payload ID: 126
  Gene Symbol: ABHD1
  Gene Name: abhydrolase domain containing 1
  ENST ID: ENST00000420647
  CDS Start-End: 142-450
cggggaccggacctgcacaggccgcctatggcgggcggcgggtgggaccgcgagttacagccggccaactggggccagccaggagcctgagggtcggaagcccccaacacaagatgctgagctccttcctgagcccccagaatggcacctgggcagacaccttctctctgctcttggctcttgccgttgccctctacttgggctactactgggcatgtgtgcttcagtgacatcctccaaacaccagatggaggccagctcctgctagactgggccaagcagcctgacagcagccaagaccctgatcctactacccagcccattgtgctgctgcttcctggcatcactggcagtagccaggagacatacgtcttgcacctagttaaccaagctctgagggatggctaccaacccacagggctttttgtgccagcaatactgaagatctagagacagtcgtgaaccacataaagcatcgttatccccaagctccactgctggccgtgggcatctcttttggagggatactggtgctgaatcacctggcacaggccaggcaggctgcagggctggtggcagcactgactctgtctgcatgctgggattcctttgagaccactcgctccctggaaaccccactcaactcactgctcttcaatcagcccctcactgctgggctctgccaacttgtggaacgcctatcctatggtaagacctgcaggcccgtacaatccgccagtttgatgagcgctacacatctgtggcctttggatatcaagactgtgttacctactacaaagcagcaagccctagaaccaagatagatgccatccggatccctgtgctctatctcagtgcagcagatgaccccttctcccccgtctgtgcccttcccatacaggccgcccaacactccccctacgttgcgctgctcatcacagcccggggtggccacatcggcttcctggaagggctgctcccgtggcagcactggtacatgagccgcctcttgcatcagtacgccaaagccatcttccaggacccagaggggctgcctgacctcagggctctcttaccttctgaggacagaaacagctgacaagagtaccatttggggtctcagttcactctttccttgtttattaaatatcaacttttcctgcctaa

SEQ ID NO: 103199 - DNA, 668 bp, Homo sapiens
  Payload ID: 126
  Gene Symbol: ABHD1
  Gene Name: abhydrolase domain containing 1
  ENST ID: ENST00000416071
  CDS Start-End: 138-668
gaccggacctgcacaggccgcctatggcgggcggcgggtgggaccgcgagttacagccggccaactggggccagccaggagcctgagggtcggaagcccccaacacaagatgctgagctccttcctgagcccccagaatggcacctgggcagacaccttctctctgctcttggctcttgccgttgccctctacttgggctactactgggcatgtgtgcttcagtgacatcctccaaacaccagatggaggccagctcctgctagactgggccaagcagcctgacagcagccaagaccctgatcctactacccagcccattgtgctgctgcttcctggcatcactggcagtagccaggagacatacgtcttgcacctagttaaccaagctctgagggatggctaccaggctgtcgtgtttaacaaccggggctgccgtggggaggaactgcggacccacagggctttttgtgccagcaatactgaagatctagagacagtcgtgaaccacataaagcatcgttatccccaagctccactgctggccgtgggcatctcttttggagggatactggtgctgaatcacctggcacaggccaggcaggctgcagggctggtggcagcactgactctgtctgcatgctgggattcctttgagaccactcgctcc

SEQ ID NO: 103200 - DNA, 1387 bp, Homo sapiens
  Payload ID: 126
  Gene Symbol: ABHD1
  Gene Name: abhydrolase domain containing 1
  Uniprot ID: Q96SE0
  ENST ID: ENST00000448950
  CDS Start-End: 127-1044
aaactgcctgcagcggggaccggacctgcacaggccgcctatggcgggcggcgggtgggaccgcgagttacagccggccaactggggccagccaggagcctgagggtcggaagcccccaacacaagatgctgagctccttcctgagcccccagaatggcacctgggcagacaccttctctctgctcttggctcttgccgttgccctctacttgggctactactgggcatgtgtgcttcagaggcctcggctggtggctgggccgcagtttctggccttcctggagccacactgttccatcaccaccgagactttctacccaacgctgtggtgttttgaggggcgactacaaagcatcttccaagtcctcctgcagtctcagcccctagtcctttatcagagtgacatcctccaaacaccagatggaggccagctcctgctagactgggccaagcagcctgacagcagccaagaccctgatcctactacccagcccattgtgctgctgcttcctggcatcactggcagtagccaggagacatacgtcttgcacctagttaaccaagctctgagggatggctaccaggctgtcgtgtttaacaaccggggctgccgtggggaggaactgcggacccacagggctttttgtgccagcaatactgaagatctagagacagtcgtgaaccacataaagcatcgttatccccaagctccactgctggccgtgggcatctcttttggagggatactggtgctgaatcacctggcacaggccaggcaggctgcagggctggtggcagcactgactctgtctgcatgctgggattcctttgagaccactcgctccctggaaaccccactcaactcactgctcttcaatcagcccctcactgctgggctctgccaacttgtggaacgcctatcctatggtaagacctgcaggcccgtacaatccgccagtttgatgagcgctacacatctgtggcctttggatatcaagactgtgttacctactacaaagcagcaagccctagaaccaagatagatgccatccggatccctgtgctctatctcagtgcagcagatgaccccttctcccccgtctgtgcccttcccatacaggccgcccaacactccccctacgttgcgctgctcatcacagcccggggtggccacatcggcttcctggaagggctgctcccgtggcagcactggtacatgagccgcctcttgcatcagtacgccaaagccatcttccaggacccagaggggctgcctgacctcagggctctcttaccttctgaggacagaaacagctgacaagagtaccatttggggtctcagttcactctttccttgtttattaaatatcaacttttcctgcctaa

SEQ ID NO: 103201 - DNA, 1078 bp, Homo sapiens
  Payload ID: 126
  Gene Symbol: ABHD1
  Gene Name: abhydrolase domain containing 1
  Uniprot ID: Q96SE0
  ENST ID: ENST00000621324
  CDS Start-End: 161-1078
ccggggcaccggcggtgggcggggccagcagcgcaaactgcctgcagcggggaccggacctgcacaggccgcctatggcgggcggcgggtgggaccgcgagttacagccggccaactggggccagccaggagcctgagggtcggaagcccccaacacaagatgctgagctccttcctgagcccccagaatggcacctgggcagacaccttctctctgctcttggctcttgccgttgccctctacttgggctactactgggcatgtgtgcttcagaggcctcggctggtggctgggccgcagtttctggccttcctggagccacactgttccatcaccaccgagactttctacccaacgctgtggtgttttgaggggcgactacaaagcatcttccaagtcctcctgcagtctcagcccctagtcctttatcagagtgacatcctccaaacaccagatggaggccagctcctgctagactgggccaagcagcctgacagcagccaagaccctgatcctactacccagcccattgtgctgctgcttcctggcatcactggcagtagccaggagacatacgtcttgcacctagttaaccaagctctgagggatggctaccaggctgtcgtgtttaacaaccggggctgccgtggggaggaactgcggacccacagggctttttgtgccagcaatactgaagatctagagacagtcgtgaaccacataaagcatcgttatccccaagctccactgctggccgtgggcatctcttttggagggatactggtgctgaatcacctggcacaggccaggcaggctgcagggctggtggcagcactgactctgtctgcatgctgggattcctttgagaccactcgctccctggaaaccccactcaactcactgctcttcaatcagcccctcactgctgggctctgccaacttgtggaacgcctatcctatggtaagacctgcaggcccgtacaatccgccagtttgatgagcgctacacatctgtggcctttggatatcaagactgtgttacctactacaaagcagcaagccctagaaccaagatag

SEQ ID NO: 103202 - DNA, 2590 bp, Homo sapiens
  Payload ID: 127
  Gene Symbol: ABHD10
  Gene Name: abhydrolase domain containing 10
  Uniprot ID: Q9NUJ1
  ENST ID: ENST00000273359
  CDS Start-End: 28-948
ctgcagggtgcggggacaactacgaagatggcggttgcgcgcttggcagctgtggcggcctgggtaccttgtcggagctggggctgggcagccgtccccttcggtccccaccgtggcctcagcgtgctgcttgcacggatacctcagcgggcgccacggtggctcccagcttgtagacaaaagacgtcactctcattccttaatcgaccagaccttccaaacctggcttataagaagctaaaaggcaaaagtccaggaattatcttcatccctggctatctttcttatatgaatggtacaaaagcgttggcgattgaggagttttgcaaatctctaggtcacgcctgcataaggtttgattactcaggagttggaagttcagatggtaactcagaggaaagcacactggggaaatggagaaaagatgttctttctataattgatgacttagctgatgggccacagattcttgttggatctagccttggagggtggcttatgcttcatgctgcaattgcacgaccagagaaggtcgtggctcttattggtgtagctacagctgcagataccttagtgacaaagtttaatcagcttcctgttgagctaaaaaaggaagtagagatgaaaggtgtgtggagcatgccatcaaaatactctgaagaaggagtttataacgttcagtacagtttcattaaagaagctgaacatcactgcttgttacatagcccaattcctgtgaactgccccataagattgctccatggcatgaaggatgacattgtaccttggcatacatcaatgcaggttgccgatcgagtactcagcacagatgtggatgtcatcctccgaaaacacagtgatcaccgaatgagggaaaaagcagacattcaacttcttgtttacactattgatgacttaattgataagctctcaactatagttaactagtatcacatgtttagttggtatgtaaactaatgtatccagaagattggaagagggataagaaatgaaagatcctgatactttaggtttttccctttcctctattttgtaaatataagatgagtattatttaatgatgtatttgcataagtaatgcaaattgtgaagaaggaccagctgctgtttagaaaattttctccttccttctgtccttgattttttttcattaaagtatttcctttttttaattcaagaaaagtttacctttcttatgcttatgttagctatgccagctcttaattgcatccttttctaattaggattattaataaagcgtgaatattttgttttttattatagacagaaatttgtaacattacttctgatttgaaaatgcaattcacaaaatatagggaaatttttattgaagtaaatttgaaatgatggagaaatttcagaagcataataaagttcacaataaggataatactttatataatgtataaagtatatataatataatatatatgttatataaactgcacattatattcaaacttaaaattgagctttttttttaaaggcccaaaattgtacagtgatacaaggagctatttctaaaatttggcttatgtataatatatttaaatggggaatttcatctaaaacaatgatgtagtatttttaatattctgattggtaaaattaaagaggaaattaatctttatatattatttcttgcagaaacattcattattttattaatattgccctaagtacaactaggcaagtgattgccacctaaatcagaagacgttctaaagtcagtaagaaagtgtgaaatgctagtataaaggttattttttttctttcctaaataactaaagtgaggtgtagattgagccttgatattatttagttaatgttttttattaattaattttggctggactttatttagcttgattaggttattatctgtcaaaccttttaagttgacaacatgactcatatatatacatgtgtataagatgagcatgtgtcgaagacttattcgactcattaatgaggaaaccagcagatagtaaacctggttcaaagtacaattcaagaaactgagtatttatgggcattgaagaaaaaatgttgagataaaattgctgtgcagaaaaaagtgttaatgaagccgacctgactacttaaccttagagacctgctttacaaggttggcccttgattggcatctgggaacttggagttcagggggcttccaccattcccagaactgatcaaagtagcttactatatctaaactgtaaaacaatatagtttctcctgaacacctgctttccttctgggagtctggaattttggtatgtgccaggcagagactacctttgtgaccagctcccagtaaaaaccccaggcactcagtctctaacaagcttttctggttgacagtgtttcacaagtgctgttacaactggttgctgggagaattaagctcatcctctgtgattccactggcggaggattcttggaagcttgcacttagtttcccctgacttcaccccatgtgtcttttttcctttgctgattttgttttgtatcctttcactgtaataaatcatggccgtgagcagaa

SEQ ID NO: 103203 - DNA, 890 bp, Homo sapiens
  Payload ID: 127
  Gene Symbol: ABHD10
  Gene Name: abhydrolase domain containing 10
  ENST ID: ENST00000493784
  CDS Start-End: 11-169
aactacgaagatggcggttgcgcgcttggcagctgtggcggcctgggtaccttgtcggagctggggctgggcagccgtccccttcggtccccaccgtggcctcagcgtgctgcttgcacggatacctcagcgggcgccacggtggctcccagattcttgttggatctagccttggagggtggcttatgcttcatgctgcaattgcacgaccagagaaggtcgtggctcttattggtgtagctacagctgcagataccttagtgacaaagtttaatcagcttcctgttgagctaaaaaaggaagtagagatgaaaggtgtgtggagcatgccatcaaaatactctgaagaaggagtttataacgttcagtacagtttcattaaagaagctgaacatcactgcttgttacatagcccaattcctgtgaactgccccataagattgctccatggcatgaaggatgacattgtaccttggcatacatcaatgcaggttgccgatcgagtactcagcacagatgtggatgtcatcctccgaaaacacagtgatcaccgaatgagggaaaaagcagacattcaacttcttgtttacactattgatgacttaattgataagctctcaactatagttaactagtatcacatgtttagttggtatgtaaactaatgtatccagaagattggaagagggataagaaatgaaagatcctgatactttaggtttttccctttcctctattttgtaaatataagatgagtattatttaatgatgtatttgcataagtaatgcaaattgtgaagaaggaccagctgctgtttagaaaattttctccttccttctgtccttgattttttttcattaaagtatttcctttttttaattcaagaaaa

SEQ ID NO: 103204 - DNA, 1339 bp, Homo sapiens
  Payload ID: 127
  Gene Symbol: ABHD10
  Gene Name: abhydrolase domain containing 10
  ENST ID: ENST00000491580
  CDS Start-End: 53-280
gcgtagcgtgtccctcagtgggacactgcagggtgcggggacaactacgaagatggcggttgcgcgcttggcagctgtggcggcctgggtaccttgtcggagctggggctgggcagccgtccccttcggtccccaccgtggcctcagcgtgctgcttgcacggatacctcagcgggcgccacggtggctcccaggtttgattactcaggagttggaagttcagatggtaactcagaggaaagcacactggggaaatggagaaaagatgttctttctataattgatgacttagctgatgggccacagattcttgttggatctagccttggagggtggcttatgcttcatgctgcaattgcacgaccagagaaggtcgtggctcttattggtgtagctacagctgcagataccttagtgacaaagtttaatcagcttcctgttgagctaaaaaaggaagtagagatgaaaggtgtgtggagcatgccatcaaaatactctgaagaaggagtttataacgttcagtacagtttcattaaagaagctgaacatcactgcttgttacatagcccaattcctgtgaactgccccataagattgctccatggcatgaaggatgacattgtaccttggcatacatcaatgcaggttgccgatcgagtactcagcacagatgtggatgtcatcctccgaaaacacagtgatcaccgaatgagggaaaaagcagacattcaacttcttgtttacactattgatgacttaattgataagctctcaactatagttaactagtatcacatgtttagttggtatgtaaactaatgtatccagaagattggaagagggataagaaatgaaagatcctgatactttaggtttttccctttcctctattttgtaaatataagatgagtattatttaatgatgtatttgcataagtaatgcaaattgtgaagaaggaccagctgctgtttagaaaattttctccttccttctgtccttgattttttttcattaaagtatttcctttttttaattcaagaaaagtttacctttcttatgcttatgttagctatgccagctcttaattgcatccttttctaattaggattattaataaagcgtgaatattttgttttttattatagacagaaatttgtaacattacttctgatttgaaaatgcaattcacaaaatatagggaaatttttattgaagtaaatttgaaatgatggagaaatttcagaagcataataaagttcacaataaggataatactttatataatgtataaagtatatataatataatatatatgttatataaactgcacattatatt

SEQ ID NO: 103205 - DNA, 801 bp, Homo sapiens
  Payload ID: 127
  Gene Symbol: ABHD10
  Gene Name: abhydrolase domain containing 10
  Uniprot ID: Q9NUJ1
  ENST ID: ENST00000494817
  CDS Start-End: 10-627
actacgaagatggcggttgcgcgcttggcagctgtggcggcctgggtaccttgtcggagctggggctgggcagccgtccccttcggtccccaccgtggcctcagcgtgctgcttgcacggatacctcagcgggcgccacggtggctcccagcttgtagacaaaagacgtcactctcattccttaatcgaccagaccttccaaacctggcttataagaagctaaaaggcaaaagtccaggaattatcttcatccctggctatctttcttatatgaatggtacaaaagcgttggcgattgaggagttttgcaaatctctaggtcacgcctgcataaggtttgattactcaggagttggaagttcagatggtaactcagaggaaagcacactggggaaatggagaaaagatgttctttctataattgatgacttagctgatgggccacagattcttgttggatctagccttggagggtggcttatgcttcatgctgcaattgcacgaccagagaaggtcgtggctcttattggtgtagctacagctgcagataccttagtgacaaagtttaatcagcttcctgttgaggactctggaaggaaaaactatatttctttacattcagcctaaaattgcatgactaaaaaaggaagtagagatgaaaggtgtgtggagcatgccatcaaaatactctgaagaaggagtttataacgttcagtacagtttcattaaagaagctgaacatcactgcttgttacatagcccaattcctgtgaactgccccataagattgctccatggcat

SEQ ID NO: 103206 - DNA, 1483 bp, Homo sapiens
  Payload ID: 128
  Gene Symbol: ABHD11
  Gene Name: abhydrolase domain containing 11
  Uniprot ID: Q8NFV4
  ENST ID: ENST00000222800
  CDS Start-End: 71-1018
tgaagacggaaatgggcggggctgcgagctagggcgggagaaggagcgcggggaggacgtaccttgtgagatgcgagccggccaacagcttgcaagcatgctccgctggacccgagcctggaggctcccgcgtgagggactcggcccccacggccctagcttcgcgagggtgcctgtcgcacccagcagcagcagcggcggccgagggggcgccgagccgaggccgcttccgctttcctacaggcttctggacggggaggcagccctcccggccgtcgtctttttgcacgggctcttcggcagcaaaactaacttcaactccatcgccaagatcttggcccagcagacaggccgtagggtgctgacggtggatgctcgtaaccacggtgacagcccccacagcccagacatgagctacgagatcatgagccaggacctgcaggaccttctgccccagctgggcctggtgccctgcgtcgtcgttggccacagcatgggaggaaagacagccatgctgctggcactacagaggccagagctggtggaacgtctcattgctgtagatatcagcccagtggaaagcacaggtgtctcccactttgcaacctatgtggcagccatgagggccatcaacatcgcagatgagctgccccgctcccgtgcccgaaaactggcggatgaacagctcagttctgtcatccaggacatggccgtgcggcagcacctgctcactaacctggtagaggtagacgggcgcttcgtgtggagggtgaacttggatgccctgacccagcacctagacaagatcttggctttcccacagaggcaggagtcctacctcgggccaacactctttctccttggtggaaactcccagttcgtgcatcccagccaccaccctgagattatgcggctcttccctcgggcccagatgcagacggtgccgaacgctggccactggatccacgctgaccgcccacaggacttcatagctgccatccgaggcttcctggtctaagagttgctggcaagaagatggccgggcgtggtggctcatgcctgtaattccagcactttgggaggctaaggcgggaggatgacttgaggccaggagttggagaccagcctggccaacatggtgaaaccctgtctctactaaaaatacaaaaattagcctggcgtggtggtgcacacctgtaatcccagctactctggaggctgaggcaggagaatcacttgaaccctggaggcagaggttgcaatgagccgagatcacaccactacactccagcctaggcaacagagcaagactctgtctcaaaaaaaacaaaacaaaaaggaggcacaaaaccccaggcttcaagtctctgcagcctgctccacatttgggcacagaaggactcagacaggcactgtgtgggcacgaggttttacaggggtggtcagacctcaggctttaatgaataaagacactactcccaaa

SEQ ID NO: 103207 - DNA, 812 bp, Homo sapiens
  Payload ID: 128
  Gene Symbol: ABHD11
  Gene Name: abhydrolase domain containing 11
  Uniprot ID: Q8NFV4
  ENST ID: ENST00000395147
  CDS Start-End: 36-812
gggagaaggagcgcggggaggacgtaccttgtgagatgcgagccggccaacagcttgcaagcatgctccgctggacccgagcctggaggctcccgcgtgagggactcggcccccacggccctagcttcgcgagggtgcctgtcgcacccagcagcagcagcggcggccgagggggcgccgagccgaggccgcttccgctttcctacaggcttctggacggggaggcagccctcccggccgtcgtctttttgcacgggctcttcggcagcaaaactaacttcaactccatcgccaagatcttggcccagcagacaggccgtagggtgctgacggtggatgctcgtaaccacggtgacagcccccacagcccagacatgagctacgagatcatgagccaggacctgcaggaccttctgccccagctgggcctggtgccctgcgtcgtcgttggccacagcatgggaggaaagacagccatgctgctggcactacagagggacatggccgtgcggcagcacctgctcactaacctggtagaggtagacgggcgcttcgtgtggagggtgaacttggatgccctgacccagcacctagacaagatcttggctttcccacagaggcaggagtcctacctcgggccaacactctttctccttggtggaaactcccagttcgtgcatcccagccaccaccctgagattatgcggctcttccctcgggcccagatgcagacggtgccgaacgctggccactggatccacgctgaccgcccacaggacttcatagctgccatccgaggcttcctggtctaa

SEQ ID NO: 103208 - DNA, 852 bp, Homo sapiens
  Payload ID: 128
  Gene Symbol: ABHD11
  Gene Name: abhydrolase domain containing 11
  ENST ID: ENST00000412965
  CDS Start-End: 1-554
cgcgtgagggactcggcccccacggccctagcttcgcgagggtgcctgtcgcacccagcagcagcagcggcggccgagggggcgccgagccgaggccgcttccgctttcctacaggcttctggacggggaggcagccctcccggccgtcgtctttttgcacgggctcttcggcagcaaaactaacttcaactccatcgccaagatcttggcccagcagacaggccgtagggtgctgacggtggatgctcgtaaccacggtgacagcccccacagcccagacatgagctacgagatcatgagccaggacctgcaggaccttctgccccagctgggcctggtgccctgcgtcgtcgttggccacagcatgggaggaaagacagccatgctgctggcactacagagggtgatacacccaaggtgccccggatggtattgtagaccaggacctgtcaagggaagagtggcacccccagaccgcacaaggaacctcccccaactgctgcacccccacaggacatggccgtgcggcagcacctgctcactaacctggtagaggtagacgggcgcttcgtgtggagggtgaacttggatgccctgacccagcacctagacaagatcttggctttcccacagaggcaggagtcctacctcgggccaacactctttctccttggtggaaactcccagttcgtgcatcccagccaccaccctgagattatgcggctcttccctcgggcccagatgcagacggtgccgaacgctggccactggatccacgctgaccgcccacaggacttcatagctgccatccgaggcttcctggtctaagagttgctggcaagaagatggcc

SEQ ID NO: 103209 - DNA, 1463 bp, Homo sapiens
  Payload ID: 128
  Gene Symbol: ABHD11
  Gene Name: abhydrolase domain containing 11
  Uniprot ID: Q8NFV4
  ENST ID: ENST00000357419
  CDS Start-End: 56-361
gcggggctgcgagctagggcgggagaaggagcgcggggaggacgtaccttgtgagatgcgagccggccaacagcttgcaagcatgctccgctggacccgagcctggaggctcccgcgtgagggactcggcccccacggccctagcttcgcgagggtgcctgtcgcacccagcagcagcagcggcggccgagggggcgccgagccgaggccgcttccgctttcctacaggcttctggacggggaggcagccctcccggccgtcgtctttttgcacgggctcttcggcagcaaaactaacttcaactccatcgccaagatcttggcccagcagacaggccgtgctgacggtggatgctcgtaaccacggtgacagcccccacagcccagacatgagctacgagatcatgagccaggacctgcaggaccttctgccccagctgggcctggtgccctgcgtcgtcgttggccacagcatgggaggaaagacagccatgctgctggcactacagaggccagagctggtggaacgtctcattgctgtagatatcagcccagtggaaagcacaggtgtctcccactttgcaacctatgtggcagccatgagggccatcaacatcgcagatgagctgccccgctcccgtgcccgaaaactggcggatgaacagctcagttctgtcatccaggacatggccgtgcggcagcacctgctcactaacctggtagaggtagacgggcgcttcgtgtggagggtgaacttggatgccctgacccagcacctagacaagatcttggctttcccacagaggcaggagtcctacctcgggccaacactctttctccttggtggaaactcccagttcgtgcatcccagccaccaccctgagattatgcggctcttccctcgggcccagatgcagacggtgccgaacgctggccactggatccacgctgaccgcccacaggacttcatagctgccatccgaggcttcctggtctaagagttgctggcaagaagatggccgggcgtggtggctcatgcctgtaattccagcactttgggaggctaaggcgggaggatgacttgaggccaggagttggagaccagcctggccaacatggtgaaaccctgtctctactaaaaatacaaaaattagcctggcgtggtggtgcacacctgtaatcccagctactctggaggctgaggcaggagaatcacttgaaccctggaggcagaggttgcaatgagccgagatcacaccactacactccagcctaggcaacagagcaagactctgtctcaaaaaaaacaaaacaaaaaggaggcacaaaaccccaggcttcaagtctctgcagcctgctccacatttgggcacagaaggactcagacaggcactgtgtgggcacgaggttttacaggggtggtcagacctcaggctttaatgaataaagacactactcccaaa

SEQ ID NO: 103210 - DNA, 890 bp, Homo sapiens
  Payload ID: 128
  Gene Symbol: ABHD11
  Gene Name: abhydrolase domain containing 11
  ENST ID: ENST00000458339
  CDS Start-End: 27-506
agcgcggggaggacgtaccttgtgagatgcgagccggccaacagcttgcaagcatgctccgctggacccgagcctggaggctcccgcgtgagggactcggcccccacggccctagcttcgcgagggtgcctgtcgcacccagcagcagcagcggcggccgagggggcgccgagccgaggccgcttccgctttcctacaggcttctggacggggaggcagccctcccggccgtcgtctttttgcacgggctcttcggcagcaaaactaacttcaactccatcgccaagatcttggcccagcagacaggccgtagggtgctgacggtggatgctcgtaaccacggtgacagcccccacagcccagacatgagctacgagatcatgagccaggacctgcaggaccttctgccccagctgggcctggtgccctgcgtcgtcgttggccacagcatgggaggaaagacagccatgctgctggcactacagaggtcccagccaccaccctgagattatgcggctcttccctcgggcccagatgcagacggtgccgaacgctggccactggatccacgctgaccgcccacaggacttcatagctgccatccgaggcttcctggtctaagagttgctggcaagaagatggccgggcgtggtggctcatgcctgtaattccagcactttgggaggctaaggcgggaggatgacttgaggccaggagttggagaccagcctggccaacatggtgaaaccctgtctctactaaaaatacaaaaattagcctggcgtggtggtgcacacctgtaatcccagctactctggaggctgaggcaggagaatcacttgaaccctggaggcagaggttgcaatgagccgagatcacaccactacact

SEQ ID NO: 103211 - DNA, 760 bp, Homo sapiens
  Payload ID: 128
  Gene Symbol: ABHD11
  Gene Name: abhydrolase domain containing 11
  ENST ID: ENST00000437891
  CDS Start-End: 1-370
gccgcttccgctttcctacaggcttctggacggggaggcagccctcccggccgtcgtctttttgcacgggctcttcggcagcaaaactaacttcaactccatcgccaagatcttggcccagcagacaggccgtagggtgctgacggtggatgctcgtaaccacggtgacagcccccacagcccagacatgagctacgagatcatgagccaggacctgcaggaccttctgccccagctgggcctggtgccctgcgtcgtcgttggccacagcatgggaggaaagacagccatgctgctggcactacagaggatatcagcccagtggaaagcacaggtgtctcccactttgcaacctatgtggcagccatgagggccatcaacatcgcagatgagctgccccgctcccgtgcccgaaaactggcggatgaacagctcagttctgtcatccaggacatggccgtgcggcagcacctgctcactaacctggtagaggtagacgggcgcttcgtgtggagggtgaacttggatgccctgacccagcacctagacaagatcttggctttcccacagaggcaggagtcctacctcgggccaacactctttctccttggtggaaactcccagttcgtgcatcccagccaccaccctgagattatgcggctcttccctcgggcccagatgcagacggtgccgaacgctggccactggatccacgctgaccgcccacaggacttcatagctgccatccgaggcttcctgg

SEQ ID NO: 103212 - DNA, 1447 bp, Homo sapiens
  Payload ID: 128
  Gene Symbol: ABHD11
  Gene Name: abhydrolase domain containing 11
  Uniprot ID: Q8NFV4
  ENST ID: ENST00000437775
  CDS Start-End: 56-982
gcggggctgcgagctagggcgggagaaggagcgcggggaggacgtaccttgtgagatgcgagccggccaacagcttgcaagcatgctccgctggacccgagcctggaggctcccgcgtgagggactcggcccccacggccctagcttcgcgagggtgcctgtcgcacccagcagcagcagcggcggccgagggggcgccgagccgaggcttctggacggggaggcagccctcccggccgtcgtctttttgcacgggctcttcggcagcaaaactaacttcaactccatcgccaagatcttggcccagcagacaggccgtagggtgctgacggtggatgctcgtaaccacggtgacagcccccacagcccagacatgagctacgagatcatgagccaggacctgcaggaccttctgccccagctgggcctggtgccctgcgtcgtcgttggccacagcatgggaggaaagacagccatgctgctggcactacagaggccagagctggtggaacgtctcattgctgtagatatcagcccagtggaaagcacaggtgtctcccactttgcaacctatgtggcagccatgagggccatcaacatcgcagatgagctgccccgctcccgtgcccgaaaactggcggatgaacagctcagttctgtcatccaggacatggccgtgcggcagcacctgctcactaacctggtagaggtagacgggcgcttcgtgtggagggtgaacttggatgccctgacccagcacctagacaagatcttggctttcccacagaggcaggagtcctacctcgggccaacactctttctccttggtggaaactcccagttcgtgcatcccagccaccaccctgagattatgcggctcttccctcgggcccagatgcagacggtgccgaacgctggccactggatccacgctgaccgcccacaggacttcatagctgccatccgaggcttcctggtctaagagttgctggcaagaagatggccgggcgtggtggctcatgcctgtaattccagcactttgggaggctaaggcgggaggatgacttgaggccaggagttggagaccagcctggccaacatggtgaaaccctgtctctactaaaaatacaaaaattagcctggcgtggtggtgcacacctgtaatcccagctactctggaggctgaggcaggagaatcacttgaaccctggaggcagaggttgcaatgagccgagatcacaccactacactccagcctaggcaacagagcaagactctgtctcaaaaaaaacaaaacaaaaaggaggcacaaaaccccaggcttcaagtctctgcagcctgctccacatttgggcacagaaggactcagacaggcactgtgtgggcacgaggttttacaggggtggtcagacctcaggctttaatgaataaagacactactcccaaa

SEQ ID NO: 103213 - DNA, 623 bp, Homo sapiens
  Payload ID: 128
  Gene Symbol: ABHD11
  Gene Name: abhydrolase domain containing 11
  ENST ID: ENST00000474130
  CDS Start-End: 1-264
ctccgctggacccgagcctggaggctcccgcgtgagggactcggcccccacggccctagcttcgcgagggtgcctgtcgcacccagcagcagcagcggcggccgagggggcgccgagccgaggccgcttccgctttcctacaggcttctggacggggaggcagccctcccggccgtcgtctttttgcacgggctcttcggcagcaaaactaacttcaactccatcgccaagatcttggcccagcagacaggccgtaggggatgaccgggagctcaccacctcttatggcagcccattcttctgtgctcctactgttggaaattcctggagtctccttcctggcattctccgagattgccacccagccaggccagcccttcagagacgtggtcacaaccctggggcctgctcttctctggcagagtggccccaggttcttcatctgggcctcctaggtgctgacggtggatgctcgtaaccacggtgacagcccccacagcccagacatgagctacgagatcatgagccaggacctgcaggaccttctgccccagctgggcctggtgccctgcgtcgtcgttggccacagcatgggaggaaagacagccatgctgctggcacta

SEQ ID NO: 103214 - DNA, 2117 bp, Homo sapiens
  Payload ID: 129
  Gene Symbol: ABHD12
  Gene Name: abhydrolase domain containing 12
  Uniprot ID: Q8N2K0
  ENST ID: ENST00000339157
  CDS Start-End: 274-1470
atgctgggcgcgcgctccttggaactagagaggaggtggccggggcggggccgggggaggggggtagggcagagccggcgggagcccggcgctgattggccggcctggctggcgggcccccgccgctggttcgtagccggcgcagcggcctgggctgggatgtgaggagcggcgggttccgggctccgggctctgggtggcggcggctgtgagcggcggcactgcggcgcaggccagcgggcgccgtcggcggctggccctgtcggccgcgggatgaggaagcggaccgagcccgtcgccttggagcatgagcgctgcgccgccgcgggctcgtcctcctccggctcggccgccgcggcgctggacgccgactgccgcctgaagcagaacctacgcctgacgggcccggcggcggctgagccgcgctgcgcagccgacgcgggaatgaagcgggcgctgggcaggcgaaagggcgtgtggttgcgcctgaggaagatacttttctgtgttttggggttgtacattgccattccatttctcatcaaactatgtcctggaatacaggccaaactgattttcttgaatttcgtaagagttccctatttcattgatttgaaaaaaccacaggatcaaggtttgaatcacacgtgtaactactacctgcagccagaggaagacgtgaccattggagtctggcacaccgtccctgcagtctggtggaagaacgcccaaggcaaagaccagatgtggtatgaggatgccttggcttccagccaccctatcattctgtacctgcatgggaacgcaggtaccagaggaggcgaccaccgcgtggagctttacaaggtgctgagttcccttggttaccatgtggtcacctttgactacagaggttggggtgactcagtgggaacgccatctgagcggggcatgacctatgacgcactccacgtttttgactggatcaaagcaagaagtggtgacaaccccgtgtacatctggggccactctctgggcactggcgtggcgacaaatctggtgcggcgcctctgtgagcgagagacgcctccagatgcccttatattggaatctccattcactaatatccgcgaagaagctaagagccatccattttcagtgatatatcgatacttccctgggtttgactggttcttccttgatcctattacaagtagtggaattaaatttgcaaatgatgaaaacgtgaagcacatctcctgtcccctgctcatcctgcacgctgaggacgacccggtggtgcccttccagcttggcagaaagctctatagcatcgccgcaccagctcgaagcttccgagatttcaaagttcagtttgtgccctttcattcagaccttggctacaggcacaaatacatttacaagagccctgagctgccacggatactgagggaattcctggggaagtcggagcctgagcaccagcactgagcctggccgtgggaaggaagcatgaagacctctgccctcctcccgttttcctccagtcagcagcccggtatcctgaagccccggggggccggcacctgcaatgctcaggagcccagctcgcacctggagagcacctcagatcccaggcggggaggcccctgcaggcctgcagtgcccggaggcctgagcatggctgtgtggaaagcgtgggtggcaggcatgtggctctccttgccgcccctcaacctgagatcttgttgggagacttaatggcagcaggcagccatcactgcctgcttgatgctgcactgagctggacagggggagtccgggcaggggactcttggggctcgggaccatgctgagctttttggcaccacccacagagaacgtggggtccaggttctttctgcaccttcccagcacatgcagaatgactccagtggttccatcgtcccctcctgccctgtgtacctgcttgcctttctcagctgccccacctcccctgggctggcccactcacccacagtggaagtgcccgggatctgcacttcctcccctttcacctacctgtacacctaacctggccttagactgagctttatttaagaataaaatcgtggtggtggtccttttgtctctctgca

SEQ ID NO: 103215 - DNA, 1725 bp, Homo sapiens
  Payload ID: 129
  Gene Symbol: ABHD12
  Gene Name: abhydrolase domain containing 12
  Uniprot ID: Q8N2K0
  ENST ID: ENST00000376542
  CDS Start-End: 281-1495
gccagggatgctgggcgcgcgctccttggaactagagaggaggtggccggggcggggccgggggaggggggtagggcagagccggcgggagcccggcgctgattggccggcctggctggcgggcccccgccgctggttcgtagccggcgcagcggcctgggctgggatgtgaggagcggcgggttccgggctccgggctctgggtggcggcggctgtgagcggcggcactgcggcgcaggccagcgggcgccgtcggcggctggccctgtcggccgcgggatgaggaagcggaccgagcccgtcgccttggagcatgagcgctgcgccgccgcgggctcgtcctcctccggctcggccgccgcggcgctggacgccgactgccgcctgaagcagaacctacgcctgacgggcccggcggcggctgagccgcgctgcgcagccgacgcgggaatgaagcgggcgctgggcaggcgaaagggcgtgtggttgcgcctgaggaagatacttttctgtgttttggggttgtacattgccattccatttctcatcaaactatgtcctggaatacaggccaaactgattttcttgaatttcgtaagagttccctatttcattgatttgaaaaaaccacaggatcaaggtttgaatcacacgtgtaactactacctgcagccagaggaagacgtgaccattggagtctggcacaccgtccctgcagtctggtggaagaacgcccaaggcaaagaccagatgtggtatgaggatgccttggcttccagccaccctatcattctgtacctgcatgggaacgcaggtaccagaggaggcgaccaccgcgtggagctttacaaggtgctgagttcccttggttaccatgtggtcacctttgactacagaggttggggtgactcagtgggaacgccatctgagcggggcatgacctatgacgcactccacgtttttgactggatcaaagcaagaagtggtgacaaccccgtgtacatctggggccactctctgggcactggcgtggcgacaaatctggtgcggcgcctctgtgagcgagagacgcctccagatgcccttatattggaatctccattcactaatatccgcgaagaagctaagagccatccattttcagtgatatatcgatacttccctgggtttgactggttcttccttgatcctattacaagtagtggaattaaatttgcaaatgatgaaaacgtgaagcacatctcctgtcccctgctcatcctgcacgctgaggacgacccggtggtgcccttccagcttggcagaaagctctatagcatcgccgcaccagctcgaagcttccgagatttcaaagttcagtttgtgccctttcattcagaccttggctacaggcacaaatacatttacaagagccctgagctgccacggatactgagacctcagcagggcccaggttccagcccagatcccagcatgtggtcagagctggtgtgactgaagccaacaggtgacacggtcatcgaagagcagcagacaaaactaaaactaacccaaaggcagctgaaagtggagggcaggtgaattcccagccctcgccggattcaacttttgccaacggtgaagaactgccctgagctgcaaaccttacaaagtctgtaactctagataaaccataccatgtgctaactgcactgaaataaaacactaactacattataatgtca

SEQ ID NO: 103216 - DNA, 615 bp, Homo sapiens
  Payload ID: 129
  Gene Symbol: ABHD12
  Gene Name: abhydrolase domain containing 12
  ENST ID: ENST00000450393
  CDS Start-End: 55-615
cgggaggcctgaggaggccgctctttcctgatacgaggttacagctggggtctgatgtcaggtggggggcatggtggggtctgctttctctgctgtattcttctgcaagggcgaaagggcgtgtggttgcgcctgaggaagatacttttctgtgttttggggttgtacattgccattccatttctcatcaaactatgtcctggaatacaggccaaactgattttcttgaatttcgtaagagttccctatttcattgatttgaaaaaaccacaggatcaaggtttgaatcacacgtgtaactactacctgcagccagaggaagacgtgaccattggagtctggcacaccgtccctgcagtctggtggaagaacgcccaaggcaaagaccagatgtggtatgaggatgccttggcttccagccaccctatcattctgtacctgcatgggaacgcaggtaccagaggaggcgaccaccgcgtggagctttacaaggtgctgagttcccttggttaccatgtggtcacctttgactacagaggttggggtgactcagtgggaacgccatctgagcggggcatgacctatgacgcactccacgtttttgactggatcaaa

SEQ ID NO: 103217 - DNA, 620 bp, Homo sapiens
  Payload ID: 129
  Gene Symbol: ABHD12
  Gene Name: abhydrolase domain containing 12
  ENST ID: ENST00000576316
  CDS Start-End: 1-585
gcaagaagtggtgacaaccccgtgtacatctggggccactctctgggcactggcgtggcgacaaatctggtgcggcgcctctgtgagcgagagacgcctccagatgcccttatattggaatctccattcactaatatccgcgaagaagctaagagccatccattttcagtgatatatcgatacttccctgggtttgactggttcttccttgatcctattacaagtagtggaattaaatttgcaaatgatgaaaacgtgaagcacatctcctgtcccctgctcatcctgcacgctgaggacgacccggtggtgcccttccagcttggcagaaaggtgggtcctggcctctgcctctggtgtagctggcatcttgcacactcagccagtgtgggtggaccaggctgggagtgggcaggcgggaaggcagcccctgcatgctgcatcacgggctgcgcaccagccacgtcaggctcaggaggccacctcatcctccctgcgtcacctccaggctgcttcggaaggacatgggaggtctggtgtaaaggttggggcaggggcccactgatgctgtctccaagaatatgaaaaataagcagatagttcccagtcctcacacaggg

SEQ ID NO: 103218 - DNA, 474 bp, Homo sapiens
  Payload ID: 129
  Gene Symbol: ABHD12
  Gene Name: abhydrolase domain containing 12
  ENST ID: ENST00000465694
  CDS Start-End: 1-40
ggaattcctggggaagtcggagcctgagcaccagcactgagcctggccgtgggaaggaagcatgaagacctctgccctcctcccgttttcctccagtcagcagcccggtatcctgaagccccggggggccggcacctgcaatgctcaggagcccagctcgcacctggagagcacctcagatcccagacctcagcagggcccaggttccagcccagatcccagcatgtggtcagagctggtgtgactgaagccaacaggtgacacggtcatcgaagagcagcagacaaaactaaaactaacccaaaggcagctgaaagtggagggcaggtgaattcccagccctcgccggattcaacttttgccaacggtgaagaactgccctgagctgcaaaccttacaaagtctgtaactctagataaaccataccatgtgctaactgcactgaaataaaacactaactacattataatgtca

SEQ ID NO: 103219 - DNA, 814 bp, Homo sapiens
  Payload ID: 129
  Gene Symbol: ABHD12
  Gene Name: abhydrolase domain containing 12
  ENST ID: ENST00000491682
  CDS Start-End: 336-814
gtctcacagaagacggatcgggaggcctgaggaggccgctctttcctgatacgaggcgaaagggcgtgtggttgcgcctgaggaagatacttttctgtgttttggggttgtacattgccattccatttctcatcaaactatgtcctggaatacaggccaaactgattttcttgaatttcgtaagagttccctatttcattgatttgaaaaaaccacaggatcaaggtttgaatcacacgtgtaactactacctgcagccagaggaagacgtgaccattggagtctggcacaccgtccctgcagtctggtggaagaacgcccaaggcaaagaccagatgtggtatgaggatgccttggcttccagccaccctatcattctgtacctgcatgggaacgcaggtaccagaggaggcgaccaccgcgtggagctttacaaggtgctgagttcccttggttaccatgtggtcacctttgactacagaggttggggtgactcagtgggaacgccatctgagcggggcatgacctatgacgcactccacgtttttgactggatcaaagcaagaagtggtgacaaccccgtgtacatctggggccactctctgggcactggcgtggcgacaaatctggtgcggcgcctctgtgagcgagagacgcctccagatgcccttatattggaatctccattcactaatatccgcgaagaagctaagagccatccattttcagtgatatatcgatacttccctgggtttgactggttcttccttgatcctattacaagtagtggaattaaatttgcaaatgatgaaaa

SEQ ID NO: 103220 - DNA, 712 bp, Homo sapiens
  Payload ID: 129
  Gene Symbol: ABHD12
  Gene Name: abhydrolase domain containing 12
  ENST ID: ENST00000461204
  CDS Start-End: 51-407
gcggcgcaggccagcgggcgccgtcggcggctggccctgtcggccgcgggatgaggaagcggaccgagcccgtcgccttggagcatgagcgctgcgccgccgcgggctcgtcctcctccggctcggccgccgcggcgctggacgccgactgccgcctgaagcagaacctacgcctgacgggcccggcggcggctgagccgcgctgcgcagccgacgcgggaatgaagcgggcgctgggcaggcgaaagggcgtgtggttgcgcctgaggaagatacttttctgtgttttggggttgtacattgccattccatttctcatcaaactatgtcctggaatacaggccaaactgattttcttgaatttcggtccctgtgccccttcccagctggaggactttctgtgctagtgttgctccccagcactggatttctgtccacagaagactacactgccctgggggaccagcgtatctgtcttcagctgagtaagagttccctatttcattgatttgaaaaaaccacaggatcaaggtttgaatcacacgtgtaactactacctgcagccagaggaagacgtgaccattggagtctggcacaccgtccctgcagtctggtggaagaacgcccaaggcaaagaccagatgtggtatgaggatgccttggcttccagccaccctatcattctgtacctgcatgggaacgcaggtaccag

SEQ ID NO: 103221 - DNA, 805 bp, Homo sapiens
  Payload ID: 129
  Gene Symbol: ABHD12
  Gene Name: abhydrolase domain containing 12
  ENST ID: ENST00000471287
  CDS Start-End: 490-805
gagtccttggaagatccctggacgccaggcacagcagaggcgggaggcagaggggccggcgccagaccctgagagcgctggggcccactcggacctcctcctcctgctctgcatcaggccccacaccgagcgcccgggcgggcgcccctcgggctgggctgcgtgcgcggagccttactggcgccttgggccctcggcggctctccccggcgaaagggcgtgtggttgcgcctgaggaagatacttttctgtgttttggggttgtacattgccattccatttctcatcaaactatgtcctggaatacaggccaaactgattttcttgaatttcgtaagagttccctatttcattgatttgaaaaaaccacaggatcaaggtttgaatcacacgtgtaactactacctgcagccagaggaagacgtgaccattggagtctggcacaccgtccctgcagtctggtggaagaacgcccaaggcaaagaccagatgtggtatgaggatgccttggcttccagccaccctatcattctgtacctgcatgggaacgcaggtaccagaggaggcgaccaccgcgtggagctttacaaggtgctgagttcccttggttaccatgtggtcacctttgactacagaggttggggtgactcagtgggaacgccatctgagcggggcatgacctatgacgcactccacgtttttgactggatcaaagcaagaagtggtgacaaccccgtgtacatctggggccactctctgggcactggcgtggcgacaaatctggtgcggcgcctctgtgagcgag

SEQ ID NO: 103222 - DNA, 1708 bp, Homo sapiens
  Payload ID: 130
  Gene Symbol: ABHD12B
  Gene Name: abhydrolase domain containing 12B
  Uniprot ID: Q7Z5M8
  ENST ID: ENST00000337334
  CDS Start-End: 16-1104
gggacacggcgcgggatggacgcgcaggactgccaggcggccgcatcgcccgagccgcccgggcccccagcccgtagctgcgtggccgcctggtgggacatggtcgaccgcaacctgcgatattttccacactcctgttcaatgctcggaagaaaaattgctgctctgtatgacagctttactagtaaatccttaaaagaacacgttttccttcctctgatagacatgctaatttattttaattttttcaaagccccatttcttgtggatttaaagaaaccagagttaaagattcctcacacagtgaacttctacctgagagttgaacctggggtgatgctagggatctggcacacagtccccagctgccggggggaagatgccaaggggaaggactgttgctggtatgaagcagcccttcgtgatgggaacccaattattgtttatcttcatggcagtgcagaacacagggcagcttcgcacagactgaagctggtaaaggtgctgagtgatggtggctttcatgtcttgtctgttgactacagaggatttggggactctacaggtaagcccacagaggagggactgactacggatgccatttgtgtctatgagtggaccaaggcaagaagtggcatcactcccgtgtgtctctggggccactctctgggtacaggagttgcaacaaatgctgcaaaagtgctagaagaaaaaggatgcccagttgatgctattgtcttggaagctccatttaccaacatgtgggttgcaagtatcaattatcccttgttaaagatttaccggaacattccaggatttttacgtacacttatggatgccctgagaaaagacaaaataatctttcctaatgatgaaaatgttaaattcctttcttctcctcttctcatcttacatggagaggatgacaggacagtgcctttggagtatgggaaaaagctctatgaaattgcacgcaatgcatacaggaacaaagagagggtcaagatggttatctttcctcctggcttccaacacaacctgctttgtaaaagccccacactgttaataaccgtgagagatttcctgagcaagcagtggtcatgagtctgggaggagtggaaatcttcaatgaagacttggcccaaacaccacctgtgatgtatattgttctaatgtaaaattgtactgggctggtcggatgagctgaggccattgacttctctacaaatcacttgccattttaacaacagaaagtacgaatgttaggcagtatggaatgttcttatttagcttatcataatctactttgtaaaacatgctgaaacctcactgtggagaaccagaatttggtaaaatctagatcctatctaaaaatatgtagttattaaacattctgtggatatttgtgaataaggtagttgctatggtccgaatatctgggcctgcccccccaaattatgctgaaacctaatcaccagtgtgatggtaataggaggtgggactgagctctgatgaatgagattagtgcccttataaattatgaccaaaagagctcttcactcctcctaccatttgaggatacagtgagaagccttcatctatgaaccacaaagtagccctcatcagacactgaatcagccagtgccttgctcttggacttcccagcccccagaactgtgagaaataaatttctgttgtttataagcta

SEQ ID NO: 103223 - DNA, 1477 bp, Homo sapiens
  Payload ID: 130
  Gene Symbol: ABHD12B
  Gene Name: abhydrolase domain containing 12B
  Uniprot ID: Q7Z5M8
  ENST ID: ENST00000353130
  CDS Start-End: 16-873
gggacacggcgcgggatggacgcgcaggactgccaggcggccgcatcgcccgagccgcccgggcccccagcccgtagctgcgtggccgcctggtgggacatggtcgaccgcaacctgcggcacacagtccccagctgccggggggaagatgccaaggggaaggactgttgctggtatgaagcagcccttcgtgatgggaacccaattattgtttatcttcatggcagtgcagaacacagggcagcttcgcacagactgaagctggtaaaggtgctgagtgatggtggctttcatgtcttgtctgttgactacagaggatttggggactctacaggtaagcccacagaggagggactgactacggatgccatttgtgtctatgagtggaccaaggcaagaagtggcatcactcccgtgtgtctctggggccactctctgggtacaggagttgcaacaaatgctgcaaaagtgctagaagaaaaaggatgcccagttgatgctattgtcttggaagctccatttaccaacatgtgggttgcaagtatcaattatcccttgttaaagatttaccggaacattccaggatttttacgtacacttatggatgccctgagaaaagacaaaataatctttcctaatgatgaaaatgttaaattcctttcttctcctcttctcatcttacatggagaggatgacaggacagtgcctttggagtatgggaaaaagctctatgaaattgcacgcaatgcatacaggaacaaagagagggtcaagatggttatctttcctcctggcttccaacacaacctgctttgtaaaagccccacactgttaataaccgtgagagatttcctgagcaagcagtggtcatgagtctgggaggagtggaaatcttcaatgaagacttggcccaaacaccacctgtgatgtatattgttctaatgtaaaattgtactgggctggtcggatgagctgaggccattgacttctctacaaatcacttgccattttaacaacagaaagtacgaatgttaggcagtatggaatgttcttatttagcttatcataatctactttgtaaaacatgctgaaacctcactgtggagaaccagaatttggtaaaatctagatcctatctaaaaatatgtagttattaaacattctgtggatatttgtgaataaggtagttgctatggtccgaatatctgggcctgcccccccaaattatgctgaaacctaatcaccagtgtgatggtaataggaggtgggactgagctctgatgaatgagattagtgcccttataaattatgaccaaaagagctcttcactcctcctaccatttgaggatacagtgagaagccttcatctatgaaccacaaagtagccctcatcagacactgaatcagccagtgccttgctcttggacttcccagcccccagaactgtgagaaataaatttctgttgtttataagcta

SEQ ID NO: 103224 - DNA, 1580 bp, Homo sapiens
  Payload ID: 130
  Gene Symbol: ABHD12B
  Gene Name: abhydrolase domain containing 12B
  Uniprot ID: Q7Z5M8
  ENST ID: ENST00000382029
  CDS Start-End: 16-198
gggacacggcgcgggatggacgcgcaggactgccaggcggccgcatcgcccgagccgcccgggcccccagcccgtagctgcgtggccgcctggtgggacatggtcgaccgcaacctgcgtcaaagccccatttcttgtggatttaaagaaaccagagttaaagattcctcacacagtgaacttctacctgagagttgaacctggggtgatgctagggatctggcacacagtccccagctgccggggggaagatgccaaggggaaggactgttgctggtatgaagcagcccttcgtgatgggaacccaattattgtttatcttcatggcagtgcagaacacagggcagcttcgcacagactgaagctggtaaaggtgctgagtgatggtggctttcatgtcttgtctgttgactacagaggatttggggactctacaggtaagcccacagaggagggactgactacggatgccatttgtgtctatgagtggaccaaggcaagaagtggcatcactcccgtgtgtctctggggccactctctgggtacaggagttgcaacaaatgctgcaaaagtgctagaagaaaaaggatgcccagttgatgctattgtcttggaagctccatttaccaacatgtgggttgcaagtatcaattatcccttgttaaagatttaccggaacattccaggatttttacgtacacttatggatgccctgagaaaagacaaaataatctttcctaatgatgaaaatgttaaattcctttcttctcctcttctcatcttacatggagaggatgacaggacagtgcctttggagtatgggaaaaagctctatgaaattgcacgcaatgcatacaggaacaaagagagggtcaagatggttatctttcctcctggcttccaacacaacctgctttgtaaaagccccacactgttaataaccgtgagagatttcctgagcaagcagtggtcatgagtctgggaggagtggaaatcttcaatgaagacttggcccaaacaccacctgtgatgtatattgttctaatgtaaaattgtactgggctggtcggatgagctgaggccattgacttctctacaaatcacttgccattttaacaacagaaagtacgaatgttaggcagtatggaatgttcttatttagcttatcataatctactttgtaaaacatgctgaaacctcactgtggagaaccagaatttggtaaaatctagatcctatctaaaaatatgtagttattaaacattctgtggatatttgtgaataaggtagttgctatggtccgaatatctgggcctgcccccccaaattatgctgaaacctaatcaccagtgtgatggtaataggaggtgggactgagctctgatgaatgagattagtgcccttataaattatgaccaaaagagctcttcactcctcctaccatttgaggatacagtgagaagccttcatctatgaaccacaaagtagccctcatcagacactgaatcagccagtgccttgctcttggacttcccagcccccagaactgtgagaaataaatttctgttgtttataagcta

SEQ ID NO: 103225 - DNA, 1404 bp, Homo sapiens
  Payload ID: 130
  Gene Symbol: ABHD12B
  Gene Name: abhydrolase domain containing 12B
  Uniprot ID: Q7Z5M8
  ENST ID: ENST00000557345
  CDS Start-End: 16-198
gggacacggcgcgggatggacgcgcaggactgccaggcggccgcatcgcccgagccgcccgggcccccagcccgtagctgcgtggccgcctggtgggacatggtcgaccgcaacctgcgtcaaagccccatttcttgtggatttaaagaaaccagagttaaagattcctcacacagtgaacttctacctgagagttgaacctggggtgatgctagggatctggcacacagtccccagctgccggggggaagatgccaaggggaaggactgttgctggtatgaagcagcccttcgtgatgggaacccaattattgtttatcttcatggcagtgcagaacacagggcagcttcgcacagactgaagctggtaaagagttgcaacaaatgctgcaaaagtgctagaagaaaaaggatgcccagttgatgctattgtcttggaagctccatttaccaacatgtgggttgcaagtatcaattatcccttgttaaagatttaccggaacattccaggatttttacgtacacttatggatgccctgagaaaagacaaaataatctttcctaatgatgaaaatgttaaattcctttcttctcctcttctcatcttacatggagaggatgacaggacagtgcctttggagtatgggaaaaagctctatgaaattgcacgcaatgcatacaggaacaaagagagggtcaagatggttatctttcctcctggcttccaacacaacctgctttgtaaaagccccacactgttaataaccgtgagagatttcctgagcaagcagtggtcatgagtctgggaggagtggaaatcttcaatgaagacttggcccaaacaccacctgtgatgtatattgttctaatgtaaaattgtactgggctggtcggatgagctgaggccattgacttctctacaaatcacttgccattttaacaacagaaagtacgaatgttaggcagtatggaatgttcttatttagcttatcataatctactttgtaaaacatgctgaaacctcactgtggagaaccagaatttggtaaaatctagatcctatctaaaaatatgtagttattaaacattctgtggatatttgtgaataaggtagttgctatggtccgaatatctgggcctgcccccccaaattatgctgaaacctaatcaccagtgtgatggtaataggaggtgggactgagctctgatgaatgagattagtgcccttataaattatgaccaaaagagctcttcactcctcctaccatttgaggatacagtgagaagccttcatctatgaaccacaaagtagccctcatcagacactgaatcagccagtgccttgctcttggacttcccagcccccagaactgtgagaaataaatttctgttgtttataagcta

SEQ ID NO: 103226 - DNA, 5338 bp, Homo sapiens
  Payload ID: 131
  Gene Symbol: ABHD13
  Gene Name: abhydrolase domain containing 13
  Uniprot ID: Q7L211
  ENST ID: ENST00000375898
  CDS Start-End: 302-1315
gcgcatgctcggaagagcgggcagggttcccactccgggagcggagacggagaacaggttatgtgggagccggcgggggcatttgccggcgacacccgagcgggggccggaagtggggccacagctcgcagcaggagctccgggctagaccgtggcgccggcagcggcccctgggctggaggaggatgatgaggagcgacggaagcgacgcgggggtacgctgctgcgcggcgcccggtttcgtgcccgcggccgactgcgcagcctgtccgcgagtctgagatacttacagagagctacaatggaaaagtcctggatgctgtggaactttgttgaaagatggctaatagccttggcttcatggtcttgggctctctgccgtatttctcttttacctttaatagtgacttttcatctgtatggaggcattatcttacttttgttaatattcatatcaatagcaggtattctgtataaattccaggatgtattgctttattttccagaacagccatcctcttcacgtctttatgttcccatgcccactggcattccacatgaaaacattttcatcagaaccaaagatggaatacgtctgaatcttattttgatacgatacactggagacaattcaccctattccccaactataatttattttcatgggaatgcaggcaacataggtcacaggttgccaaatgcattacttatgttggttaacctcaaagttaaccttttgctggttgattatcgaggatatggaaaaagtgaaggagaagcaagtgaagaaggactctacttagattctgaagctgtgttagactacgtgatgactagacctgaccttgataaaacaaaaatttttctttttggccgttccttgggtggagcagtggctattcatttggcttctgaaaattcacataggatttcagccattatggtggagaacacatttttaagcataccacatatggccagcactttattttcattctttccgatgcgttaccttcctttatggtgctacaaaaataaatttttgtcctacagaaaaatctctcagtgtagaatgccttcacttttcatctctggactctcagatcaattaattccaccagtaatgatgaaacaactttatgaactctccccatctcggactaagagattagccatttttccagatgggactcacaatgacacatggcagtgccaaggctatttcactgcacttgaacagttcatcaaagaagtcgtaaagagccattctcctgaagaaatggcaaaaacttcatctaatgtaacaattatataatgtttccctttttgattattgcattgtattttaatttgtgcagaatgataaagaatgttccttttagaagtgtgttatgtctgtacctgtctgaagagtgacattaaactttgaaaggacttcactgctcctttacgatattccaaatagttttttacattggaaaaactaattcttgggattctttcatacattttcatcaaaactttcagtgtgattatgtattcatatcttcagtttaatatgtcagtataatagatattgttcaaaagtttcttgttgctaaagtggtgtaatctgttacacagatgaatagctagatgtggaaagagatatgtaaacaagaaacctttgggtattgtttcttaagtaaatattgggacaatcatggtaagcaaacttagttctgtaactgcatttttcaccttaaaagttaaatgaaatgcatgatggtattttattccttgaattatgcaatgcaacattttacatgtaaatagcactggtcatatactgatgtatatggttatctgggttatatctatttttatgtaaactctattttgtttttggcaagaagtgaaattgagacttatgtgcaggttgccattgaattttgctctggtgaatgctgagatccagctttttcttacaaataaatgggaccctgttttccaatacaaatgtaccgtgtttttgttaggtacagtctggatcatggcatgtagaaatagaaatttagaattttactgcagctttgatgtgcatatttgaactttttaacatttgtaactttggtggcaaagagaattttagcttctatcgattttgtaagtcttcagctgaaccactaatagcagtcatagtgaagattagcactacttagaattaaattaggaagtcttttatcattgcaggattgtacatactactttataaaaattctcacctttgattttaaatcccagtacctagttatatctaacctatcaaaggcaagatatcatttattggacttcttgaaaataaaagttacaaaatccaacaacaacaacaacaaaacaatgttcttggttttaatgttccagttgctgtgaaatagaactcctacaatcaaaagacagttttaggaagtcttatttattgattttaaaagttttacatgtaggagtgtgggaatgaaggaattctggagctttttgacacaaaacctattaccacatttagcagttaaatggctataggtgggaagtaggatttagatgtatagaaaagtaagaaaatcttacttagaaaaaagccccttgaaacttgcaggatttacttaataaaaatacacgctatgagtcataattgtgccaagttgtttcatgcagtcctcaaaaattagatgtaattgagctttgtgtaatattatgtcagctttaacatataatattttgaatattttagctatatttagtggctttctgcaagcaactagaacagagaagtaatgggtcaataatcttgaccttaatttaaaactttcaatggagatagggctagaaatacttttgccaaatagcattcttattcactttatgccggtatttagaaaaaataaattatagcaagtatgatttctaagaatgtttttctataaattactaattgtaaaaagtcttgctttttaaaacaagttggtaatgcatatcatggaaggcatattttgtatgtataaattcaccacaattaaagattattcttgtcagtccttgctatgtagaatgactattctaaatattaatgtattaaaaagaaaatacaacaaaatgtatatttagacacgagcttacatggcataccttatatttgtatcattctttaaagtttacaaaaaaaaaccttatgtttttatgtaatcagtcattacactagggagaaatttatcagctttagttctaaatatgctcatgaggtataaaagctatttcttcatcagtattttgcttttatgctgctttttctttttgatactccaggtttataaactatcttttaaaattttaagccaggacttcaaaaattgtagagtacttgtttggcgttccctaccttcattctcttagggttaaggagcctttctttctgcagctaagggcagaggctgtgcctagggctataccaccactagcatctgtatttgagactgtttccttagatgggtaagaggtggaaaacaaacttagtatcaggggtccatgaagcccatggcatcatttttgaaaatatttctagttttgtagccaaagcaattggttttagtaaaatgagacttcttcaggagtcactcctttactgtggacccattgcttagtgggaatggaagtatatgtatctatcttgtgtattaacttctgacttatttatacaagagcagctataggagtttacaaaagaactttaagttattaagttactataaatttggggatcctagagtgatcttaaatatggcaagatacagctcatttagaataaaatctcacatccattattttaaagggaatgattggggggaaaaactggtgaaaaagaaatataaaaaggaccctaaaaagaattctgcaaaataagagaagaaataatttgtgacaggtaatagaatactagtaggatagaaacaactagaaaggaaagtgtgacacagtttttaaatttagatgtagaaaataatgaattaatgagattggtgaaaggaaatcatgcaaaacatttgaatgcaaagcatttctaacaaaaagtgactggagcacttgccattgcaacaaccctgtttttgcaattaggtttttgactgttaaaatggatattttcataaaaatggtgttctgaattttgctacagggctgcttaaatttatgattacctgtagacacttgatatttacatagattacagctttggtaatatgtcactggagtaattacgctgtaatacctgttgagaattcataccatctgatgcttatatattaatttcttatgtttgtaagtttggctttgtgggaataggtgtggagaaattaaagagtgaaggccatatttcattttttataaattatctttcaagctcagatagcttaagagcagtttatattaaggagacccttttctccttgaggatagggataggtaaggtaaacttgtaaaaaggatgtcacagaagtcactttttaattaagtcatgattgagatactgaactcttccactcattcttctttcccattttcctattatgtttgataattatatgtatttttaaaaactgtgagaggaaaaattagtcataacccttttgggttatccacttaaatttaggtattttcatattactcaggtaaagatggaaatgacagagcacagacatttattttttaaattgatagggtagaaaatgaaatgtacttctgtttattcttaatactatatatatatatacacacatagttttagcaaattggaaataatatattcatttgtatggcaagataaatgcagtcatcttaatactagtctatacatttttgccaaatggcgcaaatatacctccatttatattttgtatcttaaaatgtagtttaaaaataggaccatgtatgagacacttttttacaaaaagtgccgtatatacatatgtaacaggtgagtgtgtgtttaacataatttataattatttctgtcagtacagcgtatatggaaaattcaagttgtttttaacatattcaagtatgttcagtataaaataagttaatcccatttcataatgtaaatcatatttttgttatttgccatattttatttgaagtgataaaattttataactcaaatttgaatgtcatagtacattgtgtgctaaccatggcaagcaaacatttacatttgttttttacaataaatttcttttaaaatatactttctatttttctgtactgacatatgcaataaattggtacattaaaaatttgattaatgtcttca

SEQ ID NO: 103227 - DNA, 1062 bp, Homo sapiens
  Payload ID: 132
  Gene Symbol: ABHD14A
  Gene Name: abhydrolase domain containing 14A
  Uniprot ID: Q9BUJ0
  ENST ID: ENST00000273596
  CDS Start-End: 69-884
gcgcgccgagatggccgcgctcctggccgcctagagccggagcggcccgcggagctgcggaggcagccatggtcggggcgctgtgcggctgctggttccgcctgggcggggcccgcccgctcatcccgttgggcccgactgtggtacagacctccatgagccggtcccaggtagccctgctgggcctgagtctgctgctcatgctcctactgtatgtggggctgccaggcccccctgagcagacttcctgcctctggggagaccccaatgtcacagtcctggctggtctcacccctggcaactcgcccatcttttaccgcgaggtgctcccactcaaccaggcacacagggtggaggtggtgctgcttcatggaaaggcctttaactctcacacgtgggagcagctgggcacactgcagctactgtcacagaggggctaccgggccgtggcccttgaccttccaggttttgggaactcggcaccttcaaaggaggcaagcacagaggcagggcgggcagcgctgctggagcgggcgctgcgggacctggaggtacagaatgccgtgttggtgagcccctcgctgagtggccactatgccctgcccttcctgatgcgaggccaccaccagctacatggatttgtgcccatcgcacccacctccacccagaactacacccaggagcaattctgggctgtgaagactccaacccttatcctgtatggagagctggaccacatcctggctcgagagtcactgcggcagctccgccacctgcccaaccactctgtggtgaagctacgcaatgcaggccatgcctgttacctccacaagccgcaagacttccaccttgtcctgcttgccttccttgaccatctaccttgaactaacccactcccagctcccagcctggcatgagcttggacagtctggaccgccaccctccctgaaccagggagacagcctctgggattggaggccagaggccagggtcagacccagccaggactcctcatttcatctcacagacacaataaaaaagcatatttgtcctgcctgggaa

SEQ ID NO: 103228 - DNA, 1113 bp, Homo sapiens
  Payload ID: 132
  Gene Symbol: ABHD14A
  Gene Name: abhydrolase domain containing 14A
  ENST ID: ENST00000458031
  CDS Start-End: 243-932
ctcggtaactgggttgcaggcccgcggctgcggagtgcgcaggcgcgccgagatggccgcgctcctggccgcctagagccggagcggcccgcggagctgcggaggcagccatggtcggggcgctgtgcggctgctggttccgcctgggcggggcccgcccgctcatcccgttgggcccgactgtggtacagacctccatgagccggtcccaggtagccctgctgggcctgagtctgctgctcatgctcctactgtatgtggggctgccaggcccccctgagcagacttcctgcctctggggagaccccaatgtcacagtcctggctggtctcacccctggcaactcgcccatcttttaccgcgaggtgctcccactcaaccaggcacacagggtggaggtggtgctgcttcatggaaaggcctttaactctcacacgtgggagcagctgggcacactgcagctactgtcacagaggggctaccgggccgtggcccttgaccttccagtcccgggttcaagcaattctcctgcctccgcttccccagtagctgagattacagaaaatagcttctgggcagttttagtgcgggacctggaggtacagaatgccgtgttggtgagcccctcgctgagtggccactatgccctgcccttcctgatgcgaggccaccaccagctacatggatttgtgcccatcgcacccacctccacccagaactacacccaggagcaattctgggctgtgaagactccaacccttatcctgtatggagagctggaccacatcctggctcgagagtcactgcggcagctccgccacctgcccaaccactctgtggtgaagctacgcaatgcaggccatgcctgttacctccacaagccgcaagacttccaccttgtcctgcttgccttccttgaccatctaccttgaactaacccactcccagctcccagcctggcatgagcttggacagtctggaccgccaccctccctgaaccagggagacagcctctgggattggaggccagaggccagggtcagacccagccaggactcctcatttcatctcacagacacaataaaaaagcatatttgtcctgcctgggaagtg

SEQ ID NO: 103229 - DNA, 802 bp, Homo sapiens
  Payload ID: 132
  Gene Symbol: ABHD14A
  Gene Name: abhydrolase domain containing 14A
  ENST ID: ENST00000497864
  CDS Start-End: 129-802
ccaaaccctgcccagaagcctgccccttaagtacctggcaggtcaatggccacagcccggtagccagcctgggccagcctgtgcagtgtacccaggttctgccaggtctcggaggagaagcgaataccatgcagcagcagtacagagaagcgagcctgcccactgccgggcagggcctctcggaagaagagggcctggccctgcacctggatggtgccctcgcgctgctccacgcttgctgccatgcctgctgctgctgtgctggtgaagggcctgtggttcaaaaccacgatgatgaggggccacagaacaccctgcccagggtggcagtcccagaggagcagcaaggaagcctccaggaggtttccagaactttaagaacatgccttgggactgtggtacagacctccatgagccggtcccaggtagccctgctgggcctgagtctgctgctcatgctcctactgtatgtggggctgccaggcccccctgagcagacttcctgcctctggggagaccccaatgtcacagtcctggctggtctcacccctggcaactcgcccatcttttaccgcgaggtgctcccactcaaccaggcacacagggtggaggtggtgctgcttcatggaaaggcctttaactctcacacgtgggagcagctgggcacactgcagctactgtcacagaggggctaccgggccgtggcccttgaccttccaggttttgggaactcggcaccttcaaaggaggcaagcacagaggcagggcgggcagcgctgctggagcgggcgctgcgggacct

SEQ ID NO: 103230 - DNA, 674 bp, Homo sapiens
  Payload ID: 132
  Gene Symbol: ABHD14A
  Gene Name: abhydrolase domain containing 14A
  ENST ID: ENST00000491470
  CDS Start-End: 34-408
gccggagcggcccgcggagctgcggaggcagccatggtcggggcgctgtgcggctgctggttccgcctgggcggggcccgcccgctcatcccgttgggcccgactgtggtacagacctccatgagccggtcccaggtagccctgctgggcctgagtctgctgctcatgctcctactgtatgtggggctgccaggcccccctgagcagacttcctgcctctggggagaccccaatgtcacagtcctggctggtctcacccctggcaactcgcccatcttttaccgcgaggtgctcccactcaaccaggcacacagactccaacccttatcctgtatggagagctggaccacatcctggctcgagagtcactgcggcagctccgccacctgcccaaccactctgtggtgaagctacgcaatgcaggccatgcctgttacctccacaagccgcaagacttccaccttgtcctgcttgccttccttgaccatctaccttgaactaacccactcccagctcccagcctggcatgagcttggacagtctggaccgccaccctccctgaaccagggagacagcctctgggattggaggccagaggccagggtcagacccagccaggactcctcatttcatctcacagacacaataaaaaagcatatttgtcctgcctggga

SEQ ID NO: 103231 - DNA, 626 bp, Homo sapiens
  Payload ID: 132
  Gene Symbol: ABHD14A
  Gene Name: abhydrolase domain containing 14A
  ENST ID: ENST00000494478
  CDS Start-End: 169-626
ttttctagaggcggaaaccgaagcgcccagtgggaaaggcgacccgccggggatgcggggtgctcaacgcgctgccacctggggcccaacgcgttgacctcgcggtcaggttgcttccgcggactacggttctggctcgctagctctggaagggagcaccgggagggaatggtggcaactcccaaggaggggacccagggatccgagaaaggaagacttgggactgtggtacagacctccatgagccggtcccaggtagccctgctgggcctgagtctgctgctcatgctcctactgtatgtggggctgccaggcccccctgagcagacttcctgcctctggggagaccccaatgtcacagtcctggctggtctcacccctggcaactcgcccatcttttaccgcgaggtgctcccactcaaccaggcacacagggtggaggtggtgctgcttcatggaaaggcctttaactctcacacgtgggagcagctgggcacactgcagctactgtcacagaggggctaccgggccgtggcccttgaccttccaggttttgggaactcggcaccttcaaaggaggcaagcacagaggcagggcgggcagcgctgctggagcgggcgctgcg

SEQ ID NO: 103232 - DNA, 2236 bp, Homo sapiens
  Payload ID: 133
  Gene Symbol: ABHD14B
  Gene Name: abhydrolase domain containing 14B
  ENST ID: ENST00000315877
  CDS Start-End: 695-1321
ctactcatggcgcctgccctggttggcgatgtgttaccaacgtctggcctgtcccagcccaaggctccgcgtggcgaccaggcccagcactgggaggctgtgcagagcgtggcgtttactgcttattgctactctgcagaggttggcaacatctgacccgctctactggcaggaaacaggctcgggggcattgggaaaacgatcaaggccacttggctggacactggcggagcctcgcactcaaacctgtcgggcctcaactccgtgccaggccaacaagttgccctgggcagttcaagctggggataagggggatggggagcaggaagacagcagcaaggatgcgatcccgaaggaactttcctcctcagactgctccatgtccatgtggggcaggtcgctgaagagttcgaaaccgtgctcagcaccgcgtttggggcatgtgagaccgagaggctttgggaaactgacgccgctgtgagaacgagtttagcggagtctatggacgctgcgagcttgtggccacaagagggcgccccggagcacggcccagtccccgcccccgctggatggggcccggcctcttcccagcgttcctcctccggccccaggtcaccgccagcacgcgcctgcttcccgtctgcgcgagtccacgcagctccccaggcccttcaccagcacagcagcagcaggcatggcagcaagcgtggagcagcgcgagggcaccatccaggtgcagggccaggccctcttcttccgagaggccctgcccggcagtgggcaggctcgcttctctgtactgctgctgcatggtattcgcttctcctccgagacctggcagaacctgggtacactgcacaggctggcccaggctggctaccgggctgtggccattgacctgccagggctcaagggcgagcctcctgcccaggagcctctcttgtcccaatccagggccagcttcctggcggctgtggtggatgccttggagctgggccccccggttgtgatcagtccatcactgagtggcatgtactccctgcccttcctcacggcccctggctcccagctcccgggctttgtgccagtggcccccatctgcactgacaaaatcaatgctgccaactatgccagtgtgaagactccagctctgattgtatatggagaccaggaccccatgggtcagaccagctttgagcacctgaagcagctgcccaaccaccgggtgctgatcatgaagggggcggggcacccctgttacctggacaaaccagaggagtggcatacagggctgctggacttcctgcaggggctccagtgaagcccagcactgctgcagggggtgggctgcctgcctgctctgagctctctcttgcacgctctctcttctctcccaggctctggctcatgcacatgcaacaggtgcgtctgtctatatgtctgggttcttgtcttttgtggtctgtttgtcttttctacctctttctcttgcagtgatagactgagggggtaaaatcaagagaaaaaactctcaggaatcaaggaacataatcctgtggagggtaatccattacatgagcttctcctgttcttccactttcctgcctggctttcactccttcccctgctctgcccagcctttccctcccacccactcctccttctgcaaatgccctgaaggccagcccttaccccaacacccacttccccacctccttaggccccagatacatacatgcccacatgcacgcttacatgtttagagccatccttgtttccaaatatgacccttcgcttgagggcaactgcataggtacatctaactctggactggcatgcacattgtcatgtgcagctttgcatatacacacatgcatacatgagcctccacacaagcacttgcacacatgtggactcctaaccatgctaacctcactggctgggaaggtggggaccccatgggccagcccttgcaggaggcccttttgcaaggcttagggtgtggccagccctgaaagctacttggacacaggtttcagctggccccagcccagaagtgacccccagaaagggagggccaccgctttgccccctgcttttacccttccttctgggtgctctacacctcaggttaccaggcctgaggcatctcagccaagcttgtttcctgctctgaggcttgtggggtgggagccagagtggaggtcggtgaaataaagtgatgcaattagacccc

SEQ ID NO: 103233 - DNA, 1636 bp, Homo sapiens
  Payload ID: 133
  Gene Symbol: ABHD14B
  Gene Name: abhydrolase domain containing 14B
  Uniprot ID: Q96IU4
  ENST ID: ENST00000361143
  CDS Start-End: 131-763
gctggatggggcccggcctcttcccagcgttcctcctccggccccaggtcaccgccagcacgcgcctgcttcccgtctgcgcgagtccacgcagctccccaggcccttcaccagcacagcagcagcaggcatggcagcaagcgtggagcagcgcgagggcaccatccaggtgcagggccaggccctcttcttccgagaggccctgcccggcagtgggcaggctcgcttctctgtactgctgctgcatggtattcgcttctcctccgagacctggcagaacctgggtacactgcacaggctggcccaggctggctaccgggctgtggccattgacctgccaggtctggggcactccaaggaagcagcagcccctgcccctattggggagctggcccctggcagcttcctggcggctgtggtggatgccttggagctgggccccccggttgtgatcagtccatcactgagtggcatgtactccctgcccttcctcacggcccctggctcccagctcccgggctttgtgccagtggcccccatctgcactgacaaaatcaatgctgccaactatgccagtgtgaagactccagctctgattgtatatggagaccaggaccccatgggtcagaccagctttgagcacctgaagcagctgcccaaccaccgggtgctgatcatgaagggggcggggcacccctgttacctggacaaaccagaggagtggcatacagggctgctggacttcctgcaggggctccagtgaagcccagcactgctgcagggggtgggctgcctgcctgctctgagctctctcttgcacgctctctcttctctcccaggctctggctcatgcacatgcaacaggtgcgtctgtctatatgtctgggttcttgtcttttgtggtctgtttgtcttttctacctctttctcttgcagtgatagactgagggggtaaaatcaagagaaaaaactctcaggaatcaaggaacataatcctgtggagggtaatccattacatgagcttctcctgttcttccactttcctgcctggctttcactccttcccctgctctgcccagcctttccctcccacccactcctccttctgcaaatgccctgaaggccagcccttaccccaacacccacttccccacctccttaggccccagatacatacatgcccacatgcacgcttacatgtttagagccatccttgtttccaaatatgacccttcgcttgagggcaactgcataggtacatctaactctggactggcatgcacattgtcatgtgcagctttgcatatacacacatgcatacatgagcctccacacaagcacttgcacacatgtggactcctaaccatgctaacctcactggctgggaaggtggggaccccatgggccagcccttgcaggaggcccttttgcaaggcttagggtgtggccagccctgaaagctacttggacacaggtttcagctggccccagcccagaagtgacccccagaaagggagggccaccgctttgccccctgcttttacccttccttctgggtgctctacacctcaggttaccaggcctgaggcatctcagccaagcttgtttcctgctctgaggcttgtggggtgggagc

SEQ ID NO: 103234 - DNA, 1818 bp, Homo sapiens
  Payload ID: 133
  Gene Symbol: ABHD14B
  Gene Name: abhydrolase domain containing 14B
  Uniprot ID: Q96IU4
  ENST ID: ENST00000395008
  CDS Start-End: 290-922
ctccggccccaggtcaccgccagcacgcgcctgcttcccgtctgcgcgagtccacgcagctccccagatcaagaagctgaggccccaggttacacactaaagtaaatggcagaggcagaaataacacctatgtcctcctgaccccaaggcatgttcttaaagttctggaaacctcctggaggcttccttgctgctcctctgggactgccaccctgggcagggtgttctgtggcccctcatcatcgtggttttgaaccacaggcccttcaccagcacagcagcagcaggcatggcagcaagcgtggagcagcgcgagggcaccatccaggtgcagggccaggccctcttcttccgagaggccctgcccggcagtgggcaggctcgcttctctgtactgctgctgcatggtattcgcttctcctccgagacctggcagaacctgggtacactgcacaggctggcccaggctggctaccgggctgtggccattgacctgccaggtctggggcactccaaggaagcagcagcccctgcccctattggggagctggcccctggcagcttcctggcggctgtggtggatgccttggagctgggccccccggttgtgatcagtccatcactgagtggcatgtactccctgcccttcctcacggcccctggctcccagctcccgggctttgtgccagtggcccccatctgcactgacaaaatcaatgctgccaactatgccagtgtgaagactccagctctgattgtatatggagaccaggaccccatgggtcagaccagctttgagcacctgaagcagctgcccaaccaccgggtgctgatcatgaagggggcggggcacccctgttacctggacaaaccagaggagtggcatacagggctgctggacttcctgcaggggctccagtgaagcccagcactgctgcagggggtgggctgcctgcctgctctgagctctctcttgcacgctctctcttctctcccaggctctggctcatgcacatgcaacaggtgcgtctgtctatatgtctgggttcttgtcttttgtggtctgtttgtcttttctacctctttctcttgcagtgatagactgagggggtaaaatcaagagaaaaaactctcaggaatcaaggaacataatcctgtggagggtaatccattacatgagcttctcctgttcttccactttcctgcctggctttcactccttcccctgctctgcccagcctttccctcccacccactcctccttctgcaaatgccctgaaggccagcccttaccccaacacccacttccccacctccttaggccccagatacatacatgcccacatgcacgcttacatgtttagagccatccttgtttccaaatatgacccttcgcttgagggcaactgcataggtacatctaactctggactggcatgcacattgtcatgtgcagctttgcatatacacacatgcatacatgagcctccacacaagcacttgcacacatgtggactcctaaccatgctaacctcactggctgggaaggtggggaccccatgggccagcccttgcaggaggcccttttgcaaggcttagggtgtggccagccctgaaagctacttggacacaggtttcagctggccccagcccagaagtgacccccagaaagggagggccaccgctttgccccctgcttttacccttccttctgggtgctctacacctcaggttaccaggcctgaggcatctcagccaagcttgtttcctgctctgaggcttgtggggtgggagccagagtggaggtcggtgaaataa

SEQ ID NO: 103235 - DNA, 1397 bp, Homo sapiens
  Payload ID: 133
  Gene Symbol: ABHD14B
  Gene Name: abhydrolase domain containing 14B
  ENST ID: ENST00000461108
  CDS Start-End: 86-652
aggtcaccgccagcacgcgcctgcttcccgtctgcgcgagtccacgcagctccccaggcccttcaccagcacagcagcagcaggcatggcagcaagcgtggagcagcgcgagggcaccatccaggtgcagggccaggccctcttcttccgagaggccctgcccggcagtgggcaggctcgcttctctgtactgctgctgcatggtattcgcttctcctccgagacctggcagaacctgggtacactgcacaggctggcccaggctggctaccgggctgtggccattgacctgccaggtctggggcactccaaggaagcagcagcccctgcccctattggggagctggcccctggcagcttcctggcggctgtggtggatgccttggagctgggccccccggttgtgatcagtccatcactgagtggcatgtactccctgcccttcctcacggcccctggctcccagctcccgggctttgtgccagtggcccccatctgcactgacaaaatcaatgctgccaactatgccagtgtgaaggtacccttgtgtgggaagctgaggtgcccctgccaggagcaaggaagggtgcatccctgggctttcctcatctgggggctggataatcaaggggtgtcttctgggaggagctgaccacccaactccacccttttggtttactcagcagactactgtgccaagccctgtgctaaactgtgttctggggcagacaccaatctgtgcccccacccactgggccagcttgtctctctccctcatatggggtggtcccaggaagagactgaagtggggagggctggggatgctatggcaggtccctgttgactctgccccacccccctatccttcctctcagactccagctctgattgtatatggagaccaggaccccatgggtcagaccagctttgagcacctgaagcagctgcccaaccaccgggtgctgatcatgaagggggcggggcacccctgttacctggacaaaccagaggagtggcatacagggctgctggacttcctgcaggggctccagtgaagcccagcactgctgcagggggtgggctgcctgcctgctctgagctctctcttgcacgctctctcttctctcccaggctctggctcatgcacatgcaacaggtgcgtctgtctatatgtctgggttcttgtcttttgtggtctgtttgtcttttctacctctttctcttgcagtgatagactgagggggtaaaatcaagagaaaaaactctcaggaatcaaggaacataatcctgtggagggtaatccattacatgagcttctcctgttcttccactttcctgcctggctttcactccttcccctgctctgcccagcctttccctcccacccactcctcctt

SEQ ID NO: 103236 - DNA, 2056 bp, Homo sapiens
  Payload ID: 133
  Gene Symbol: ABHD14B
  Gene Name: abhydrolase domain containing 14B
  Uniprot ID: Q96IU4
  ENST ID: ENST00000483233
  CDS Start-End: 508-1140
cccggcgccagcggccgcgtcggcgcggatgtccccgcccgcctctggttcgggcctcagcgagattactggaggattagatccggatcccgtccccgggcagcggccgccgcggccagcgccgccccgcgagttgcgagctccgggctggccctgctctgacaggctcgccccgccccacacgacacgcctgccactcctgcccccaggtcgctgaagagttcgaaaccgtgctcagcaccgcgtttggggcatgtgagaccgagaggctttgggaaactgacgccgctgtgagaacgagtttagcggagtctatggacgctgcgagcttgtggccacaagagggcgccccggagcacggcccagtccccgcccccgctggatggggcccggcctcttcccagcgttcctcctccggccccaggtcaccgccagcacgcgcctgcttcccgtctgcgcgagtccacgcagctccccaggcccttcaccagcacagcagcagcaggcatggcagcaagcgtggagcagcgcgagggcaccatccaggtgcagggccaggccctcttcttccgagaggccctgcccggcagtgggcaggctcgcttctctgtactgctgctgcatggtattcgcttctcctccgagacctggcagaacctgggtacactgcacaggctggcccaggctggctaccgggctgtggccattgacctgccaggtctggggcactccaaggaagcagcagcccctgcccctattggggagctggcccctggcagcttcctggcggctgtggtggatgccttggagctgggccccccggttgtgatcagtccatcactgagtggcatgtactccctgcccttcctcacggcccctggctcccagctcccgggctttgtgccagtggcccccatctgcactgacaaaatcaatgctgccaactatgccagtgtgaagactccagctctgattgtatatggagaccaggaccccatgggtcagaccagctttgagcacctgaagcagctgcccaaccaccgggtgctgatcatgaagggggcggggcacccctgttacctggacaaaccagaggagtggcatacagggctgctggacttcctgcaggggctccagtgaagcccagcactgctgcagggggtgggctgcctgcctgctctgagctctctcttgcacgctctctcttctctcccaggctctggctcatgcacatgcaacaggtgcgtctgtctatatgtctgggttcttgtcttttgtggtctgtttgtcttttctacctctttctcttgcagtgatagactgagggggtaaaatcaagagaaaaaactctcaggaatcaaggaacataatcctgtggagggtaatccattacatgagcttctcctgttcttccactttcctgcctggctttcactccttcccctgctctgcccagcctttccctcccacccactcctccttctgcaaatgccctgaaggccagcccttaccccaacacccacttccccacctccttaggccccagatacatacatgcccacatgcacgcttacatgtttagagccatccttgtttccaaatatgacccttcgcttgagggcaactgcataggtacatctaactctggactggcatgcacattgtcatgtgcagctttgcatatacacacatgcatacatgagcctccacacaagcacttgcacacatgtggactcctaaccatgctaacctcactggctgggaaggtggggaccccatgggccagcccttgcaggaggcccttttgcaaggcttagggtgtggccagccctgaaagctacttggacacaggtttcagctggccccagcccagaagtgacccccagaaagggagggccaccgctttgccccctgcttttacccttccttctgggtgctctacacctcaggttaccaggcctgaggcatctcagccaagcttgtttcctgctctgaggcttgtggggtgggagccagagtggaggtcggtgaaataaagtgatgcaattagacccca

SEQ ID NO: 103237 - DNA, 980 bp, Homo sapiens
  Payload ID: 133
  Gene Symbol: ABHD14B
  Gene Name: abhydrolase domain containing 14B
  Uniprot ID: Q96IU4
  ENST ID: ENST00000525795
  CDS Start-End: 195-827
ctcttcccagcgttcctcctccggccccaggtcaccgccagcacgcgcctgcttcccgtctgcgcgagtccacgcagctccccagatcaagaagctgaggccccaggttacacactaaagtaaatggcagaggcagaaataacacctatgtcctcctgaccccaaggcccttcaccagcacagcagcagcaggcatggcagcaagcgtggagcagcgcgagggcaccatccaggtgcagggccaggccctcttcttccgagaggccctgcccggcagtgggcaggctcgcttctctgtactgctgctgcatggtattcgcttctcctccgagacctggcagaacctgggtacactgcacaggctggcccaggctggctaccgggctgtggccattgacctgccaggtctggggcactccaaggaagcagcagcccctgcccctattggggagctggcccctggcagcttcctggcggctgtggtggatgccttggagctgggccccccggttgtgatcagtccatcactgagtggcatgtactccctgcccttcctcacggcccctggctcccagctcccgggctttgtgccagtggcccccatctgcactgacaaaatcaatgctgccaactatgccagtgtgaagactccagctctgattgtatatggagaccaggaccccatgggtcagaccagctttgagcacctgaagcagctgcccaaccaccgggtgctgatcatgaagggggcggggcacccctgttacctggacaaaccagaggagtggcatacagggctgctggacttcctgcaggggctccagtgaagcccagcactgctgcagggggtgggctgcctgcctgctctgagctctctcttgcacgctctctcttctctcccaggctctggctcatgcacatgcaacaggtgcgtctgtctatatgtctgggttcttgtcttttgtggtctgtttgtcttt

SEQ ID NO: 103238 - DNA, 3592 bp, Homo sapiens
  Payload ID: 134
  Gene Symbol: ABHD15
  Gene Name: abhydrolase domain containing 15
  Uniprot ID: Q6UXT9
  ENST ID: ENST00000307201
  CDS Start-End: 172-1578
cagccgggcccgaactggctgcctctgcccggccacggccaatccagagcgcgcccgcgcgggagggccctgggcagccgccgccggcgggcggagccgcgggcaaagcgcggagctcgccgagtagacggccccgccgcccgctgcccgccggggctctccagcttcgccatgccgccgtggggcgccgccctcgcgctcatcttggccgtgctcgcccttctcggcctgctcggcccgcggctccggggaccctgggggcgcgccgtcggagagaggaccctgccgggggcccaagaccgagacgacggggaggaggcggacggcggaggcccggcggaccagttcagcgacgggcgcgagccactgccgggagggtgcagccttgtttgcaagccgtcggccctggcccagtgcctgctgcgcgccctgcggcgctcagaggcgctggaggccggcccgcgctcctggttctccgggccccacctgcagaccctctgccacttcgtcctgcccgtagcgcctgggcctgagctggcccgggagtacctgcagttggcggacgatgggctagtggccctggactgggtggtaggaccttgtgttcggggccgccggatcaccagcgccgggggccttcctgcggtgcttctggtgatccccaatgcgtggggtcgcctcacccgcaacgtgctcggcctttgcttgctcgccctggagcgcggctactacccggtcatcttccatcgccgcggccaccacggttgcccactggtcagcccccggctgcagcctttcggggacccgtccgacctcaaggaggcggtcacatacatccgcttccgacacccggcggcgccgctgttcgcggtgagcgaaggctcgggctcggcgctgctcctgtcctacctgggcgagtgcggctcctccagctacgtgacaggcgccgcctgcatctcgcccgtgctgcgctgccgagagtggttcgaggccggcctgccctggccctacgagcggggctttctgctccaccagaagatcgccctcagcaggtatgccacagccctggaggacactgtggacaccagcagactgttcaggagccgttcccttcgagagtttgaggaggctctcttctgccacaccaaaagcttccccatcagctgggatacctactgggaccgcaacgacccgctccgggatgtcgatgaggcagccgtgcctgtgctgtgtatctgcagtgctgacgaccccgtgtgtggacccccagaccacactctgacaactgaactcttccacagcaacccctacttcttcctcctgctcagtcgccacggaggccactgtggcttcctgcgccaggagcccttgccagcctggagccatgaggtcatcttggagtccttccgggccttgactgagttcttccgaacggaggagaggattaaagggctgagcaggcacagagcttccttccttgggggccgtcgtcgtgggggagccttgcagaggcgggaagtctcttcctcttccaacctggaggagatctttaactggaagcgatcatacacaaggtgaaagacctggcctgagaacccccaagtcctgcaaagaaaaacagagctgggcaagggggagtcctggaaagatggggcggactgaacagagggagctccagctctgtgctcctcattcagtccctctctcttaaattggtgccttgaaagagaaggaacgtcctgcgagcctgcactcacttcatcctcagcagaactcctgcctggcctctgctcaacatatccctactcatccggtcagcagcggcgcgttccagtcactgtcacctgtcactgacatcacaagccaaaggatagcactttttcaatccatggactcaggagaaaatgccctcttactggcagtggctagagggatgagacgtttgtgtatgtcactgggcagtgaccccgattctcaagctggagccatttgatgtcatgaggacaggatgtttgtgtctcggccccacttccctcatttgctctgtggttgtggcgccctgctttgaccgaatgctctggcaactgcggcagcaggcttgtgtgtgtgagaagggcggcagaggcagtggggctggctcgctgagggctgagcaggtagagaatgtgaatgtccatctcaaggaatgcgaagttccaatctctcagaggagctctgcaagtctcagctaggaatggggctgatctggcccccaagcctcactggagagatcccaagggtattttacaaataggaagcgctctcatgcaggatctgagggctttgctagaccatggttcaaggagtcagaatcttggctaccctacatgctccctctggcaccatttcaggggattactccagagagctgcagccagaactgtttatctcctgagatatggactttctctaagtcaggaaaagcacaaacctcataacttaggtgttttctggttggttgctcccttttctgatcctactactggcctctccctttccagagccaggagacacatctgggaccagaggaaacaaaagcaccaagaggttgactagagctgaccagtgatttacaaatatttcatattccaatgcttcgtctgctcaattattcaaaaggccatccctgtaaaggcagaaaagcttcctcttagatctggccactcagcaaataagtgggtatttggttttatgaagaataatgctgaggactagagatatagtatatcagagataatatatagtatacaggttgatctaaatattctggtttggattaggcaattaaaatttttttggcaacaggacatatgtttccatgtgttgctaagattcaaaaactttgccctgaagttttattttaatcgtcattgagaaagagggctcctgttctgacctcaaaaacagcaaagctgttgtaaagaagagagctgcttatacgaaaacccacattccaagacttggtataaggtattcctgaggccttgatttcaggtttggataatcttgccccagattctagatcttgttcttctagatcaaatcagaagaaactttgaaataactccaagaatctgcactgaaatgtagacagcactcgataatctaagggacattatcttgttgtgaaaaattatctccctcctggctgggagcggtggcacacacctataatctcagcactttgggaggccgaggtgggtggatcacgaggtcaggagatcgagaccatcctggctaacacagtgaaacctcatctctactaaaaatacaaaaaattagccgggcgtggtagcgggtgcctgtaatcccagttactcaggaggctgaggcaggagaatggcgtgaacccgggaggcggagcttgcagtgagctgagatcgcaccactgcactccagcctgggcgacagagtaagactgtgtttcaaaaaaaaaaaagaaaagaaaaattatctcccttctccccacttcttgtttctcctcctccatattcctcatctgacgttcttttgccgtttctaagcaggataaataaaaaggaactgaaattaa

SEQ ID NO: 103239 - DNA, 2103 bp, Homo sapiens
  Payload ID: 135
  Gene Symbol: ABHD16A
  Gene Name: abhydrolase domain containing 16A
  Uniprot ID: O95870
  ENST ID: ENST00000395952
  CDS Start-End: 164-1840
aactgcgcgaaactcttctcaggaagcactgaaaatgtcgcaactcgcccggaggcggagccggtacgggctgacgtcaagggcacacaacacctcagaggcagggagggcggggccggcagggggacctgctgctggaagagcagcggcccgagccggggccatggcgaagctgctgagctgcgtcctaggcccccggctctacaaaatctaccgggagagggactctgaaagggccccggccagcgtccctgagacgccaacggcagtcactgccccccattccagctcctgggatacgtactatcagccccgtgccctggagaaacatgctgacagcatcctggcactggcttcagtattctggtccatctcttattactcctctcccttcgccttcttctacttgtacaggaaaggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagacaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgtctccacgcccctggaagctggatattcagtcctgggctggaatcatccaggctttgctggaagcacgggggtgccattcccgcagaatgaggctaatgccatggatgtggtggtccagtttgccatccaccgcctaggcttccagccccaggacatcatcatctacgcctggtccatcggcggcttcactgccacgtgggcagccatgtcctacccagatgttagtgccatgatcctggatgcctcctttgatgacctggtgcccttggccttgaaggtcatgccagacagctggaggggcctggtgaccaggaccgtgaggcagcatctcaatctaaacaacgcggagcagctgtgcagataccagggtcctgtactgctgatccggagaaccaaggatgagatcatcaccaccacggttcctgaggacatcatgtccaaccgaggcaatgacctcctgctgaagctcctgcagcatcggtatccccgggtgatggcagaggagggtcttcgagtggtgaggcagtggttggaggcctcctcacagctggaggaagcctcaatttatagccgatgggaggtggaagaggactggtgtctgtctgtcctccgctcctaccaggcagaacacgggcccgacttcccctggagcgtgggggaggacatgagtgcagatggacggcggcagctggctttgtttctggctcggaagcatctgcacaactttgaggccactcactgcaccccactcccagcccagaacttccagatgccctggcacctctagggaccaactgggactcattatggaagaatggggtgagaggagacatgaggaaagaccctcttatttgtgattctctgtgttcatgttgctgtttatagtttgtggaaagtgggggaccatcccccttctcaccactgttcctcttgcacgtttcccctcattcatgtggctgtacttaaccttctccaacatacatcctgcattacatgaatggattattcctaataattaataaaaaggtattttttctactatcaggctaa

SEQ ID NO: 103240 - DNA, 889 bp, Homo sapiens
  Payload ID: 135
  Gene Symbol: ABHD16A
  Gene Name: abhydrolase domain containing 16A
  ENST ID: ENST00000414591
  CDS Start-End: 99-889
agttgagtcttgagtcccgggaagagaccctgcgcggactggggagccgttgaattttgctgtcagactcccagtttcctcttcttcagtgcctcttcatgcctcccccggctctgtttttatcttccctttaccctcgccttgaatttcagaatgacttttacagatcctgtatccgtcggtcctcccctcaacccccgcccaacctagcctggagacccgagtcattgtattctggagagctggcgggtggtggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagacaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgt

SEQ ID NO: 103241 - DNA, 2069 bp, Homo sapiens
  Payload ID: 135
  Gene Symbol: ABHD16A
  Gene Name: abhydrolase domain containing 16A
  ENST ID: ENST00000429735
  CDS Start-End: 7-1812
ctgaaaatgtcgcaactcgcccggaggcggagccggtacgggctgacgtcaagggcacacaacacctcagaggcagggagggcggggccggcagggggacctgctgctggaagagcagcggcccgagccggggccatggcgaagctgctgagctgcgtcctaggcccccggctctacaaaatctaccgggagagggactctgaaagggccccggccagcgtccctgagacgccaacggcagtcactgccccccattccagctcctgggatacgtactatcagccccgtgccctggagaaacatgctgacagcatcctggcactggcttcagtattctggtccatctcttattactcctctcccttcgccttcttctacttgtacaggaaaggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagacaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgtctccacgcccctggaagctggatattcagtcctgggctggaatcatccaggctttgctggaagcacgggggtgccattcccgcagaatgaggctaatgccatggatgtggtggtccagtttgccatccaccgcctaggcttccagccccaggacatcatcatctacgcctggtccatcggcggcttcactgccacgtgggcagccatgtcctacccagatgttagtgccatgatcctggatgcctcctttgatgacctggtgcccttggccttgaaggtcatgccagacagctggaggggcctggtgaccaggaccgtgaggcagcatctcaatctaaacaacgcggagcagctgtgcagataccagggtcctgtactgctgatccggagaaccaaggatgagatcatcaccaccacggttcctgaggacatcatgtccaaccgaggcaatgacctcctgctgaagctcctgcagcatcggtatccccgggtgatggcagaggagggtcttcgagtggtgaggcagtggttggaggcctcctcacagctggaggaagcctcaatttatagccgatgggaggtggaagaggactggtgtctgtctgtcctccgctcctaccaggcagaacacgggcccgacttcccctggagcgtgggggaggacatgagtgcagatggacggcggcagctggctttgtttctggctcggaagcatctgcacaactttgaggccactcactgcaccccactcccagcccagaacttccagatgccctggcacctctagggaccaactgggactcattatggaagaatggggtgagaggagacatgaggaaagaccctcttatttgtgattctctgtgttcatgttgctgtttatagtttgtggaaagtgggggaccatcccccttctcaccactgttcctcttgcacgtttcccctcattcatgtggctgtacttaaccttctccaacatacatcctgcattacatgaatggattattcctaataattaataaaaaggtattttttctactatca

SEQ ID NO: 103242 - DNA, 889 bp, Homo sapiens; identical to SEQ ID NO: 103240
  Payload ID: 135
  Gene Symbol: ABHD16A
  Gene Name: abhydrolase domain containing 16A
  ENST ID: ENST00000422411
  CDS Start-End: 99-889

SEQ ID NO: 103243 - DNA, 889 bp, Homo sapiens; identical to SEQ ID NO: 103240
  Payload ID: 135
  Gene Symbol: ABHD16A
  Gene Name: abhydrolase domain containing 16A
  ENST ID: ENST00000422404
  CDS Start-End: 99-889

SEQ ID NO: 103244 - DNA, 2068 bp, Homo sapiens
  Payload ID: 135
  Gene Symbol: ABHD16A
  Gene Name: abhydrolase domain containing 16A
  Uniprot ID: O95870
  ENST ID: ENST00000446529
  CDS Start-End: 136-1812
ctgaaaatgtcgcaactcgcccggaggcggagccggtacgggctgacgtcaagggcacacaacacctcagaggcagggagggcggggccggcagggggacctgctgctggaagagcagcggcccgagccggggccatggcgaagctgctgagctgcgtcctaggcccccggctctacaaaatctaccgggagagggactctgaaagggccccggccagcgtccctgagacgccaacggcagtcactgccccccattccagctcctgggatacgtactatcagccccgtgccctggagaaacatgctgacagcatcctggcactggcttcagtattctggtccatctcttattactcctctcccttcgccttcttctacttgtacaggaaaggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagacaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgtctccacgcccctggaagctggatattcagtcctgggctggaatcatccaggctttgctggaagcacgggggtgccattcccgcagaatgaggctaatgccatggatgtggtggtccagtttgccatccaccgcctgggcttccagccccaggacatcatcatctacgcctggtccatcggcggcttcactgccacgtgggcagccatgtcctacccagatgttagtgccatgatcctggatgcctcctttgatgacctggtgcccttggccttgaaggtcatgccagacagctggaggggcctggtgaccaggaccgtgaggcagcatctcaatctaaacaacgcggagcagctgtgcagataccagggtcctgtactgctgatccggagaaccaaggatgagatcatcaccaccacggttcctgaggacatcatgtccaaccgaggcaatgacctcctgctgaagctcctgcagcatcggtatccccgggtgatggcagaggagggtcttcgagtggtgaggcagtggttggaggcctcctcacagctggaggaagcctcaatttatagccgatgggaggtggaagaggactggtgtctgtctgtcctccgctcctaccaggcagaacacgggcctgacttcccctggagcgtgggggaggacatgagtgcagatggacggcggcagctggctttgtttctggctcggaagcatctgcacaactttgaggccactcactgcaccccactcccagcccagaacttccagatgccctggcacctctagggaccaactgggactcattatggaagaatggggtgagaggagacatgaggaaagaccctcttatttgtgattctctgtgttcatgttgctgtttatagtttgtggaaagtgggggaccatcccccttctcaccactgttcctcttgcacgtttcccctcattcatgtggctgtacttaaccttctccaacatacatcctgcattacatgaatggattattcctaataattaataaaaaggtattttttctactatc

SEQ ID NO: 103245 - DNA, 889 bp, Homo sapiens; identical to SEQ ID NO: 103240
  Payload ID: 135
  Gene Symbol: ABHD16A
  Gene Name: abhydrolase domain containing 16A
  ENST ID: ENST00000446366
  CDS Start-End: 99-889

SEQ ID NO: 103246 - DNA, 2068 bp, Homo sapiens; identical to SEQ ID NO: 103244
  Payload ID: 135
  Gene Symbol: ABHD16A
  Gene Name: abhydrolase domain containing 16A
  ENST ID: ENST00000432617
  CDS Start-End: 7-1812

SEQ ID NO: 103247 - DNA, 2069 bp, Homo sapiens
  Payload ID: 135
  Gene Symbol: ABHD16A
  Gene Name: abhydrolase domain containing 16A
  ENST ID: ENST00000457366
  CDS Start-End: 7-1812
ctgaaaatgtcgcaactcgcccggaggcggagccggtacgggctgacgtcaagggcacacaacacctcagaggcagggagggcggggccggcagggggacctgctgctggaagagcagcggcccgagccggggccatggcgaagctgctgagctgcgtcctaggcccccggctctacaaaatctaccgggagagggactctgaaagggccccggccagcgtccctgagacgccaacggcagtcactgccccccattccagctcctgggatacgtactatcagccccgtgccctggagaaacatgctgacagcatcctggcactggcttcagtattctggtccatctcttattactcctctcccttcgccttcttctacttgtacaggaaaggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagacaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgtctccacgcccctggaagctggatattcagtcctgggctggaatcatccaggctttgctggaagcacgggggtgccattcccgcagaatgaggctaatgccatggatgtggtggtccagtttgccatccaccgcctgggcttccagccccaggacatcatcatctacgcctggtccatcggcggcttcactgccacgtgggcagccatgtcctacccagatgttagtgccatgatcctggatgcctcctttgatgacctggtgcccttggccttgaaggtcatgccagacagctggaggggcctggtgaccaggaccgtgaggcagcatctcaatctaaacaacgcggagcagctgtgcagataccagggtcctgtactgctgatccggagaaccaaggatgagatcatcaccaccacggttcctgaggacatcatgtccaaccgaggcaatgacctcctgctgaagctcctgcagcatcggtatccccgggtgatggcagaggagggtcttcgagtggtgaggcagtggttggaggcctcctcacagctggaggaagcctcaatttatagccgatgggaggtggaagaggactggtgtctgtctgtcctccgctcctaccaggcagaacacgggcccgacttcccctggagcgtgggggaggacatgagtgcagatggacggcggcagctggctttgtttctggctcggaagcatctgcacaactttgaggccactcactgcaccccactcccagcccagaacttccagatgccctggcacctctagggaccaactgggactcattatggaagaatggggtgagaggagacatgaggaaagaccctcttatttgtgattctctgtgttcatgttgctgtttatagtttgtggaaagtgggggaccatcccccttctcaccactgttcctcttgcacgtttcccctcattcatgtggctgtacttaaccttctccaacatacatcctgcattacatgaatggattattcctaataattaataaaaaggtattttttctactatca

SEQ ID NO: 103248 - DNA, 889 bp, Homo sapiens; identical to SEQ ID NO: 103240
  Payload ID: 135
  Gene Symbol: ABHD16A
  Gene Name: abhydrolase domain containing 16A
  ENST ID: ENST00000440799
  CDS Start-End: 99-889

SEQ ID NO: 103249 - DNA, 2069 bp, Homo sapiens; identical to SEQ ID NO: 103247
  Payload ID: 135
  Gene Symbol: ABHD16A
  Gene Name: abhydrolase domain containing 16A
  ENST ID: ENST00000444818
  CDS Start-End: 7-1812

SEQ ID NO: 103250 - DNA, 1906 bp, Homo sapiens
  Payload ID: 135
  Gene Symbol: ABHD16A
  Gene Name: abhydrolase domain containing 16A
  Uniprot ID: O95870
  ENST ID: ENST00000440843
  CDS Start-End: 303-1880
aatgggaaataaggggagcctgcttgtcaagccagttatccgcaaaatctgcgctctgtgtgcttcctgagttaaagtcacgcctacggactggccgcctcctttctttttcgctctttaccgctttctcattccgactgccactctttgttctttcctctccgcgtccccccgaccctgtgtgtcgtggttcgtgccggtcccagttgagtcttgagtcccgggaagagaccctgcgcggactggggagccgttgaattttgctgtcagactcccagtttcctcttcttcagtgcctcttcatgcctcccccggctctgtttttatcttccctttaccctcgccttgaatttcagaatgacttttacagatcctgtatccgtcggtcctcccctcaacccccgcccaacctagcctggagacccgagtcattgtattctggagagctggcgggtggtggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagacaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgtctccacgcccctggaagctggatattcagtcctgggctggaatcatccaggctttgctggaagcacgggggtgccattcccgcagaatgaggctaatgccatggatgtggtggtccagtttgccatccaccgcctaggcttccagccccaggacatcatcatctacgcctggtccatcggcggcttcactgccacgtgggcagccatgtcctacccagatgttagtgccatgatcctggatgcctcctttgatgacctggtgcccttggccttgaaggtcatgccagacagctggaggggcctggtgaccaggaccgtgaggcagcatctcaatctaaacaacgcggagcagctgtgcagataccagggtcctgtactgctgatccggagaaccaaggatgagatcatcaccaccacggttcctgaggacatcatgtccaaccgaggcaatgacctcctgctgaagctcctgcagcatcggtatccccgggtgatggcagaggagggtcttcgagtggtgaggcagtggttggaggcctcctcacagctggaggaagcctcaatttatagccgatgggaggtggaagaggactggtgtctgtctgtcctccgctcctaccaggcagaacacgggcccgacttcccctggagcgtgggggaggacatgagtgcagatggacggcggcagctggctttgtttctggctcggaagcatctgcacaactttgaggccactcactgcaccccactcccagcccagaacttccagatgccctggcacctctagggaccaactgggactcattatggaag

SEQ ID NO: 103251 - DNA, 889 bp, Homo sapiens; identical to SEQ ID NO: 103240
  Payload ID: 135
  Gene Symbol: ABHD16A
  Gene Name: abhydrolase domain containing 16A
  ENST ID: ENST00000431671
  CDS Start-End: 99-889

SEQ ID NO: 103252 - DNA, 2069 bp, Homo sapiens; identical to SEQ ID NO: 103247
  Payload ID: 135
  Gene Symbol: ABHD16A
  Gene Name: abhydrolase domain containing 16A
  ENST ID: ENST00000413853
  CDS Start-End: 7-1812

SEQ ID NO: 103253 - DNA, 1000 bp, Homo sapiens
  Payload ID: 135
  Gene Symbol: ABHD16A
  Gene Name: abhydrolase domain containing 16A
  ENST ID: ENST00000468037
  CDS Start-End: 217-414
cggactggccgcctcctttctttttcgctctttaccgctttctcattccgactgccactctttgttctttcctctccgcgtccccccgaccctgtgtgtcgtggttcgtgccggtcccagttgagtcttgagtcccgggaagagaccctgcgcggactggggagccgttgaattttgctgtcagactcccagtttcctcttcttcagtgcctcttcatgcctcccccggctctgtttttatcttccctttaccctcgccttgaatttcagaatgacttttacagatcctgtatccgtcggtcctcccctcaacccccgcccaacctagcctggagacccgagtcattgtattctggagagctggcgggtggtggatacgtactatcagccccgtgccctggagaaacatgctgacagcatcctggcactggcttcagtattctggtccatctcttattactcctctcccttcgccttcttctacttgtacaggaaaggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagacaccctcctcaaccgggttaagaagctgccttgtcagatcaccaggtgggaaacagcagcgaggagaggcccactggggtggaggggccatttcaggagtgctctgggagtgggcgctccattgtaaaatagctgtcactcattgggcctagtgctgtatggtttgtgtagatcattt

SEQ ID NO: 103254 - DNA, 1892 bp, Homo sapiens
  Payload ID: 135
  Gene Symbol: ABHD16A
  Gene Name: abhydrolase domain containing 16A
  ENST ID: ENST00000495769
  CDS Start-End: 60-257
ggagggcggggccggcagggggacctgctgctggaagagcagcggcccgagccggggccatggcgaagctgctgagctgcgtcctaggcccccggctctacaaaatctaccgggagagggactctgaaagggccccggccagcgtccctgagacgccaacggcagtcactgccccccattccagctcctgggatacgtactatcagccccgtgccctggagaaacatgctgacagcatcctggcactggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagacaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgtctccacgcccctggaagctggatattcagtcctgggctggaatcatccaggctttgctggaagcacgggggtgccattcccgcagaatgaggctaatgccatggatgtggtggtccagtttgccatccaccgcctaggcttccagccccaggacatcatcatctacgcctggtccatcggcggcttcactgccacgtgggcagccatgtcctacccagatgttagtgccatgatcctggatgcctcctttgatgacctggtgcccttggccttgaaggtcatgccagacagctggaggggcctggtgaccaggaccgtgaggcagcatctcaatctaaacaacgcggagcagctgtgcagataccagggtcctgtactgctgatccggagaaccaaggatgagatcatcaccaccacggttcctgaggacatcatgtccaaccgaggcaatgacctcctgctgaagctcctgcagcatcggtatccccgggtgatggcagaggagggtcttcgagtggtgaggcagtggttggaggcctcctcacagctggaggaagcctcaatttatagccgatgggaggtggaagaggactggtgtctgtctgtcctccgctcctaccaggcagaacacgggcccgacttcccctggagcgtgggggaggacatgagtgcagatggacggcggcagctggctttgtttctggctcggaagcatctgcacaactttgaggccactcactgcaccccactcccagcccagaacttccagatgccctggcacctctagggaccaactgggactcattatggaagaatggggtgagaggagacatgaggaaagaccctcttatttgtgattctctgtgttcatgttgctgtttatagtttgtggaaagtgggggaccatcccccttctcaccactgttcctcttgcacgtttcccctcattcatgtggctgtacttaaccttctccaacatacatcctgcattacatgaatggattattcct

SEQ ID NO: 103255 - DNA, 582 bp, Homo sapiens
  Payload ID: 135
  Gene Symbol: ABHD16A
  Gene Name: abhydrolase domain containing 16A
  ENST ID: ENST00000477462
  CDS Start-End: 20-160
agcggcccgagccggggccatggcgaagctgctgagctgcgtcctaggcccccggctctacaaaatctaccgggagagggactctgaaagggccccggccagcgtccctgagacgccaacggcagtcactgccccccattccagctcctgggttacttgagtttgtccaaagtggtgccgttttctcactatgctgggacattgctgctacttctggcaggtgtggcctgcctccgagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagacaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctg

SEQ ID NO: 103256 - DNA, 864 bp, Homo sapiens
  Payload ID: 135
  Gene Symbol: ABHD16A
  Gene Name: abhydrolase domain containing 16A
  ENST ID: ENST00000482224
  CDS Start-End: 31-228
gctggaagagcagcggcccgagccggggccatggcgaagctgctgagctgcgtcctaggcccccggctctacaaaatctaccgggagagggactctgaaagggccccggccagcgtccctgagacgccaacggcagtcactgccccccattccagctcctgggatacgtactatcagccccgtgccctggagaaacatgctgacagcatcctggcactggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagacaccctcctcaaccgggttaagaagctgccttgtcagatcaccaggtgggaaacagcagcgaggagaggcccactggggtggaggggccatttcaggagtgctctgggagtgggcgctccattgtaaaatagctgtcactcattgggcctagtgctgtatggtttgtgtagatcatttatggcaaagtcatttttatccatatttatgtttgaagaaaagaggctcagagaggtctggagtctcaaatgtagtaagtaaagaactgggatatgaacaaaagctccttcagtgaggctgaaaaggagcagtgggggtgggg

SEQ ID NO: 103257 - DNA, 2260 bp, Homo sapiens
  Payload ID: 135
  Gene Symbol: ABHD16A
  Gene Name: abhydrolase domain containing 16A
  ENST ID: ENST00000492084
  CDS Start-End: 306-503
cataatgggaaataaggggagcctgcttgtcaagccagttatccgcaaaatctgcgctctgtgtgcttcctgagttaaagtcacgcctacggactggccgcctcctttctttttcgctctttaccgctttctcattccgactgccactctttgttctttcctctccgcgtccccccgaccctgtgtgtcgtggttcgtgccggtcccagttgagtcttgagtcccgggaagagaccctgcgcggactggggagccgttgaattttgctgtcagactcccagtttcctcttcttcagtgcctcttcatgcctcccccggctctgtttttatcttccctttaccctcgccttgaatttcagaatgacttttacagatcctgtatccgtcggtcctcccctcaacccccgcccaacctagcctggagacccgagtcattgtattctggagagctggcgggtggtggatacgtactatcagccccgtgccctggagaaacatgctgacagcatcctggcactggcttcagtattctggtccatctcttattactcctctcccttcgccttcttctacttgtacaggaaaggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagacaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgtctccacgcccctggaagctggatattcagtcctgggctggaatcatccaggctttgctggaagcacgggggtgccattcccgcagaatgaggctaatgccatggatgtggtggtccagtttgccatccaccgcctaggcttccagccccaggacatcatcatctacgcctggtccatcggcggcttcactgccacgtgggcagccatgtcctacccagatgttagtgccatgatcctggatgcctcctttgatgacctggtgcccttggccttgaaggtcatgccagacagctggaggggcctggtgaccaggaccgtgaggcagcatctcaatctaaacaacgcggagcagctgtgcagataccagggtcctgtactgctgatccggagaaccaaggatgagatcatcaccaccacggttcctgaggacatcatgtccaaccgaggcaatgacctcctgctgaagctcctgcagcatcggtatccccgggtgatggcagaggagggtcttcgagtggtgaggcagtggttggaggcctcctcacagctggaggaagcctcaatttatagccgatgggaggtggaagaggactggtgtctgtctgtcctccgctcctaccaggcagaacacgggcccgacttcccctggagcgtgggggaggacatgagtgcagatggacggcggcagctggctttgtttctggctcggaagcatctgcacaactttgaggccactcactgcaccccactcccagcccagaacttccagatgccctggcacctctagggaccaactgggactcattatggaagaatggggtgagaggagacatgaggaaagaccctcttatttgtgattctctgtgttcatgttgctgtttatagtttgtggaaagtgggggaccatcccccttctcaccactgttcctcttgcacgtttcccctcattcatgtggctgtacttaaccttctccaacatacatcctgcattacatgaatggattattcctaataattaataaaaaggtattttttctact

SEQ ID NO: 103258 - DNA, 1137 bp, Homo sapiens
  Payload ID: 135
  Gene Symbol: ABHD16A
  Gene Name: abhydrolase domain containing 16A
  ENST ID: ENST00000498420
  CDS Start-End: 76-216
aacacctcagaggcagggagggcggggccggcagggggacctgctgctggaagagcagcggcccgagccggggccatggcgaagctgctgagctgcgtcctaggcccccggctctacaaaatctaccgggagagggactctgaaagggccccggccagcgtccctgagacgccaacggcagtcactgccccccattccagctcctgggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagacaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgtctccacgcccctggaagctggatattcagtcctgggctggaatcatccaggctttgctggaagcacgggggtgccattcccgcagaatgaggctaatgccatggatgtggtggtccagtttgccatccaccgcctaggcttccagccccaggacatcatcatctacgcctggtccatcggcggcttcactgccacgtgggcagccatgtcctacccagatgttagtgccatgatcctggatgcctcctttgatgacctggtgcccttggccttgaaggtcatgccagacagctgga

SEQ ID NO: 103259 - DNA, 2146 bp, Homo sapiens
  Payload ID: 135
  Gene Symbol: ABHD16A
  Gene Name: abhydrolase domain containing 16A
  Uniprot ID: O95870
  ENST ID: ENST00000550556
  CDS Start-End: 306-1883
cataatgggaaataaggggagcctgcttgtcaagccagttatccgcaaaatctgcgctctgtgtgcttcctgagttaaagtcacgcctacggactggccgcctcctttctttttcgctctttaccgctttctcattccgactgccactctttgttctttcctctccgcgtccccccgaccctgtgtgtcgtggttcgtgccggtcccagttgagtcttgagtcccgggaagagaccctgcgcggactggggagccgttgaattttgctgtcagactcccagtttcctcttcttcagtgcctcttcatgcctcccccggctctgtttttatcttccctttaccctcgccttgaatttcagaatgacttttacagatcctgtatccgtcggtcctcccctcaacccccgcccaacctagcctggagacccgagtcattgtattctggagagctggcgggtggtggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagacaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgtctccacgcccctggaagctggatattcagtcctgggctggaatcatccaggctttgctggaagcacgggggtgccattcccgcagaatgaggctaatgccatggatgtggtggtccagtttgccatccaccgcctgggcttccagccccaggacatcatcatctacgcctggtccatcggcggcttcactgccacgtgggcagccatgtcctacccagatgttagtgccatgatcctggatgcctcctttgatgacctggtgcccttggccttgaaggtcatgccagacagctggaggggcctggtgaccaggaccgtgaggcagcatctcaatctaaacaacgcggagcagctgtgcagataccagggtcctgtactgctgatccggagaaccaaggatgagatcatcaccaccacggttcctgaggacatcatgtccaaccgaggcaatgacctcctgctgaagctcctgcagcatcggtatccccgggtgatggcagaggagggtcttcgagtggtgaggcagtggttggaggcctcctcacagctggaggaagcctcaatttatagccgatgggaggtggaagaggactggtgtctgtctgtcctccgctcctaccaggcagaacacgggcccgacttcccctggagcgtgggggaggacatgagtgcagatggacggcggcagctggctttgtttctggctcggaagcatctgcacaactttgaggccactcactgcaccccactcccagcccagaacttccagatgccctggcacctctagggaccaactgggactcattatggaagaatggggtgagaggagacatgaggaaagaccctcttatttgtgattctctgtgttcatgttgctgtttatagtttgtggaaagtgggggaccatcccccttctcaccactgttcctcttgcacgtttcccctcattcatgtggctgtacttaaccttctccaacatacatcctgcattacatgaatggattattcctaataattaataaaaaggtattttttctactatcaggctaa

SEQ ID NO: 103260 - DNA, 2146 bp, Homo sapiens
  Payload ID: 135
  Gene Symbol: ABHD16A
  Gene Name: abhydrolase domain containing 16A
  Uniprot ID: O95870
  ENST ID: ENST00000549722
  CDS Start-End: 306-1883
cataatgggaaataaggggagcctgcttgtcaagccagttatccgcaaaatctgcgctctgtgtgcttcctgagttaaagtcacgcctacggactggccgcctcctttctttttcgctctttaccgctttctcattccgactgccactctttgttctttcctctccgcgtccccccgaccctgtgtgtcgtggttcgtgccggtcccagttgagtcttgagtcccgggaagagaccctgcgcggactggggagccgttgaattttgctgtcagactcccagtttcctcttcttcagtgcctcttcatgcctcccccggctctgtttttatcttccctttaccctcgccttgaatttcagaatgacttttacagatcctgtatccgtcggtcctcccctcaacccccgcccaacctagcctggagacccgagtcattgtattctggagagctggcgggtggtggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagacaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgtctccacgcccctggaagctggatattcagtcctgggctggaatcatccaggctttgctggaagcacgggggtgccattcccgcagaatgaggctaatgccatggatgtggtggtccagtttgccatccaccgcctgggcttccagccccaggacatcatcatctacgcctggtccatcggcggcttcactgccacgtgggcagccatgtcctacccagatgttagtgccatgatcctggatgcctcctttgatgacctggtgcccttggccttgaaggtcatgccagacagctggaggggcctggtgaccaggaccgtgaggcagcatctcaatctaaacaacgcggagcagctgtgcagataccagggtcctgtactgctgatccggagaaccaaggatgagatcatcaccaccacggttcctgaggacatcatgtccaaccgaggcaatgacctcctgctgaagctcctgcagcatcggtatccccgggtgatggcagaggagggtcttcgagtggtgaggcagtggttggaggcctcctcacagctggaggaagcctcaatttatagccgatgggaggtggaagaggactggtgtctgtctgtcctccgctcctaccaggcagaacacgggcctgacttcccctggagcgtgggggaggacatgagtgcagatggacggcggcagctggctttgtttctggctcggaagcatctgcacaactttgaggccactcactgcaccccactcccagcccagaacttccagatgccctggcacctctagggaccaactgggactcattatggaagaatggggtgagaggagacatgaggaaagaccctcttatttgtgattctctgtgttcatgttgctgtttatagtttgtggaaagtgggggaccatcccccttctcaccactgttcctcttgcacgtttcccctcattcatgtggctgtacttaaccttctccaacatacatcctgcattacatgaatggattattcctaataattaataaaaaggtattttttctactatctggctaa

SEQ ID NO: 103261 - DNA, 2146 bp, Homo sapiens; identical to SEQ ID NO: 103259
  Payload ID: 135
  Gene Symbol: ABHD16A
  Gene Name: abhydrolase domain containing 16A
  Uniprot ID: O95870
  ENST ID: ENST00000549853
  CDS Start-End: 306-1883

SEQ ID NO: 103262 - DNA, 2146 bp, Homo sapiens; identical to SEQ ID NO: 103260
  Payload ID: 135
  Gene Symbol: ABHD16A
  Gene Name: abhydrolase domain containing 16A
  Uniprot ID: O95870
  ENST ID: ENST00000548592
  CDS Start-End: 306-1883

SEQ ID NO: 103263 - DNA, 2146 bp, Homo sapiens
  Payload ID: 135
  Gene Symbol: ABHD16A
  Gene Name: abhydrolase domain containing 16A
  Uniprot ID: O95870
  ENST ID: ENST00000552042
  CDS Start-End: 306-1883
cataatgggaaataaggggagcctgcttgtcaagccagttatccgcaaaatctgcgctctgtgtgcttcctgagttaaagtcacgcctacggactggccgcctcctttctttttcgctctttaccgctttctcattccgactgccactctttgttctttcctctccgcgtccccccgaccctgtgtgtcgtggttcgtgccggtcccagttgagtcttgagtcccgggaagagaccctgcgcggactggggagccgttgaattttgctgtcagactcccagtttcctcttcttcagtgcctcttcatgcctcccccggctctgtttttatcttccctttaccctcgccttgaatttcagaatgacttttacagatcctgtatccgtcggtcctcccctcaacccccgcccaacctagcctggagacccgagtcattgtattctggagagctggcgggtggtggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagacaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgtctccacgcccctggaagctggatattcagtcctgggctggaatcatccaggctttgctggaagcacgggggtgccattcccgcagaatgaggctaatgccatggatgtggtggtccagtttgccatccaccgcctaggcttccagccccaggacatcatcatctacgcctggtccatcggcggcttcactgccacgtgggcagccatgtcctacccagatgttagtgccatgatcctggatgcctcctttgatgacctggtgcccttggccttgaaggtcatgccagacagctggaggggcctggtgaccaggaccgtgaggcagcatctcaatctaaacaacgcggagcagctgtgcagataccagggtcctgtactgctgatccggagaaccaaggatgagatcatcaccaccacggttcctgaggacatcatgtccaaccgaggcaatgacctcctgctgaagctcctgcagcatcggtatccccgggtgatggcagaggagggtcttcgagtggtgaggcagtggttggaggcctcctcacagctggaggaagcctcaatttatagccgatgggaggtggaagaggactggtgtctgtctgtcctccgctcctaccaggcagaacacgggcccgacttcccctggagcgtgggggaggacatgagtgcagatggacggcggcagctggctttgtttctggctcggaagcatctgcacaactttgaggccactcactgcaccccactcccagcccagaacttccagatgccctggcacctctagggaccaactgggactcattatggaagaatggggtgagaggagacatgaggaaagaccctcttatttgtgattctctgtgttcatgttgctgtttatagtttgtggaaagtgggggaccatcccccttctcaccactgttcctcttgcacgtttcccctcattcatgtggctgtacttaaccttctccaacatacatcctgcattacatgaatggattattcctaataattaataaaaaggtattttttctactatcaggctaa

SEQ ID NO: 103264 - DNA, 2146 bp, Homo sapiens; identical to SEQ ID NO: 103259
  Payload ID: 135
  Gene Symbol: ABHD16A
  Gene Name: abhydrolase domain containing 16A
  Uniprot ID: O95870
  ENST ID: ENST00000551038
  CDS Start-End: 306-1883

SEQ ID NO: 103265 - DNA, 1491 bp, Homo sapiens
  Payload ID: 136
  Gene Symbol: ABHD16B
  Gene Name: abhydrolase domain containing 16B
  Uniprot ID: Q9H3Z7
  ENST ID: ENST00000369916
  CDS Start-End: 44-1453
gcggcgatcccggcccagcggctgggcgttagggccaccgctcatgtgcgtcatctgcttcgtgaaggcgctggtgcgcgtgttcaagatctacctgaccgccagctacacctacccattccgcggctggcccgtggccttccgctgggatgacgtgcgcgccgtgggccggagcagcagccaccgggcgctgacctgcgcggcagccgcggcgggcgtgtggttgctgcgggacgagacgctgggcggggatgcgctggggcggcctccacgtggggcgcgcagccaggcgcagtgcctcttgcagcagctccgcgagctgcccggccagctcgctagctacgcgctggcccactcgctgggccgctggctcgtgtaccccggctccgtgtccctgatgacgcgcgcgctgctgccgctgctgcagcagggccaagagcgcctcgtggagcgctaccacggccggcgcgccaagctggtggcctgtgacggcaacgagatcgacactatgttcatggaccgccgccagcacccgggcagccacgtgcacgggccgcgcctcgtcatctgctgcgaaggcaacgcgggcttctacgagatgggctgtctgtctgcaccgctcgaggccggctactccgtgctgggctggaaccaccccggcttcggcagcagcactggcgtgcccttccctcagcacgacgccaacgccatggacgtggtggtcgagtacgcactgcaccgcctgcacttcccgcccgcgcacctggtggtctacggctggtctgttggcggcttcacggccacctgggccaccatgacctacccggagctgggtgcactggtgctggacgccaccttcgacgaccttgtgccgctggcgctgaaggtcatgccccacagttggaaggggctggtggtgcgcaccgtgcgcgagcacttcaacctcaacgtggccgagcagctgtgctgctacccggggccggtgctgctgctccgacgcacgcaggatgacgtggtcagcacttcgggccgcctgcgccccctgtcacctggtgacgtggagggcaaccggggcaatgagctgctgctgcgcctgctggagcaccgctaccccgtcgtgatggcgcgagagggccgcgccgtcgtcacccgctggctgcgcgctggcagcttggcgcaggaggccgccttctatgcacgctaccgcgtggacgaggactggtgcctggcgctgctgcgctcctaccgtgcacgctgcgaagaggagctggagggcgaggaggccctggggccacacggacccgccttcccatggctggtgggccagggcctgagctcgcggcggcgccggcgcctcgcactgttcctggctcggaagcacctcaagaacgtggaggcgactcacttcagccctctggagcctgaggagtttcagttgccctggcggctgtaacctatatgccccagtgggggatcacgcacttgaactcc

SEQ ID NO: 103266 - DNA, 1630 bp, Homo sapiens
  Payload ID: 137
  Gene Symbol: ABHD17A
  Gene Name: abhydrolase domain containing 17A
  Uniprot ID: Q96GS6
  ENST ID: ENST00000250974
  CDS Start-End: 321-1406
gcggagggaccgacggacgcacgggcgggcggccgggagccatggagcgcggccctggggcccgggggcgcgggccggggtgggcttcccacggcacgacatggagacctgtggttgcgaggctccctggggctcggcttggaccgcgatggggctgggccctggcctcctaacggggctgctgtctggggcggtagctgggggggcgctctcccccctgcccgcgactcggagcacccccacccctcccctgccgggccaggccgggcggcgttgttggcgggggccccggtggaggcccggcctgggcggcgcccgccatgaatgggctgtcgctgagtgagctctgctgcctcttctgctgcccgccctgccccggccgcatcgctgccaagctcgccttcctgccgccggaggccacctactccctggtgcctgagcccgagccggggcctggtggggccggggccgcccccttggggaccctgagagcctcctcgggcgcacccgggcgctggaagctgcacctgacggagcgtgccgacttccagtacagccagcgcgagctggacaccatcgaggtcttccccaccaagagcgcccgcggcaaccgcgtctcctgcatgtatgttcgctgcgtgcctggtgccagacaaggacaccaggctcagggaggccatccccagctggcatgggtgggcaggctgggcgactccaacaacccagcgcctggtggttgcctgctgggcaagagctggggcacaggggctgccctggcctgcgggtacatccaccttctcgccaggtacacggtcctcttctcgcacggcaatgccgtggacctgggccagatgagcagcttctacattggcctgggctcccgcctccactgcaacatcttctcctacgactactccggctacggtgccagctcgggcaggccttccgagaggaacctctatgccgacatcgacgccgcctggcaggccctgcgcaccaggtacggcatcagcccggacagcatcatcctgtacgggcagagcatcggcacggtgcccaccgtggacctggcctcgcgctacgagtgtgccgcggtggtgctgcactcgccgctcacctcgggcatgcgcgtcgccttccccgacaccaagaagacctactgcttcgacgccttccctaacatcgagaaggtgtccaagatcacgtctcccgtgctcatcatccacggcacggaggacgaggtgatcgacttctcgcacgggctggcgctctacgagcgctgccccaaggcggtggagccgctgtgggtggagggcgccgggcacaacgacatcgagctctacagccagtacctggagcgcctgcgtcgcttcatctcccaggagctgcccagccagcgcgcctagcggcggccccaaccggccggacctcagcaataaggcggcccccggacctcaccccgcgccggcccccacccaggggctgcatgtggaccccccgggcggcccaggggaccccgccccgacccaggggctgtggacgatgtacaggcaacagagctacgcactcctttccttttggaagcaagaagaaaatacgtgaaaacggaaattaaagatttaaaatttta

SEQ ID NO: 103267 - DNA, 1757 bp, Homo sapiens
  Payload ID: 137
  Gene Symbol: ABHD17A
  Gene Name: abhydrolase domain containing 17A
  Uniprot ID: Q96GS6
  ENST ID: ENST00000292577
  CDS Start-End: 435-1367
gacccccgccccgcgcgctcctcgcgtcacttccggggcggtggtgagaacgaggctcacttccgtccgtggggggagctgcggcggtggcggtgcaggaggccgggcaggggtgcggagggaccgacggacgcacgggcgggcggccgggagccatggagcgcggccctggggcccgggggcgcgggccggggtgggcttcccacggcacgacatggagacctgtggttgcgaggctccctggggctcggcttggaccgcgatggggctgggccctggcctcctaacggggctgctgtctggggcggtagctgggggggcgctctcccccctgcccgcgactcggagcacccccacccctcccctgccgggccaggccgggcggcgttgttggcgggggccccggtggaggcccggcctgggcggcgcccgccatgaatgggctgtcgctgagtgagctctgctgcctcttctgctgcccgccctgccccggccgcatcgctgccaagctcgccttcctgccgccggaggccacctactccctggtgcctgagcccgagccggggcctggtggggccggggccgcccccttggggaccctgagagcctcctcgggcgcacccgggcgctggaagctgcacctgacggagcgtgccgacttccagtacagccagcgcgagctggacaccatcgaggtcttccccaccaagagcgcccgcggcaaccgcgtctcctgcatgtatgttcgctgcgtgcctggtgccaggtacacggtcctcttctcgcacggcaatgccgtggacctgggccagatgagcagcttctacattggcctgggctcccgcctccactgcaacatcttctcctacgactactccggctacggtgccagctcgggcaggccttccgagaggaacctctatgccgacatcgacgccgcctggcaggccctgcgcaccaggtacggcatcagcccggacagcatcatcctgtacgggcagagcatcggcacggtgcccaccgtggacctggcctcgcgctacgagtgtgccgcggtggtgctgcactcgccgctcacctcgggcatgcgcgtcgccttccccgacaccaagaagacctactgcttcgacgccttccctaacatcgagaaggtgtccaagatcacgtctcccgtgctcatcatccacggcacggaggacgaggtgatcgacttctcgcacgggctggcgctctacgagcgctgccccaaggcggtggagccgctgtgggtggagggcgccgggcacaacgacatcgagctctacagccagtacctggagcgcctgcgtcgcttcatctcccaggagctgcccagccagcgcgcctagcggcggccccaaccggccggacctcagcaataaggcggcccccggacctcaccccgcgccggcccccacccaggggctgcatgtggaccccccgggcggcccaggggaccccgccccgacccaggggctgtggacgatgtacaggcaacagagctacgcactcctttccttttggaagcaagaagaaaatacgtgaaaacggaaattaaagatttaaaattttagggctgctctccttcctttcatggctctgctcactctctcgagcgctcagcgagctcgaaagggggccggggttcccaggtttcgtccctgagtccctaggagagatcggcacggacccccttataggttttactctgcggaagtggggtgggtctctgtctagtc

SEQ ID NO: 103268 - DNA, 740 bp, Homo sapiens
  Payload ID: 137
  Gene Symbol: ABHD17A
  Gene Name: abhydrolase domain containing 17A
  ENST ID: ENST00000592757
  CDS Start-End: 1-119
cctacgactactccggctacggtgccagctcgggcaggccttccgagaggaacctctatgccgacatcgacgccgcctggcaggccctgcgcaccaggaacctaggcccagagctgtgagggggaggccagagcgtgcccagggcctccaccggggatgtgtcctgttcgtttgagtggtgacatccaggtggcagctcggggctcctgcctgtagcaggtggcagggctgggctggctcagcacactactgaccatggctgccagggagcaggccagggaggccgaggcagagctggagccacaggcaccagccaggcagcatcctttggggcatgggtacggcatcagcccggacagcatcatcctgtacgggcagagcatcggcacggtgcccaccgtggacctggcctcgcgctacgagtgtgccgcggtggtgctgcactcgccgctcacctcgggcatgcgcgtcgccttccccgacaccaagaagacctactgcttcgacgccttccctaacatcgagaaggtgtccaagatcacgtctcccgtgctcatcatccacggcacggaggacgaggtgatcgacttctcgcacgggctggcgctctacgagcgctgccccaaggcggtggagccgctgtgggtggagggcgccgggcacaacgacatcgagctctacagccagtacctggagcgcctgcgtcgcttcatctcccaggagctgcccagccagcgcgc

SEQ ID NO: 103269 - DNA, 1079 bp, Homo sapiens
  Payload ID: 137
  Gene Symbol: ABHD17A
  Gene Name: abhydrolase domain containing 17A
  ENST ID: ENST00000590661
  CDS Start-End: 20-697
ggcctgggcggcgcccgccatgaatgggctgtcgctgagtgagctctgctgcctcttctgctgcccgccctgccccggccgcatcgctgccaagctcgccttcctgccgccggaggccacctactccctggtgcctgagcccgagccggggcctggtggggccggggccgcccccttggggaccctgagagcctcctcgggcgcacccgggcgctggaagctgcacctgacggagcgtgccgacttccagtacagccagcgcgagctggacaccatcgaggtcttccccaccaagagcgcccgcggcaaccgcgtctcctgcatgtatgttcgctgcgtgcctggtgccagcttctacattggcctgggctcccgcctccactgcaacatcttctcctacgactactccggctacggtgccagctcgggcaggccttccgagaggaacctctatgccgacatcgacgccgcctggcaggccctgcgcaccagagcatcggcacggtgcccaccgtggacctggcctcgcgctacgagtgtgccgcggtggtgctgcactcgccgctcacctcgggcatgcgcgtcgccttccccgacaccaagaagacctactgcttcgacgccttccctaacatcgagaaggtgtccaagatcacgtctcccgtgctcatcatccacggcacggaggacgaggtgatcgacttctcgcacgggctggcgctctacgagcgctgccccaaggcggtggagccgctgtgggtggagggcgccgggcacaacgacatcgagctctacagccagtacctggagcgcctgcgtcgcttcatctcccaggagctgcccagccagcgcgcctagcggcggccccaaccggccggacctcagcaataaggcggcccccggacctcaccccgcgccggcccccacccaggggctgcatgtggaccccccgggcggcccaggggaccccgccccgacccaggggctgtggacgatgtacaggcaacagagctacgcactcctttccttttggaagcaagaagaaaatacgtgaaaacggaaattaaagatttaaaatt

SEQ ID NO: 103270 - DNA, 2614 bp, Homo sapiens
  Payload ID: 138
  Gene Symbol: ABHD17B
  Gene Name: abhydrolase domain containing 17B
  Uniprot ID: Q5VST6
  ENST ID: ENST00000333421
  CDS Start-End: 113-979
cggacggcgcccggagcgcggatctcgccttgtggaggacagcgcgtcggctgcggttctctctcgaccccttctgcccggcgcttcggcccgggccgctcaggtgcagagcatgaataatctttcatttagtgagctatgttgcctcttctgctgtccaccttgtccagggaagattgcttcaaaattagcgtttttgccacctgatccaacttacacactgatgtgtgatgaaagcggaagccgttggactttacatctgtctgaacgagcagactggcagtattcttctagagaaaaagatgctattgagtgtttcatgactagaaccagtaaaggcaacagaattgcttgtatgtttgtacgttgttcacccaatgcgaaatacactttactcttctcacatggaaatgctgttgatcttggtcaaatgagcagcttttacataggactaggatcacggattaattgtaatatattctcatatgattattctggatatggtgccagttccgggaaacccacagagaagaacctctatgcagacattgaagctgcttggcttgctcttaggacaagatatggcattcgccctgaaaatgtgattatatatggccaaagtatagggacagtaccgtctgtggatcttgctgctcgatatgagagtgctgctgttattcttcattctcctctgacttcgggaatgcgagttgcctttcctgataccaagaagacctactgttttgatgcattcccaaacattgacaaaatctctaagataacctctccagtattaataattcatgggactgaagatgaagtcattgacttttcacatggcctcgcattgtttgaacgttgccaaagacctgtggagcctctctgggttgaaggagcaggtcacaatgatgtggaactttatggacagtatcttgaaaggttgaaacagtttgtgtcacaggaactggtaaatttgtaaaatattctgtaaatttgctactgggttttcctttcttgctgaactgcactctttggtaaataacataaaacctgaaggttttgtttgcaaatcatgtcagttgccttcataaatgtacaggtaatgatttgttaacagacttaatgaaggttttaattaccagaactaaaaactggaaataacagtaccgtgcagtcaggctgtgtaatttatattttttctgtgaatttttttttaacatcaagatgagtactgtatgagattttaattctataaaatcaaatgctgtaaaagtattgccaaatgcttttgcatactagaaacaaatttataaatatttttaaaacatctcaatatattaaatcttatcctggaatacaactgtaatattttgaaaaaagctatgtatctaaagcaatttaagtactcataatggaatgaactgtaaaagagatttaaaaccatgcaagttcactagaattaacctaaaccctgttgtacagggatagaggtttaaagttattttattgtaaaatacattgaattttctgtatactctgattacatacatttatcctttaaaaaagatgtaaatcttaatttttatgccatctattaatttaccaatgagttaccttgtaaatgagaagtcatgatagcactgaattttaactagttttgacttctaagtttggtactgtgaggcaagtacttaaaattttcatgctggttacttaaaaggcatttagagatttcaagaatgattttgtatacgatgttttaaattttgactgatctcatagtcttcatagaattgcagtagtcttcattgtatgaaatcccgaaagtccatgagttgatcttaaagaccactaacagactggctatcagatcccttttcactttggctatttttttcattttttgagatggagtcttgctgtgtcactgaggctggagtgcagtggcgcgatcttgattcactgcaacctctgcctcccgggatcaagtgattctcctgcctcagcctcctgagtagctggtattacagatgcttgccaccacgcctggctaatttttgtatttttagtagagacagggttttgccatgttgatcaggctggtcttgaactcctgacctcatgatctgcccttggcctcccaaagtgtcggaattacaggcatgagccactgcgcctggcccactttagctatttttaaaaataggacctattgttttggattactatctgagaatttcatggattcactcctgggtataggagataagaatacgtttaattcataacttttatattaaccaatatagtaaaaaaataaagctcacacatacaaaaactaagttgcctttccttgaatgaaccctgtctgaataaaacaatgaaaaataaaaataaaattaatggtatgtagtctaatttgtaaatgaatgaatatggaaataatacacactgtggatatattttaaggccttatgtagttttaattgttctgctcgttccgtggttatgtttaagactatagtatatgactctcttcaaagtatatcaagtattgtgaatgctttggttcagatgtgtcaaattaacagtaaaacaacaaatataccactga

SEQ ID NO: 103271 - DNA, 1312 bp, Homo sapiens
  Payload ID: 138
  Gene Symbol: ABHD17B
  Gene Name: abhydrolase domain containing 17B
  Uniprot ID: Q5VST6
  ENST ID: ENST00000377041
  CDS Start-End: 302-1183
cagcgccccgcaccggggccgttagtcagcagaacgcgagctcttgtggaggagcagggccggcgcgaggcgagactcgggagcgtgagcggggcccctggggcgccgccgtccttcttcgccccggcgccgggggctgtagccctggtccccgctcctctgtcgggccagtctgcaggcggagagagtcggacggcgcccggagcgcggatctcgccttgtggaggacagcgcgtcggctgcggttctctctcgaccccttctgcccggcgcttcggcccgggccgctcaggtgcagagcatgaataatctttcatttagtgagctatgttgcctcttctgctgtccaccttgtccagggaagattgcttcaaaattagcgtttttgccacctgatccaacttacacactgatgtgtgatgaaagcggaagccgttggactttacatctgtctgaacgagcagactggcagtattcttctagagaaaaagatgctattgagtgtttcatgactagaaccagtaaaggcaacagaattgcttgtatgtttgtacgttgttcacccaatgcgaaatacactttactcttctcacatggaaatgctgttgatcttggtcaaatgagcagcttttacataggactaggatcacggattaattgtaatatattctcatatgattattctggatatggtgccagttccgggaaacccacagagaagaacctctatgcagacattgaagctgcttggcttgctcttaggacaagatatggcattcgccctgaaaatgtgattatatatggccaaagtatagggacagtaccgtctgtggatcttgctgctcgatatgagagtgctgctgttattcttcattctcctctgacttcgggaatgcgagttgcctttcctgataccaagaagacctactgttttgatgcattcccaaacattgacaaaatctctaagataacctctccagtattaataattcatgggactgaagatgaagtcattgacttttcacatggcctcgcattgtttgaacgttgccaaagacctgtggagcctctctgggttgaaggagcaggtcacaatgatgtggaactttatggacagtatcttgaaaggttgaaacagtttgtgtcacaggaactggtgcagaaacataaagaagggaagtgattttctcaaggtctacagttttcaatgacggtactatgtattccattatcttctctttaccaaacttaactggattaatataccaatgatcctttcaaattatatgacataaacttatttgctctccaa

SEQ ID NO: 103272 - DNA, 2368 bp, Homo sapiens
  Payload ID: 139
  Gene Symbol: ABHD17C
  Gene Name: abhydrolase domain containing 17C
  Uniprot ID: Q6PCB6
  ENST ID: ENST00000258884
  CDS Start-End: 128-1117
ggcgggcgggctgcagccgccctccgcgctcgcctgccagctccctcgccgcgcgtccgtcctccgtcctcccgggccagccagccagccagccagccgggccggcggcgggcaccaggccgtcccgatgcccgagccaggccccaggatgaacggcttctcgctgggtgagctgtgctggctcttctgctgcccgccctgcccgagccgcatcgccgccaagctggccttcctgccgcccgagcccacctacacggtgctggcgccggagcagcgcggcgccggcgcgtccgccccggccccggcccaggctaccgccgccgccgccgcggcccagccggcaccgcagcagcccgaggagggcgcgggcgcggggcccggtgcgtgcagcctgcacctcagcgagcgcgccgactggcagtactcgcagcgcgagctggacgccgtcgaggtcttcttctcgcgcacggcccgggacaaccggctcggctgcatgttcgtgcgctgcgcgccctccagccgctacacgctgctcttctcgcacggcaacgccgtggacctgggccagatgtgcagcttctacattggcctcggctcccgcatcaactgcaacatcttctcctacgactactcgggatacggcgtcagctcgggcaagccctccgagaagaacctctacgccgacatcgacgccgcgtggcaggcgctgcgcacccggtatggcgtgagtcccgagaacattatcctctatggtcagagcattgggactgtccccacggtagacttggcctcgaggtatgaatgcgcagcggtaattctccattcccctctgatgtctggtttgcgtgtggcttttccggataccaggaaaacatactgctttgatgctttccccagcattgacaagatatctaaagtcacctctcctgtgttggtcattcatggtacagaggatgaggtcatcgatttctcccatggcctagcgatgtacgagcgctgtccccgagccgtggagcccctttgggttgaaggggctgggcataatgacatagagctttatgcacaatacctagaaagactaaaacagttcatatctcacgaacttcctaattcctgaagacaacaacttgatcttacctcatttactgtgaacagaagagtcctctgttttgcacatgctttaactgggtagctgtaaaggcttgataaccatgaagaagtgcccaacctttagggtgttctaatcaaagagctgatgaaatctcagtcttttgtatctagaggtggttctgctaattcacacaacacgttaaactgaacagtcgtgattcccagcttcattaccttgcaggaatgggaatgagagctgaatgtagggacaattttctagtgctgtataaagtagcctcgcatctgtttctcaaccttatccatcatttctgacattcatgcaggacttgccctgttgccaccaatgttctcggtatttcacatgcagctctctttctgccactggatacatgggttcaatccatttgtgaagctgtgatagtgtaactggaaagctagtgtggtgaaaattcctttattattttttgttaacatgctgatctttcccggacaaatgaactgaagggtaatttactggaactctcgtgtacagcttcatcaactgtaaccatataaatataactggaatattcttaaacaaaaagaaactaggggtttttttaagtgtaaatttattactagccaacagagttttactattttgattgtctggttggtttaacaaagagcctagctgactttccttctgtaaagtcctccttgtaggcttttttaaagtactgtacatatttgcaatcacattgtgcatagattcttaatggtagatatgatttcttttgtcaggctacaacaatgaactgcagattccttgtttgtaatgtaaatgattgaatacattttgttaatatgtttttattcctatgttttgctattaaaaattttataacatttccaagacaaaaattccaagtttatgctttgaagaatttatgtaattaaaatttcactaaactaatctttttagtttaggaattatttgggttttgacactggaagttgcgccaaataagcatcagaaataggagatgcttaacattgctatactacttgtgttggttaggggtttggatttgggggttctttggttttaatttttttttccacatttaaaagccttaaatgtactgtaagcctcagatcgttgtacaactggactgcggttgattgccagtttgtgtactgttgcttggatgcggcacagtggttggtaatggaataaaggatgcatggatcagaa

SEQ ID NO: 103273 - DNA, 1976 bp, Homo sapiens
  Payload ID: 139
  Gene Symbol: ABHD17C
  Gene Name: abhydrolase domain containing 17C
  Uniprot ID: Q6PCB6
  ENST ID: ENST00000558464
  CDS Start-End: 120-1007
ggctgcagccgccctccgcgctcgcctgccagctccctcgccgcgcgtccgtcctccgtcctcccgggccagccagccagccagccagccgggccggcggcgggcaccaggccgtcccgatgcccgagccaggccccaggatgaacggcttctcgctgggtgagctgtgctggctcttctgctgcccgccctgcccgagccgcatcgccgccaagctggccttcctgccgcccgagcccacctacacggtgctggcgccggagcagcgcggcgccggcgcgtccgccccggccccggcccaggctaccgccgccgccgccgcggcccagccggcaccgcagcagcccgaggagggcgcgggcgcggggcccggtgcgtgcagcctgcacctcagcgagcgcgccgactggcagtactcgcagcgcgagctggacgccgtcgaggtcttcttctcgcgcacggcccgggacaaccggctcggctgcatgttcgtgcgctgcgcgccctccagccgctacacgctgctcttctcgcacggcaacgccgtggacctgggccagatgtgcagcttctacattggcctcggctcccgcatcaactgcaacatcttctcctacgactactcgggatacggcgtcagctcgggcaagccctccgagaagaacctctacgccgacatcgacgccgcgtggcaggcgctgcgcacccggtatggcgtgagtcccgagaacattatcctctatggtcagagcattgggactgtccccacggtagacttggcctcgagcattgacaagatatctaaagtcacctctcctgtgttggtcattcatggtacagaggatgaggtcatcgatttctcccatggcctagcgatgtacgagcgctgtccccgagccgtggagcccctttgggttgaaggggctgggcataatgacatagagctttatgcacaatacctagaaagactaaaacagttcatatctcacgaacttcctaattcctgaagacaacaacttgatcttacctcatttactgtgaacagaagagtcctctgttttgcacatgctttaactgggtagctgtaaaggcttgataaccatgaagaagtgcccaacctttagggtgttctaatcaaagagctgatgaaatctcagtcttttgtatctagaggtggttctgctaattcacacaacacgttaaactgaacagtcgtgattcccagcttcattaccttgcaggaatgggaatgagagctgaatgtagggacaattttctagtgctgtataaagtagcctcgcatctgtttctcaaccttatccatcatttctgacattcatgcaggacttgccctgttgccaccaatgttctcggtatttcacatgcagctctctttctgccactggatacatgggttcaatccatttgtgaagctgtgatagtgtaactggaaagctagtgtggtgaaaattcctttattattttttgttaacatgctgatctttcccggacaaatgaactgaagggtaatttactggaactctcgtgtacagcttcatcaactgtaaccatataaatataactggaatattcttaaacaaaaagaaactaggggtttttttaagtgtaaatttattactagccaacagagttttactattttgattgtctggttggtttaacaaagagcctagctgactttccttctgtaaagtcctccttgtaggcttttttaaagtactgtacatatttgcaatcacattgtgcatagattcttaatggtagatatgatttcttttgtcaggctacaacaatgaactgcagattccttgtttgtaatgtaaatgattgaatacattttgttaatatgtttttattcctatgttttgctattaaaaattttataacatttccaagacaaaaattccaagtttatgctttgaagaatttatgtaattaaaatttcactaaactaa

SEQ ID NO: 103274 - DNA, 627 bp, Homo sapiens
  Payload ID: 139
  Gene Symbol: ABHD17C
  Gene Name: abhydrolase domain containing 17C
  ENST ID: ENST00000560609
  CDS Start-End: 194-478
ttttactcagtccctgttcaagatggagctgctcccattcaaacacttctgacatgtttactactgcctggcacagaggtatggcgtgagtcccgagaacattatcctctatggtcagagcattgggactgtccccacggtagacttggcctcgaggtatgaatgcgcagcggtaattctccattcccctctgatgtctggtttgcgtgtggcttttccggataccaggaaaacatactgctttgatgctttccccagcattgacaagatatctaaagtcacctctcctgtgttggtcattcatggtacagaggatgaggtcatcgatttctcccatggcctagcgatgtacgagcgctgtccccgagccgtggagcccctttgggttgaaggggctgggcataatgacatagagctttatgcacaatacctagaaagactaaaacagttcatatctcacgaacttcctaattcctgaagacaacaacttgatcttacctcatttactgtgaacagaagagtcctctgttttgcacatgctttaactgggtagctgtaaaggcttgataaccatgaagaagtgcccaacctttagggtgttctaatcaaagagctgatgaaatctca

SEQ ID NO: 103275 - DNA, 5450 bp, Homo sapiens
  Payload ID: 140
  Gene Symbol: ABHD18
  Gene Name: abhydrolase domain containing 18
  ENST ID: ENST00000388795
  CDS Start-End: 404-1552
gccgcgccgccctgctccgggtttgtcttcctccctccgtttctccttccgctgtatctagcatttcggttcctggaaaggttaccggagctgcgattggggctgggaccaaagttgagtcctggaaagggagcctggagagcggcggtgctgggaggcccggccagctcgatcgcaggcttccacctggcggccaatgcttgtttgctactgatgggtgtgagcaagttagatattctataccggagacttctcctaacaaaactttttatcagaggatggggaaggccagaagatctcaaaagactctttgaattcagaaagatgattggaaatcgggaaagatgccagaatctggtttcaagcgattatccagtacacattgataaggattattgatgaaatgcttgataccaacttgattcttctacctttgttccaatttattgtgcctaaagaatggaacagcaaatatagacctgtatgcattcatcttgctggaacaggagatcatcattactggaggcgacgaacactaatggcccgtcctatgattaaagaagcccgaatggcttctttattgttagaaaacccttattatggctgcaggaaacccaaggaccaagtaaggtccagcttaaaaaatgtgtccgacctttttgtgatgggaggagctcttgttttagaatctgcagctctcttgcactggctagagagggaaggttacggccctttaggaatgactggaatatccatgggaggacacatggcttccttagcggtatccaactggcctaagcccatgccattgattccatgcctgtcttggtccacagcatctggggtcttcactacgggtgtgttgagtaaatcaattaattggagggagctggaaaagcaatattatacccagacagtttatgaagaagaaattattcacatgcttgaatactgtggaacagattctttcaaaatgggacaagagtttgtgaaacacttcactagcagtgcagacaagctaactaaccttaatctggtttccagaactttaaatttagatatatcaaaccaagttgtatcccaaaaacctgctgactgccataattctagcaaaacatctgtcagtgcgacatcagaaggactcttattgcaagatacctctaagatgaagcgcttcaatcaaacactttcaaccaacaaaagtggttatacaagtcgcaaccctcagtcataccacctacttagtaaagaacaaagcagaaacagtcttcggaaagagtctttaatatttatgaaaggagtcatggatgaatgtactcatgtagcaaatttctcagtcccagttgatccaagcctcattatagtggttcaagccaaagaagatgcctatattccacgaacaggagttcgaagtttacaagaaatttggcctggttgtgaaatccgatacttagaagggggtcatattagtgcttatctttttaaacaaggactcttcagacaagccatctatgatgcatttgaccgcttcctccataaatacgctaactagttggattattatatgtaaccagtgtggccatgatgtttcttacaaaagggagcttcatcctgtgatcatgtgaaggacaagcagacagcactaatatatctaatcgctatcaatttggtctggaattcattgttacacatcagttaactataaacttcgaatacatttgaataatttcaagataatatttgaagtaaataatgttaaagtgtttttactattgtttattggaatcccatatattcagtgtttagtctgttgttactgtttatgaaaaactaaatttttaatcatgaataatttattaaattaaataaatttattcatagaaacttttctgggttttagtaaaattgctaaatcaaaccaagattttaatatatcagcatttactttgtacccttataacatttcactcttgacttgatttgagaaacatgtttattttttgaatgttcttgtgttcaactaattttctgctgtggaaataaatacttatgatatataaaatcagtgttaactttgaattctaaaatatcctgatagcttcatagataagtgcttttctttttcttttttttttcttttaacatgtacctctacttgaatgtaagtgcttttaataatcaaagtgagtggcagggtgcggtggctcacgcctgtaatcccagcactgggatgctgaagcgggcagattacctgaggttgggagttcaagaccagcctgaccaatatagagaaaccccctctctactacaaatacaaaaaattagccaagcatggtggcgcatgcctataatcccagatactcaggaggcagaggcaggagaatcgcttgaacccgggaggcagaggttgcggtgatccgagatcacaccattgcactccagcctgggcaacaagagtgaaactccgtctcaaaataataataataaccaaaatgagtgttctgcagataaaatgcattagactttgctagactaaaactttactaaagattagggtttttaaaaaatgccaataggccgggtgcagtggctcatgcctgtaatcccagcactttgggacgctcaggcgggcggatcacaaggtcaggagtttaagaccagcctggccaacatggtgaaaccccatgtctactaaaagtacaaaaaaattagccgggcattgtggcgtgtgcctgtaatcccagctactcaggaggctgaggcaggagaattggttgaaccaaggaggcggaggttgcactgagctgagattgcgccactgcactccagcctgggcaacagagcaaaactccatctcaaaaaaaaaaaaaaaaaaaaaaaaaaattaagccgggcatggtggcaggcacctgtaatcccagctactcgggaggctgaggcaggagaattgcttgaacccgggaggcagaagttgcagtgagcggagatcgcaccactgcactccagcctaggagaaggagcaagactctgtctcaaaacaaaacaaaatgccaaacttatttctccctactaaaaagtttcaattcacaaaaatggaaacattggaagacctgttgcattaactgacggagtgcagtggcatgatcttggctcactgcgacctccgcctctcaggttcaagcggttctcctgcctccacctgagtagctgagattacaggtgcccgccaccatgcctggctaatttttgtatttttaatagacacgaggtttcaccatgttggccaagctggtctcgaattcctgacctcaagtgatatgcctgccttggcctcccaaagtgctgggattataggtttgagccaccacacccgacctgacattttatttttatttttttaattacatttttctatatgcttattctttggattgctaaccatctaactacccaaatacttaacagccttggcttttaatttcaaaatttaatagacacatatgcaattgatttgtcccatataaactttattttacagaaaatatttaaagttttatgtaatagctattaactctcttaaatggggtttatatggctcgatttggtgctttctttttatgttaaacttctctagctgtcagctaaaatgttaaaaaagtcgaaaatattttagggtattgtgtgaagttttacagtaggtatttttgagttttgtttgaaatctgtgttgtctgtgaattatttttaaatagggattcttagtctactaacgatatttgaattataatgtgcctttgcagtctttttaaaggagatttcatttgtcacctctatgcctctatcatcttaattttttacaaatatttaaaaattattaatgtgaagttattgatggtagacaaagtagtaacttctttcaaactactttggcataacaagccaacactgtacagctctttgagctataagcaattttacatgttcagatgagaacctttagttttaaccaaaagtataacatctactaaagttcttccacaaaatactttttaaaataaaacttgtcaactgaattacgattttcttatattatgtatatagtgaggttatatgattgaatgctttttgaacaatggttttagtaaaacaaatactttattattgttcacataaacatttcttactaagcaataatgtactatgttgtgtgaatttctattgttaaaaaaatgaaatgttgatttagttttaattcttaggcataactaacttttctcaaataaagtgtgaaagaaagtatttttaaaatttcatctcttaaccagatgttttaagaatatatccctaggccgggtgcagtggctcacacctgtaatcccagcactttgggaggccgaggtggggggaccacctgaggttgggagttcgagactagcctgaccaatatggagaaaccccatctctattaaaaatacaaaatttttaaaaaaaatacaaaattagccaggcgtggtggcacatgcctgtaatcccagctactcaggaggctgagccaggagaatcgcttgaacccgggagacggaggttgcagtaagccgagattgtgccattgcactccagcctgggcaacaagagcaaaactctgtctcaaaaaatatatatatatccctaaaactacctcagttgaagaattcaaagtgcaaaataacttttcttaggattttttaatctattccccccaaaatggtggcttaagtgttctcaaatacataaatatacacatatacgtatatgtatacgttttatatatatatacacacacacgtatgtgtgtatatatatgtatgtacgtatatatatgtattatatatacacacatatgcatatatatatatatatatatatatatatatatatatatataatctcaaagaagtgcggtctgccatttatctgccattttgaggatttaggtactacataaaatattagaaattcatttagaccagatctgtaaactggtagttcacataggccagtttgacccacagttattttattagatgtacataatgtttcaaaaatgtttgaatttgaaaagtcttttgattgggtgtgtgttccccagtttgccacagcctactggacttccctcttatatcagacaacttctctactttgtagttcctgctcagccctgaagacctctaagtttgagacccctgatttagatctgtaattagaaaaaggttctgaatttcatgatttgctaatgtaattactattaagtcattttagcatgtgcattttagagtccttctttgtatttttgtaatgtggtgctttctctcataaagataattgaattgttaacactgtaattgaaattttaaaaatcatttccaaatcttttattatatttcacagtaaaagtctatttaaaaagctaa

SEQ ID NO: 103276 - DNA, 2177 bp, Homo sapiens
  Payload ID: 140
  Gene Symbol: ABHD18
  Gene Name: abhydrolase domain containing 18
  Uniprot ID: Q0P651
  ENST ID: ENST00000398965
  CDS Start-End: 319-1563
agcgcagggcgaaaggaggctgtgtcctcagcctcctccctcggcacgcgcctcccatcctgacggggactgagagcccaggagagctcggggcgtgtccaaactgccgcgccgccctgctccgggtttgtcttcctccctccgtttctccttccgctgtatctagcatttcggttcctggaaaggttaccggagctgcgattggggctgggaccaaagttgagtcctggaaagggagcctggagagcggcggtgctgggaggcccggccagctcgatcgcaggcttccacctggcggccaatgcttgtttgctactgatgggtgtgagcaagttagatattctataccggagacttctcctaacaaaactttttatcagaggatggggaaggccagaagatctcaaaagactctttgaattcagaaagatgattggaaatcgggaaagatgccagaatctggtttcaagcgattatccagtacacattgataagattgaagagcaatcagattgtaagatcttagatggacactttgtttcccccatggctcactatgtgcctgatatcatgccaattgaatctgttattgcaaggttccaatttattgtgcctaaagaatggaacagcaaatatagacctgtatgcattcatcttgctggaacaggagatcatcattactggaggcgacgaacactaatggcccgtcctatgattaaagaagcccgaatggcttctttattgttagaaaacccttattatggctgcaggaaacccaaggaccaagtaaggtccagcttaaaaaatgtgtccgacctttttgtgatgggaggagctcttgttttagaatctgcagctctcttgcactggctagagagggaaggttacggccctttaggaatgactggaatatccatgggaggacacatggcttccttagcggtatccaactggcctaagcccatgccattgattccatgcctgtcttggtccacagcatctggggtcttcactacgacagattctttcaaaatgggacaagagtttgtgaaacacttcactagcagtgcagacaagctaactaaccttaatctggtttccagaactttaaatttagatatatcaaaccaagttgtatcccaaaaacctgctgactgccataattctagcaaaacatctgtcagtgcgacatcagaaggactcttattgcaagatacctctaagatgaagcgcttcaatcaaacactttcaaccaacaaaagtggttatacaagtcgcaaccctcagtcataccacctacttagtaaagaacaaagcagaaacagtcttcggaaagagtctttaatatttatgaaaggagtcatggatgaatgtactcatgtagcaaatttctcagtcccagttgatccaagcctcattatagtggttcaagccaaagaagatgcctatattccacgaacaggagttcgaagtttacaagaaatttggcctggttgtgaaatccgatacttagaagggggtcatattagtgcttatctttttaaacaaggactcttcaggtaagacggctggtctaaacatgtattcgttcatttgttgtttgttttctggattttttgcttcaacaaatgtaaaagatcacatatttttatagtctgtttcaatctttgaattccctcctcacctcccacaaatctcacagagttacttttccctctttcctagaatttgatcttcttattttcttctagagaactaagcatgatgcatattataggcatgctttatcgtgtggctttcccctcttcaaatattaatggccaggtattttaggatgtgagaaggaagatcatggcttgttaaagttgctttggtgcatcaagagttttttcactctattctgatgttttttcagaatggcctgaacatctgtggaataatttagcaatgtttttcagttagcaagtgaatattgaaccttaaataagaagtgcttttaatgtgaacaaccttatatgactccactattttagttagaacttataaaaacttttatgctggctgggcgcggtggcttacgcctgtaatcccagcactttgggaggcggaggcgggtgtatcacgaggtcaggagatcaaggccatcctggctaacacggtgaaaccccgtctctagt

SEQ ID NO: 103277 - DNA, 2129 bp, Homo sapiens
  Payload ID: 140
  Gene Symbol: ABHD18
  Gene Name: abhydrolase domain containing 18
  Uniprot ID: Q0P651
  ENST ID: ENST00000444616
  CDS Start-End: 248-1492
gagagcccaggagagctcggggcgtgtccaaactgccgcgccgccctgctccgggtttgtcttcctccctccgtttctccttccgctgtatctagcatttcggttcctggaaaggttaccggagctgcgattggggctgggaccaaagttgagtcctggaaagggagcctggagagcggcggtgctgggaggcccggccagctcgatcgcaggcttccacctggcggccaatgcttgtttgctactgatgggtgtgagcaagttagatattctataccggagacttctcctaacaaaactttttatcagaggatggggaaggccagaagatctcaaaagactctttgaattcagaaagatgattggaaatcgggaaagatgccagaatctggtttcaagcgattatccagtacacattgataagattgaagagcaatcagattgtaagatcttagatggacactttgtttcccccatggctcactatgtgcctgatatcatgccaattgaatctgttattgcaaggttccaatttattgtgcctaaagaatggaacagcaaatatagacctgtatgcattcatcttgctggaacaggagatcatcattactggaggcgacgaacactaatggcccgtcctatgattaaagaagcccgaatggcttctttattgttagaaaacccttattatggctgcaggaaacccaaggaccaagtaaggtccagcttaaaaaatgtgtccgacctttttgtgatgggaggagctcttgttttagaatctgcagctctcttgcactggctagagagggaaggttacggccctttaggaatgactggaatatccatgggaggacacatggcttccttagcggtatccaactggcctaagcccatgccattgattccatgcctgtcttggtccacagcatctggggtcttcactacgacagattctttcaaaatgggacaagagtttgtgaaacacttcactagcagtgcagacaagctaactaaccttaatctggtttccagaactttaaatttagatatatcaaaccaagttgtatcccaaaaacctgctgactgccataattctagcaaaacatctgtcagtgcgacatcagaaggactcttattgcaagatacctctaagatgaagcgcttcaatcaaacactttcaaccaacaaaagtggttatacaagtcgcaaccctcagtcataccacctacttagtaaagaacaaagcagaaacagtcttcggaaagagtctttaatatttatgaaaggagtcatggatgaatgtactcatgtagcaaatttctcagtcccagttgatccaagcctcattatagtggttcaagccaaagaagatgcctatattccacgaacaggagttcgaagtttacaagaaatttggcctggttgtgaaatccgatacttagaagggggtcatattagtgcttatctttttaaacaaggactcttcaggtaagacggctggtctaaacatgtattcgttcatttgttgtttgttttctggattttttgcttcaacaaatgtaaaagatcacatatttttatagtctgtttcaatctttgaattccctcctcacctcccacaaatctcacagagttacttttccctctttcctagaatttgatcttcttattttcttctagagaactaagcatgatgcatattataggcatgctttatcgtgtggctttcccctcttcaaatattaatggccaggtattttaggatgtgagaaggaagatcatggcttgttaaagttgctttggtgcatcaagagttttttcactctattctgatgttttttcagaatggcctgaacatctgtggaataatttagcaatgtttttcagttagcaagtgaatattgaaccttaaataagaagtgcttttaatgtgaacaaccttatatgactccactattttagttagaacttataaaaacttttatgctggctgggcgcggtggcttacgcctgtaatcccagcactttgggaggcggaggcgggtgtatcacgaggtcaggagatcaaggccatcctggctaacacggtgaaaccccgtctctagtaaaaatacaaaaaaaaaaaaaaa

SEQ ID NO: 103278 - DNA, 569 bp, Homo sapiens
  Payload ID: 140
  Gene Symbol: ABHD18
  Gene Name: abhydrolase domain containing 18
  ENST ID: ENST00000513371
  CDS Start-End: 254-569
tttcggttcctggaaaggttaccggagctgcgattggggctgggaccaaagttgagtcctggaaagggagcctggagagcggcggtgctgggaggcccggccagctcgatcgcaggcttccacctggcggccagtccccggatgcgcaccccaacggcgcctgcgcctacgggggcctcagccttgcaaaatgtcactcagcagagcctgctgctgaaacgtgggagttgaaaaagatgcttgtttgctactgatgggtgtgagcaagttagatattctataccggagacttctcctaacaaaactttttatcagaggatggggaaggccagaagatctcaaaagactctttgaattcagaaagatgattggaaatcgggaaagatgccagaatctggtttcaagcgattatccagtacacattgataagattgaagagcaatcagattgtaagatcttagatggacactttgtttcccccatggctcactatgtgcctgatatcatgccaattgaatctgttattgcaaggttccaatttattgtgcctaaagaatggaacagcaaat

SEQ ID NO: 103279 - DNA, 2139 bp, Homo sapiens
  Payload ID: 140
  Gene Symbol: ABHD18
  Gene Name: abhydrolase domain containing 18
  ENST ID: ENST00000473040
  CDS Start-End: 310-507
cgaaaggaggctgtgtcctcagcctcctccctcggcacgcgcctcccatcctgacggggactgagagcccaggagagctcggggcgtgtccaaactgccgcgccgccctgctccgggtttgtcttcctccctccgtttctccttccgctgtatctagcatttcggttcctggaaaggttaccggagctgcgattggggctgggaccaaagttgagtcctggaaagggagcctggagagcggcggtgctgggaggcccggccagctcgatcgcaggcttccacctggcggccaatgcttgtttgctactgatgggtgtgagcaagttagatattctataccggagacttctcctaacaaaactttttatcagaggatggggaaggccagaagatctcaaaagactctttgaattcagaaagatgattggaaatcgggaaagatgccagaatctggtttcaagcgattatccagtacacattgataaggttccaatttattgtgcctaaagaatggaacagcaaatatagacctgtatgcattcatcttgctggaacaggagatcatcattactggaggcgacgaacactaatggcccgtcctatgattaaagaagcccgaatggcttctttattgttagaaaacccttattatatccttttactattcacagaagaagaaatgaaactggtgcacagatataaagaaatgttcaacgttgctggtaataaatgtagagctagaaggtccagcttaaaaaatgtgtccgacctttttgtgatgggaggagctcttgttttagaatctgcagctctcttgcactggctagagagggaaggttacggccctttaggaatgactggaatatccatgggaggacacatggcttccttagcggtatccaactggcctaagcccatgccattgattccatgcctgtcttggtccacagcatctggggtcttcactacgggtgtgttgagtaaatcaattaattggagggagctggaaaagcaatattatacccagacagtttatgaagaagaaattattcacatgcttgaatactgtggaacagattctttcaaaatgggacaagagtttgtgaaacacttcactagcagtgcagacaagctaactaaccttaatctggtttccagaactttaaatttagatatatcaaaccaagttgtatcccaaaaacctgctgactgccataattctagcaaaacatctgtcagtgcgacatcagaaggactcttattgcaagatacctctaagatgaagcgcttcaatcaaacactttcaaccaacaaaagtggttatacaagtcgcaaccctcagtcataccacctacttagtaaagaacaaagcagaaacagtcttcggaaagagtctttaatatttatgaaaggagtcatggatgaatgtactcatgtagcaaatttctcagtcccagttgatccaagcctcattatagtggttcaagccaaagaagatgcctatattccacgaacaggagttcgaagtttacaagaaatttggcctggttgtgaaatccgatacttagaagggggtcatattagtgcttatctttttaaacaaggactcttcagacaagccatctatgatgcatttgaccgcttcctccataaatacgctaactagttggattattatatgtaaccagtgtggccatgatgtttcttacaaaagggagcttcatcctgtgatcatgtgaaggacaagcagacagcactaatatatctaatcgctatcaatttggtctggaattcattgttacacatcagttaactataaacttcgaatacatttgaataatttcaagataatatttgaagtaaataatgttaaagtgtttttactattgtttattggaatcccatatattcagtgtttagtctgttgttactgtttatgaaaaactaaatttttaatcatgaataatttattaaattaaataaatttattcatagaaacttttctgggttttagtaaaattgctaaatcaaaccaagattttaatatatcagcatttactttgtacccttataacatttcactcttgacttgatttgagaaacatgtttattttttgaatgttcttgtgttcaactaat

SEQ ID NO: 103280 - DNA, 1493 bp, Homo sapiens
  Payload ID: 140
  Gene Symbol: ABHD18
  Gene Name: abhydrolase domain containing 18
  Uniprot ID: Q0P651
  ENST ID: ENST00000611882
  CDS Start-End: 399-1364
attggggctgggaccaaagttgagtcctggaaagggagcctggagagcggcggtgctgggaggcccggccagctcgatcgcaggcttccacctggcggccaatgcttgtttgctactgatgggtgtgagcaagttagatattctataccggagacttctcctaacaaaactttttatcagaggatggggaaggccagaagatctcaaaagactctttgaattcagaaagatgattggaaatcgggaaagatgccagaatctggtttcaagcgattatccagtacacattgataaggttccaatttattgtgcctaaagaatggaacagcaaatatagacctgtatgcattcatcttgctggaacaggagatcatcattactggaggcgacgaacactaatggcccgtcctatgattaaagaagcccgaatggcttctttattgttagaaaacccttattatggctgcaggaaacccaaggaccaagtaaggtccagcttaaaaaatgtgtccgacctttttgtgatgggaggagctcttgttttagaatctgcagctctcttgcactggctagagagggaaggttacggccctttaggaatgactggaatatccatgggaggacacatggcttccttagcggtatccaactggcctaagcccatgccattgattccatgcctgtcttggtccacagcatctggggtcttcactacgggtgtgttgagtaaatcaattaattggagggagctggaaaagcaatattatacccagacagtttatgaagaagaaattattcacatgcttgaatactgtggaacagattctttcaaaatgggacaagagtttgtgaaacacttcactagcagtgcagacaagctaactaaccttaatctggtttccagaactttaaatttagatatatcaaaccaagttgtatcccaaaaacctgctgactgccataattctagcaaaacatctgtcagtgcgacatcagaaggactcttattgcaagatacctctaagatgaagcgcttcaatcaaacactttcaaccaacaaaagtggttatacaagtcgcaaccctcagtcataccacctacttagtaaagaacaaagcagaaacagtcttcggaaagagtctttaatatttatgaaaggagtcatggatgaatgtactcatgtagcaaatttctcagtcccagttgatccaagcctcattatagtggttcaagccaaagaagatgcctatattccacgaacaggagttcgaagtttacaagaaatttggcctggttgtgaaatccgatacttagaagggggtcatattagtgcttatctttttaaacaaggactcttcaggtaagacggctggtctaaacatgtattcgttcatttgttgtttgttttctggattttttgcttcaacaaatgtaaaagatcacatatttttatagtctgtttcaatctttgaattccctcctcacctcccaca

SEQ ID NO: 103281 - DNA, 8735 bp, Homo sapiens
  Payload ID: 141
  Gene Symbol: ABHD2
  Gene Name: abhydrolase domain containing 2
  Uniprot ID: P08910
  ENST ID: ENST00000352732
  CDS Start-End: 521-1798
agccctcctcccctttccccgcccactccgggctggccttatccagtagcgtctgggtccctggactaaagccgtcaaatgtaaccaattgctgaggagctctcccctaagaatcccgcctccactctgaggaacagcttcgctgatcaatggatcccctcctagacgcaatgagcgcgcggggcaagtggagaagcggctgaactgcccaatgaacaagcggtttccgtggttaggggcgtggcagaagcggtcgtcaggggcgtggcggcagttacttgggcggggccggtagcggcgggagctgcactggccaggggttccggctgtatatccatgagcgccgctggcagccggggagctgcaggaaccagactgggggcgagctgagcacctgtagtcaatcacacgcagcttttaggtttgtttgaataagagatctgacctgaccggcccaactgtacaactcttcaaggaaaattcgtatttgcagtgggaagaataagtaacattgatcaagatgaatgccatgctggagactcccgaactcccagccgtgtttgatggagtgaagctggctgcagtggctgctgtgctgtacgtgatcgtccggtgtttgaacctgaagagccccacagccccacctgacctctacttccaggactcggggctctcacgctttctgctcaagtcctgtcctcttctgaccaaagaatacattccaccgttgatctgggggaaaagtggacacatccagacagccttgtatgggaagatgggaagggtgaggtcgccacatccttatgggcaccggaagttcatcactatgtctgatggagccacttctacattcgacctcttcgagcccttggctgagcactgtgttggagatgatatcaccatggtcatctgccctggaattgccaatcacagcgagaagcaatacatccgcactttcgttgactacgcccagaaaaatggctatcggtgcgccgtgctgaaccacctgggtgccctgcccaacattgaattgacctcgccacgcatgttcacctatggctgcacgtgggaatttggagccatggtgaactacatcaagaagacatatcccctgacccagctggtcgtcgtgggcttcagcctgggtggtaacattgtgtgcaaatacttgggggagactcaggcaaaccaagagaaggtcctgtgctgcgtcagcgtgtgccaggggtacagtgcactgagggcccaggaaaccttcatgcaatgggatcagtgccggcggttctacaacttcctcatggctgacaacatgaagaagatcatcctctcgcacaggcaagctctttttggagaccatgttaagaaaccccagagcctggaagacacggacttgagccggctctacacagcaacatccctgatgcagattgatgacaatgtgatgaggaagtttcacggctataactccctgaaggaatactatgaggaagaaagttgcatgcggtacctgcacaggatttatgttcctctcatgctggttaatgcagctgacgatccgttggtgcatgaaagtcttctaaccattccaaaatctctttcagagaaacgagagaacgtcatgtttgtgctgcctctgcatgggggccacttgggcttctttgagggctctgtgctgttccccgagcccctgacatggatggataagctggtggtggagtacgccaacgccatttgccaatgggagcgtaacaagttgcagtgctctgacacggagcaggtggaggccgacctggagtgaggcctccggactctggcacgctccagcagccctcctctggaagctgcgtcccctcaccccctgtttcaggtctcccatctccctcagtgacctggatctgacctcacaccatcagcagggggcacccaccatgcacacctgtctcggagtaggcagctcttcctgggagctccaggctatttttgtgcttagttactggttttctccattgcattgttaggcatggtgacaagtgacagagttcttgccctctgtccagtttcagcatctggttgcttttaagccaagtacatctagtttccctattaaaaatgtgtctgaatagcgattttgctttgccaccaaaaggcttttccctgagaacagtgaaggatgtatgtcattttgtggtggttgtatgtgtccttacatagaccttaaaaagagctcacccttccaggccaatgctgaagacacagctccgcttgggagcctgagaacccaggcttcccaggccagagtgtggcttcttaaacggcaaaggaaattcctttgagtcacaagccaagttttcgccctgtctcctgagaccatttccctacgctttgctgctgctgagagttacgtgaggcacttgttaaaaattcagcctcccaggtccctcccctcggagaggctgattcactgggtctgggaaggagcctggggattttaatttttcacaagtgccccagatgattctcatcaccaagcaaattttggaaatgctgttcaacagcgcccttaaattggaaacatctttgcagctcgttttattgaaattcataatcaggggtgtcctctagctcccacggtctccagagcagcaaggccggctatggagctgccgtcgtgtgaccacagtgtgatgtctcagaagggctctgggtgggctgagcatctgggctgtgccctggctctgcttttcaccctggacaaagtcgctgtggacttcaatttcttcacctctaaaatgggggacttggaccaggtagattgctgagctcactaccaggttcaaagttcaatgacaaactcagtttactgaggtttgagagaacatccctccaggggagcctgggagctgctctcccagtctaagcatgtagatatcatcgtttgccttttgtgtgtgtgtgtcccttatttgataaaaagatgttttgagttgttttttttttaagcactcacttgtaattttagtttttaaacccaagtccctctaactttgcctttgataccaaacaattcaaaagttggatctgagtttggagaaagatatttccaacctaagtgggtattattttgaaaccagatttttaatttaatagcctatatttgtagtctgttggataggtgtttccaaagtgtgtcttctcaagtgaaaacgcaactctaggtttcaagtactccttttctccgatcctgtggtacttgaatatccaaaaaccctgcactttgaacaatcagctgttgctatctggaactaaacagaactatgagtaaaattgcctggatactttaaaaagatatttttcctccttcatctcctttgactccaggacagactggaatataagtagtgggtctgcatggatgtttcagggatcaaaggagccacctgggcgcctgagtgccaaccctcagggccacaggtgggtgtggtttgggcacgggtccaagtgactgtgacgggacccgtgggcatgggtccaggtctgtaacctgaagaagttgttttctgacaatcaccaaatcatccgaatgacatcaaaagcagcccttatctcagagactgagatttctgtggtctcaacttcgctttggtataatttctggcactcaccagcctctatcattatgactttccccccagtgtattatttctctaataggtttccttttcacgttcttttagcacagactggcactttaccctctcagtttggaagttagcccctctcctctgttacttttcccttcacccaactacagctgtgatctagaacattcatagtcatatttctgctactactaccttcatttatcaagactttttatgagaataggtaaaccaagcaataacttcctaggactgaatcaccaccccagaagagcgagaggctcctttcatatgcctgaggccacaccccttaacctgttctgacaaaatagtggctggcccatgtaccagctccattcagaaattcaggaagagaaaagacagccctgttgtcacacaaaccggtgtgggggagggtggagcctggtctgcacggcagtcctggtggcccctgtggaggacaggcagggctggcagcatagcctttgttgccacacaaccggaatttgctcccccaggactgtgggagccagtgtcccagctgaaatctttttagtgtgtggctctgaatggcactcacattccattttggctcacatgaaactaactgaagccctttgttcaagcttcaggctcttaggcatggaaatgagaatgtgactgtggctgtcttacaggaaaattcttgtttgtccctgaatgagagcacagaggcattgaattcacagagctgcaaacttgcctgataaatgagggagtggcagtttatagataggtcatcttttttccttcctccaggtgtccttgcctttcttcccaaagtcattcatttctgatgagtatatgaatccccctcttgctagtaaggttctatttgggctaaaacaaggctgaatttttaaagagtatttgaatatattttagaatcaaattgaggctataaattgcatcaatctggacaattccattgcaggaataatatgttaaaaaccaatggggagaagcacccacatctctcctgtagcactccgtgtctcataagcaatttgaagacacttacaagtaactgattccagtcaaattaggattaactgactcaaaaaatggtgtcaagtttctttaatgtttttatgttagaagtgagtttaacagacttgaagaaaactgttatcttttcctgctgtgagtttacacaaatgattccagagcagaatgaaagcagaaagctgttggttacaatattcttttaacctctctgcagcattttacacttactgggaaccttatgattcaccgtaagagtggaaatatacctgagttcgtgtcctaatggtctctaattcacattggatcgtgggcaaatcacctcacctctctgagcctgttccctcctcttagaccatctctaagaccacttcatctatttacacatcatttgcttgaacattgctgaacatctgcgtgaacttggcctctccagcccttgcaggtggaaacagctgtgtcaaggctcaaggctcacgctgaggggacttggagggagggggcttctgcattaagctttcctggtgaagacccttgatcttgtccaaagccctgtgtctttgactggcttctcttcagagtccccgttgtcatcgtaagacccttgctgtttggagggtggtcttgtgactgtggcagctgctggccgctggaatgaggagcctatctccatcctccagtgtgactcaggcagagcattgagaattcccagggcagaaatccttcctgctcaggctttcattctaaaactacagtcttcattaaagctgaactttctgggtagctgagcttatatgcccggcatctgaatgagagctctctttgtaactgtgtgacttgagatctagtttgccagctcctgggaaacaatacatgtgttcttgtttgtgtttgctcagcaagcagatgtctgagatgtaagaagcttttcttttcctgtggcattgattctgacttagagctgaagtaaaagatcactgaaacatcacgtcaagttgaagtcactcataggtctttgtcctttaggcaggacaggagagtcattaagaagcatttcactgtagcattctatcacaatatcatctggaattgttttctttgcccagaaagccttaacttgcctctagagaatccctggtattacaacgatattgcggcattagaattccaactcttctgctgtggaagtttgaagcgaagctgcagcaaaaccagagaatttcctcaagtggcctgtaggctccttgttatcttatgcccccacccctccctcaacaatatgagtgatccagaactggcccaaacacctcagctctggtccctttttgcccttcttggccttactctgttgttcaaagccactttggattgcttggatgcttcgaacagccatgaaaagtagcctgcctgtggcatttagaggccaagcaattgacagaaagggtttcttctacctctgttatctaagcagagggaagtaaacctctcaccgccccccacccctcactgcccccgattaccctagaattgctttcgccaaattgtagttgaagctaaggaaggggaatctggcccctgctgggagagggaactggaatgccacacaaggcaaggcctgcttccttccttcccctctgctgctgctgcctcggaacgctgcagcccaggcttcctcccacagtggcccttggaagcaggccgcagagtagacagctgctccttttggaagagtcagtcccctgtgttttctgaactgtttttcctagcatgtatgtgggtagagctttcatgcatctctagtaataataagctgaaattagttttttttttaattctccaatttaaaacttttaattaaaaagtaaattttaatgtcgaaaatgcaaacttggggagggcagaaagatcacacacaaggctgtcacttcatacttgcaggattgcacagcagccgggcagaggcgctcctcacttcccagatggggcggcgggcagcagagacgcacctcacttcctagacagtgcggcagccaggcacaggcacacctcacttcccagacagttgggcggccaggcaagcgctcctcacttcccagatggggcggctcccgggaagcggggctcctcacttcccagacagggtggccaggcagaggtgctcctcacttcccagaacaattctttatgaatttgataaaggactgaagtgcaactgaaagctgctagtgatgatctggtaatatacaatttgtccagtagccagtttgtttttattgtgttttctaaccataagagatcattaaaggcaaagcctgtatgacgctgtacacacacaaaaaaatggtcaccgcaggccatactaccaatgaaatggtaggtaaacaaatcttctggtcaagagaaaaaaaaaagaaatagcactctgcatgctttgctctacaagacgaatttccctagaaagaatccaatgaaggccgggcatagtggctcactcctgtaatcccagcactttggaggccgaggcgggtagatcacctgaggttaggagttcaagaccagcctggccaacatggtgaaaccccttctctactaaaaatgcaaaaattagctgggtgtggtggcgggcgcctgtaatcccagctactcgggaggctgaggtgggagaattgcttgaacccaggagacggaggttgcagtgagccgagatcacgcctctgcactccagcctgggcaacaagagtgagactccgtctccaaaaaaagaaaaggaatccagtgaaaatggctgcaattacaacaagaagtgaaggaagaagactggtgacatctctgaaggatgcagttgaggttgatccaggtttatccgaatatgctacctttctgagccttaaaccttcatctctcaggtgttgatttgcttctgatagcttcatcatttctccctgaagtcttttacactcttctgttagtttccttgtttcagtatcatgaagtgaagcactgtgtggttgtggcgtgggcccgtcttgcttagatgcattcagtgggacagctttgctgggttccatgtcattcaatttatcattttcattggggatctccatttggaatccattaattcatgaggttttgcctcattccacacagcttccatatctgaagtgtttagtggagcaaaaattgtaccataaacttgtgtttactcttttcattcggatcatagtcaaagggctgtagcattactgaaacagtcacagttgaccctgggtcaataattccactgttgggcctcacacagtaccggtgaggcacggtagtcttcactttgaaacacacttttctatccgatggatttcgcaatttaagatttgtagtgactacatctgtgaaggggcctttgaatttgaggtctatgggcgggtcgaggaccaggatctgctcgtgcttcgccgtggccccggaggcagacgccattggagagacagcgcagagcagggggcggcttgctcgctgggggcgggggacgatggcgagaggggagggggagcgagttcgcatctctccttttcctggttagactctgttcaaccacattcttatgttggcagatctgcttccagattgatttttagagcaccatcactttcacattcctgattctgattttgttttgttttgtttgggttttctgaaacttaaaatgctgccccgaaaatactatatttttgagtttgtgttctgaaagcctccgtgctgctggatctttggggggaaatacaggatccttcagcactgaggtgtttaagatttgcaactagcaatgcaattttttctaaatatggggatatttacctttattaagaaattatactaaacattgatgtccttgatcattttatgttctcatattacttttgattctactatgattgtgtggtggtgaacaaagatcattacaaacaaaaactgtaattttgttatatttgattcaatggaatttacctaaaaaataaagactaaaaatgtggtgtg

SEQ ID NO: 103282 - DNA, 8688 bp, Homo sapiens
  Payload ID: 141
  Gene Symbol: ABHD2
  Gene Name: abhydrolase domain containing 2
  Uniprot ID: P08910
  ENST ID: ENST00000355100
  CDS Start-End: 474-1751
tgtcaggagggcgtagtttgcaaaacatccctcccagtggtactgatgccttttcgcaggttctgtcctcttcatttgcaagccactgctttatccacgagggtgctccctacttatgccagtgaattaatttttggcacagatgaatccttcatatttatctggatttagctggtagcatttgtctcctaagacttggtcacagaggaatccatgtgaccttcaggccttctgctctaaactggcaggagatcctgtttctactcacagcgtccgagggtctggtggccgagccctgaggggcgctgttgctcccaggtggcagaattcagcatcagagagccacacagctgaaagagatggatggcttttaggtttgtttgaataagagatctgacctgaccggcccaactgtacaactcttcaaggaaaattcgtatttgcagtgggaagaataagtaacattgatcaagatgaatgccatgctggagactcccgaactcccagccgtgtttgatggagtgaagctggctgcagtggctgctgtgctgtacgtgatcgtccggtgtttgaacctgaagagccccacagccccacctgacctctacttccaggactcggggctctcacgctttctgctcaagtcctgtcctcttctgaccaaagaatacattccaccgttgatctgggggaaaagtggacacatccagacagccttgtatgggaagatgggaagggtgaggtcgccacatccttatgggcaccggaagttcatcactatgtctgatggagccacttctacattcgacctcttcgagcccttggctgagcactgtgttggagatgatatcaccatggtcatctgccctggaattgccaatcacagcgagaagcaatacatccgcactttcgttgactacgcccagaaaaatggctatcggtgcgccgtgctgaaccacctgggtgccctgcccaacattgaattgacctcgccacgcatgttcacctatggctgcacgtgggaatttggagccatggtgaactacatcaagaagacatatcccctgacccagctggtcgtcgtgggcttcagcctgggtggtaacattgtgtgcaaatacttgggggagactcaggcaaaccaagagaaggtcctgtgctgcgtcagcgtgtgccaggggtacagtgcactgagggcccaggaaaccttcatgcaatgggatcagtgccggcggttctacaacttcctcatggctgacaacatgaagaagatcatcctctcgcacaggcaagctctttttggagaccatgttaagaaaccccagagcctggaagacacggacttgagccggctctacacagcaacatccctgatgcagattgatgacaatgtgatgaggaagtttcacggctataactccctgaaggaatactatgaggaagaaagttgcatgcggtacctgcacaggatttatgttcctctcatgctggttaatgcagctgacgatccgttggtgcatgaaagtcttctaaccattccaaaatctctttcagagaaacgagagaacgtcatgtttgtgctgcctctgcatgggggccacttgggcttctttgagggctctgtgctgttccccgagcccctgacatggatggataagctggtggtggagtacgccaacgccatttgccaatgggagcgtaacaagttgcagtgctctgacacggagcaggtggaggccgacctggagtgaggcctccggactctggcacgctccagcagccctcctctggaagctgcgtcccctcaccccctgtttcaggtctcccatctccctcagtgacctggatctgacctcacaccatcagcagggggcacccaccatgcacacctgtctcggagtaggcagctcttcctgggagctccaggctatttttgtgcttagttactggttttctccattgcattgttaggcatggtgacaagtgacagagttcttgccctctgtccagtttcagcatctggttgcttttaagccaagtacatctagtttccctattaaaaatgtgtctgaatagcgattttgctttgccaccaaaaggcttttccctgagaacagtgaaggatgtatgtcattttgtggtggttgtatgtgtccttacatagaccttaaaaagagctcacccttccaggccaatgctgaagacacagctccgcttgggagcctgagaacccaggcttcccaggccagagtgtggcttcttaaacggcaaaggaaattcctttgagtcacaagccaagttttcgccctgtctcctgagaccatttccctacgctttgctgctgctgagagttacgtgaggcacttgttaaaaattcagcctcccaggtccctcccctcggagaggctgattcactgggtctgggaaggagcctggggattttaatttttcacaagtgccccagatgattctcatcaccaagcaaattttggaaatgctgttcaacagcgcccttaaattggaaacatctttgcagctcgttttattgaaattcataatcaggggtgtcctctagctcccacggtctccagagcagcaaggccggctatggagctgccgtcgtgtgaccacagtgtgatgtctcagaagggctctgggtgggctgagcatctgggctgtgccctggctctgcttttcaccctggacaaagtcgctgtggacttcaatttcttcacctctaaaatgggggacttggaccaggtagattgctgagctcactaccaggttcaaagttcaatgacaaactcagtttactgaggtttgagagaacatccctccaggggagcctgggagctgctctcccagtctaagcatgtagatatcatcgtttgccttttgtgtgtgtgtgtcccttatttgataaaaagatgttttgagttgttttttttttaagcactcacttgtaattttagtttttaaacccaagtccctctaactttgcctttgataccaaacaattcaaaagttggatctgagtttggagaaagatatttccaacctaagtgggtattattttgaaaccagatttttaatttaatagcctatatttgtagtctgttggataggtgtttccaaagtgtgtcttctcaagtgaaaacgcaactctaggtttcaagtactccttttctccgatcctgtggtacttgaatatccaaaaaccctgcactttgaacaatcagctgttgctatctggaactaaacagaactatgagtaaaattgcctggatactttaaaaagatatttttcctccttcatctcctttgactccaggacagactggaatataagtagtgggtctgcatggatgtttcagggatcaaaggagccacctgggcgcctgagtgccaaccctcagggccacaggtgggtgtggtttgggcacgggtccaagtgactgtgacgggacccgtgggcatgggtccaggtctgtaacctgaagaagttgttttctgacaatcaccaaatcatccgaatgacatcaaaagcagcccttatctcagagactgagatttctgtggtctcaacttcgctttggtataatttctggcactcaccagcctctatcattatgactttccccccagtgtattatttctctaataggtttccttttcacgttcttttagcacagactggcactttaccctctcagtttggaagttagcccctctcctctgttacttttcccttcacccaactacagctgtgatctagaacattcatagtcatatttctgctactactaccttcatttatcaagactttttatgagaataggtaaaccaagcaataacttcctaggactgaatcaccaccccagaagagcgagaggctcctttcatatgcctgaggccacaccccttaacctgttctgacaaaatagtggctggcccatgtaccagctccattcagaaattcaggaagagaaaagacagccctgttgtcacacaaaccggtgtgggggagggtggagcctggtctgcacggcagtcctggtggcccctgtggaggacaggcagggctggcagcatagcctttgttgccacacaaccggaatttgctcccccaggactgtgggagccagtgtcccagctgaaatctttttagtgtgtggctctgaatggcactcacattccattttggctcacatgaaactaactgaagccctttgttcaagcttcaggctcttaggcatggaaatgagaatgtgactgtggctgtcttacaggaaaattcttgtttgtccctgaatgagagcacagaggcattgaattcacagagctgcaaacttgcctgataaatgagggagtggcagtttatagataggtcatcttttttccttcctccaggtgtccttgcctttcttcccaaagtcattcatttctgatgagtatatgaatccccctcttgctagtaaggttctatttgggctaaaacaaggctgaatttttaaagagtatttgaatatattttagaatcaaattgaggctataaattgcatcaatctggacaattccattgcaggaataatatgttaaaaaccaatggggagaagcacccacatctctcctgtagcactccgtgtctcataagcaatttgaagacacttacaagtaactgattccagtcaaattaggattaactgactcaaaaaatggtgtcaagtttctttaatgtttttatgttagaagtgagtttaacagacttgaagaaaactgttatcttttcctgctgtgagtttacacaaatgattccagagcagaatgaaagcagaaagctgttggttacaatattcttttaacctctctgcagcattttacacttactgggaaccttatgattcaccgtaagagtggaaatatacctgagttcgtgtcctaatggtctctaattcacattggatcgtgggcaaatcacctcacctctctgagcctgttccctcctcttagaccatctctaagaccacttcatctatttacacatcatttgcttgaacattgctgaacatctgcgtgaacttggcctctccagcccttgcaggtggaaacagctgtgtcaaggctcaaggctcacgctgaggggacttggagggagggggcttctgcattaagctttcctggtgaagacccttgatcttgtccaaagccctgtgtctttgactggcttctcttcagagtccccgttgtcatcgtaagacccttgctgtttggagggtggtcttgtgactgtggcagctgctggccgctggaatgaggagcctatctccatcctccagtgtgactcaggcagagcattgagaattcccagggcagaaatccttcctgctcaggctttcattctaaaactacagtcttcattaaagctgaactttctgggtagctgagcttatatgcccggcatctgaatgagagctctctttgtaactgtgtgacttgagatctagtttgccagctcctgggaaacaatacatgtgttcttgtttgtgtttgctcagcaagcagatgtctgagatgtaagaagcttttcttttcctgtggcattgattctgacttagagctgaagtaaaagatcactgaaacatcacgtcaagttgaagtcactcataggtctttgtcctttaggcaggacaggagagtcattaagaagcatttcactgtagcattctatcacaatatcatctggaattgttttctttgcccagaaagccttaacttgcctctagagaatccctggtattacaacgatattgcggcattagaattccaactcttctgctgtggaagtttgaagcgaagctgcagcaaaaccagagaatttcctcaagtggcctgtaggctccttgttatcttatgcccccacccctccctcaacaatatgagtgatccagaactggcccaaacacctcagctctggtccctttttgcccttcttggccttactctgttgttcaaagccactttggattgcttggatgcttcgaacagccatgaaaagtagcctgcctgtggcatttagaggccaagcaattgacagaaagggtttcttctacctctgttatctaagcagagggaagtaaacctctcaccgccccccacccctcactgcccccgattaccctagaattgctttcgccaaattgtagttgaagctaaggaaggggaatctggcccctgctgggagagggaactggaatgccacacaaggcaaggcctgcttccttccttcccctctgctgctgctgcctcggaacgctgcagcccaggcttcctcccacagtggcccttggaagcaggccgcagagtagacagctgctccttttggaagagtcagtcccctgtgttttctgaactgtttttcctagcatgtatgtgggtagagctttcatgcatctctagtaataataagctgaaattagttttttttttaattctccaatttaaaacttttaattaaaaagtaaattttaatgtcgaaaatgcaaacttggggagggcagaaagatcacacacaaggctgtcacttcatacttgcaggattgcacagcagccgggcagaggcgctcctcacttcccagatggggcggcgggcagcagagacgcacctcacttcctagacagtgcggcagccaggcacaggcacacctcacttcccagacagttgggcggccaggcaagcgctcctcacttcccagatggggcggctcccgggaagcggggctcctcacttcccagacagggtggccaggcagaggtgctcctcacttcccagaacaattctttatgaatttgataaaggactgaagtgcaactgaaagctgctagtgatgatctggtaatatacaatttgtccagtagccagtttgtttttattgtgttttctaaccataagagatcattaaaggcaaagcctgtatgacgctgtacacacacaaaaaaatggtcaccgcaggccatactaccaatgaaatggtaggtaaacaaatcttctggtcaagagaaaaaaaaaagaaatagcactctgcatgctttgctctacaagacgaatttccctagaaagaatccaatgaaggccgggcatagtggctcactcctgtaatcccagcactttggaggccgaggcgggtagatcacctgaggttaggagttcaagaccagcctggccaacatggtgaaaccccttctctactaaaaatgcaaaaattagctgggtgtggtggcgggcgcctgtaatcccagctactcgggaggctgaggtgggagaattgcttgaacccaggagacggaggttgcagtgagccgagatcacgcctctgcactccagcctgggcaacaagagtgagactccgtctccaaaaaaagaaaaggaatccagtgaaaatggctgcaattacaacaagaagtgaaggaagaagactggtgacatctctgaaggatgcagttgaggttgatccaggtttatccgaatatgctacctttctgagccttaaaccttcatctctcaggtgttgatttgcttctgatagcttcatcatttctccctgaagtcttttacactcttctgttagtttccttgtttcagtatcatgaagtgaagcactgtgtggttgtggcgtgggcccgtcttgcttagatgcattcagtgggacagctttgctgggttccatgtcattcaatttatcattttcattggggatctccatttggaatccattaattcatgaggttttgcctcattccacacagcttccatatctgaagtgtttagtggagcaaaaattgtaccataaacttgtgtttactcttttcattcggatcatagtcaaagggctgtagcattactgaaacagtcacagttgaccctgggtcaataattccactgttgggcctcacacagtaccggtgaggcacggtagtcttcactttgaaacacacttttctatccgatggatttcgcaatttaagatttgtagtgactacatctgtgaaggggcctttgaatttgaggtctatgggcgggtcgaggaccaggatctgctcgtgcttcgccgtggccccggaggcagacgccattggagagacagcgcagagcagggggcggcttgctcgctgggggcgggggacgatggcgagaggggagggggagcgagttcgcatctctccttttcctggttagactctgttcaaccacattcttatgttggcagatctgcttccagattgatttttagagcaccatcactttcacattcctgattctgattttgttttgttttgtttgggttttctgaaacttaaaatgctgccccgaaaatactatatttttgagtttgtgttctgaaagcctccgtgctgctggatctttggggggaaatacaggatccttcagcactgaggtgtttaagatttgcaactagcaatgcaattttttctaaatatggggatatttacctttattaagaaattatactaaacattgatgtccttgatcattttatgttctcatattacttttgattctactatgattgtgtggtggtgaacaaagatcattacaaacaaaaactgtaattttgttatatttgattcaatggaatttacctaaaaaataaagactaaaaatgtggtgtg

SEQ ID NO: 103283 - DNA, 845 bp, Homo sapiens
  Payload ID: 141
  Gene Symbol: ABHD2
  Gene Name: abhydrolase domain containing 2
  ENST ID: ENST00000565066
  CDS Start-End: 476-845
acttgggcggggccggtagcggcgggagctgcactggccaggggttccggctgtatatccatgagcgccgctggcagccggggagctgcaggaaccagactgggggcgagctgagcacctgtagtcaatcacacgcaggcacagatgaatccttcatatttatctggatttagctggtagcatttgtctcctaagacttggtcacagaggaatccatgtgaccttcaggccttctgctctaaactggcaggagatcctgtttctactcacagcgtccgagggtctggtggccgagccctgaggggcgctgttgctcccaggtggcagaattcagcatcagagagccacacagctgaaagagatggatggcttttaggtttgtttgaataagagatctgacctgaccggcccaactgtacaactcttcaaggaaaattcgtatttgcagtgggaagaataagtaacattgatcaagatgaatgccatgctggagactcccgaactcccagccgtgtttgatggagtgaagctggctgcagtggctgctgtgctgtacgtgatcgtccggtgtttgaacctgaagagccccacagccccacctgacctctacttccaggactcggggctctcacgctttctgctcaagtcctgtcctcttctgaccaaagaatacattccaccgttgatctgggggaaaagtggacacatccagacagccttgtatgggaagatgggaagggtgaggtcgccacatccttatgggcaccggaagttcatcactatgtctgatggagccacttctacattcgacctcttcgagcccttggctgagcactgtgttggag

SEQ ID NO: 103284 - DNA, 557 bp, Homo sapiens
  Payload ID: 141
  Gene Symbol: ABHD2
  Gene Name: abhydrolase domain containing 2
  ENST ID: ENST00000569550
  CDS Start-End: 391-557
agttacttgggcggggccggtagcggcgggagctgcactggccaggggttccggctgtatatccatgagcgccgctggcagccggggagctgcaggaaccagactgggggcgagctgagcacctgtagtcaatcacacgcaggcacagatgaatccttcatatttatctggatttagctggtagcatttgtctcctaagacttggtcacagaggaatccatgtgaccttcaggccttctgctctaaactggcaggagatcctgtttctactcacagcgtccgagcttttaggtttgtttgaataagagatctgacctgaccggcccaactgtacaactcttcaaggaaaattcgtatttgcagtgggaagaataagtaacattgatcaagatgaatgccatgctggagactcccgaactcccagccgtgtttgatggagtgaagctggctgcagtggctgctgtgctgtacgtgatcgtccggtgtttgaacctgaagagccccacagccccacctgacctctacttccaggactcggggctctcacgctttctgct

SEQ ID NO: 103285 - DNA, 2347 bp, Homo sapiens
  Payload ID: 141
  Gene Symbol: ABHD2
  Gene Name: abhydrolase domain containing 2
  Uniprot ID: P08910
  ENST ID: ENST00000565973
  CDS Start-End: 742-2019
gggcggggccggtagcggcgggagctgcactggccaggggttccggctgtatatccatgagcgccgctggcagccggggagctgcaggaaccagactgggggcgagctgagcacctgtagtcaatcacacgcagaaataataatgatacttatgttagaagattgttttgagaagtgcatggagttactacatctgaagcatttagaacagtacctggcacaggaggttagagtgatgtctttcgtccctgtggggagtgaggtggaatgtcaggagggcgtagtttgcaaaacatccctcccagtggtactgatgccttttcgcaggttctgtcctcttcatttgcaagccactgctttatccacgagggtgctccctacttatgccagtgaattaatttttggcacagatgaatccttcatatttatctggatttagctggtagcatttgtctcctaagacttggtcacagaggaatccatgtgaccttcaggccttctgctctaaactggcaggagatcctgtttctactcacagcgtccgagggtctggtggccgagccctgaggggcgctgttgctcccaggtggcagaattcagcatcagagagccacacagctgaaagagatggatggcttttaggtttgtttgaataagagatctgacctgaccggcccaactgtacaactcttcaaggaaaattcgtatttgcagtgggaagaataagtaacattgatcaagatgaatgccatgctggagactcccgaactcccagccgtgtttgatggagtgaagctggctgcagtggctgctgtgctgtacgtgatcgtccggtgtttgaacctgaagagccccacagccccacctgacctctacttccaggactcggggctctcacgctttctgctcaagtcctgtcctcttctgaccaaagaatacattccaccgttgatctgggggaaaagtggacacatccagacagccttgtatgggaagatgggaagggtgaggtcgccacatccttatgggcaccggaagttcatcactatgtctgatggagccacttctacattcgacctcttcgagcccttggctgagcactgtgttggagatgatatcaccatggtcatctgccctggaattgccaatcacagcgagaagcaatacatccgcactttcgttgactacgcccagaaaaatggctatcggtgcgccgtgctgaaccacctgggtgccctgcccaacattgaattgacctcgccacgcatgttcacctatggctgcacgtgggaatttggagccatggtgaactacatcaagaagacatatcccctgacccagctggtcgtcgtgggcttcagcctgggtggtaacattgtgtgcaaatacttgggggagactcaggcaaaccaagagaaggtcctgtgctgcgtcagcgtgtgccaggggtacagtgcactgagggcccaggaaaccttcatgcaatgggatcagtgccggcggttctacaacttcctcatggctgacaacatgaagaagatcatcctctcgcacaggcaagctctttttggagaccatgttaagaaaccccagagcctggaagacacggacttgagccggctctacacagcaacatccctgatgcagattgatgacaatgtgatgaggaagtttcacggctataactccctgaaggaatactatgaggaagaaagttgcatgcggtacctgcacaggatttatgttcctctcatgctggttaatgcagctgacgatccgttggtgcatgaaagtcttctaaccattccaaaatctctttcagagaaacgagagaacgtcatgtttgtgctgcctctgcatgggggccacttgggcttctttgagggctctgtgctgttccccgagcccctgacatggatggataagctggtggtggagtacgccaacgccatttgccaatgggagcgtaacaagttgcagtgctctgacacggagcaggtggaggccgacctggagtgaggcctccggactctggcacgctccagcagccctcctctggaagctgcgtcccctcaccccctgtttcaggtctcccatctccctcagtgacctggatctgacctcacaccatcagcagggggcacccaccatgcacacctgtctcggagtaggcagctcttcctgggagctccaggctatttttgtgcttagttactggttttctccattgcattgttaggcatggtgacaagtgacagagttcttgccctctgtccagtttcagcatctggttgcttttaagccaagtacatctagtttccctattaaaaatgtgtctgaatagcga

SEQ ID NO: 103286 - DNA, 558 bp, Homo sapiens
  Payload ID: 141
  Gene Symbol: ABHD2
  Gene Name: abhydrolase domain containing 2
  ENST ID: ENST00000569411
  CDS Start-End: 165-558
aaagcagtttcaggctcatagaattttagaaatgggcctagtttcccagccggatgagcttttaggtttgtttgaataagagatctgacctgaccggcccaactgtacaactcttcaaggaaaattcgtatttgcagtgggaagaataagtaacattgatcaagatgaatgccatgctggagactcccgaactcccagccgtgtttgatggagtgaagctggctgcagtggctgctgtgctgtacgtgatcgtccggtgtttgaacctgaagagccccacagccccacctgacctctacttccaggactcggggctctcacgctttctgctcaagtcctgtcctcttctgaccaaagaatacattccaccgttgatctgggggaaaagtggacacatccagacagccttgtatgggaagatgggaagggtgaggtcgccacatccttatgggcaccggaagttcatcactatgtctgatggagccacttctacattcgacctcttcgagcccttggctgagcactgtgttggagatgatatcaccatggtcatctgcc

SEQ ID NO: 103287 - DNA, 2064 bp, Homo sapiens
  Payload ID: 142
  Gene Symbol: ABHD3
  Gene Name: abhydrolase domain containing 3
  Uniprot ID: Q8WU67
  ENST ID: ENST00000289119
  CDS Start-End: 141-1370
gtcggaagccgcgctccgccaggcaggagacactgtggtcgggagtaggcagcggcgccgcgtccgctctcgcccgctctcgcccgctcgccagccggctctcctcccgccgcaggacccgcgcgccgcgctcgggggccatgcagcgcctggccatggacctgcggatgttgtcccgggagctctccctctacctggaacaccaagtccgggtggggttcttcggctcgggggtgggcttatcccttatcctgggcttcagcgtcgcttatgccttctactacctgagcagcattgccaagaaaccccagttagtgaccgggggtgagagtttcagccgcttccttcaagaccactgtcccgtggttacagaaacgtactacccgacggtctggtgctgggagggtcgaggacagaccctgcttagacctttcatcacttcgaagcccccggtgcagtacaggaatgaacttattaaaactgcagatggaggacagatttcactggactggtttgataatgataacagtacgtgttatatggatgccagcaccagacctactatcttattgttgcctggcctcacgggaacaagcaaggagtcatatatccttcatatgatccatcttagtgaagaattaggatacagatgtgtggtttttaacaacagaggagtggcgggggagaatctcttgacgccaaggacttattgttgtgctaacactgaagacttggagacagttattcaccatgtacacagcctgtacccttctgctcctttcctggcagcaggggtttcaatgggaggaatgctgcttctaaattacttgggcaaaattgggtccaaaacgcctttgatggcagctgcaactttttccgttggttggaacaccttcgcttgctcagagtcattggaaaaaccactgaactggctactttttaattactatttgacaacctgccttcagtcttcagttaataagcaccgacatatgtttgtaaaacaagttgatatggatcatgtcatgaaggctaaatccatcagagagtttgataagcgattcacttcagtcatgtttggataccaaacaattgatgattattatactgatgccagtccgagtcctagactgaagtcagtaggaattccagtattgtgtctaaattctgtggatgatgttttctcacccagtcatgctattccaatagaaactgctaagcaaaatcctaatgttgctttggtccttacttcttatggaggccatattggttttctggagggaatctggccaagacagtccacttacatggatcgtgtcttcaagcaatttgtgcaagccatggttgagcatggacatgaactctcttaacatgtagttctttgggtgcattttgtctgaaccacaattgtgaaggcagctcagcttagtgcacaaattttaactgttgtatataaagcaaataagccagcagatgggtgaagaggtccagaatgatatgcaaaaactactttttagagaaacaaaacaactttgtagcaacaaattaaatatagtattagattgttacttacgtagattttatttttactatgccttaccaagtacatccttaaacaaagtagtatgtacatgaaattgcacttaaccaaaactattgtgtaaaacaaattttaattcctcagggttttaatttaaactagtatttttttagattatttgttttaggtgatttaatggtactttaataactactaagaaatattggctatttcaatgtaagttataaggtggtacattcctaagggtatttatagttgatgataacatgaaaactgaaataagataaaatacaacgtgctaaatcttttatgtattctaactttaaaagacaagtgcaacaaagttagactgacttctatatgtgctcttttactctgataatattaaattaggactaacttatgttttataatgattataatttacatgcttatttttaaaatagtatatgtggacacatatatatcattatattaaaataaattctaccattttaaattgg

SEQ ID NO: 103288 - DNA, 2080 bp, Homo sapiens
  Payload ID: 142
  Gene Symbol: ABHD3
  Gene Name: abhydrolase domain containing 3
  ENST ID: ENST00000578270
  CDS Start-End: 942-1586
aagtctttgccggtttctggtttacggttggcagaaactttgctctgggcccttctctgatactgcttttcccttcagaaaccccagttagtgaccgggggtgagagtttcagccgcttccttcaagaccactgtcccgtggttacagaaacgtactacccgacggtctggtgctgggagggtcgaggacagaccctgcttagacctttcatcacttcgaagcccccggtgcagtacaggaatgaacttattaaaactgcagatggaggacagatttcactggactggtttgataatgataacagtacgtgttatatggatgccagcaccagacctactatcttattgttgcctggcctcacgggaacaagcaaggagtcatatatccttcatatgatccatcttagtgaagaattaggatacagatgtgtggtttttaacaacagaggagtggcgggggagaatctcttgacgccaaggacttattgttgtgctaacactgaagacttggagacagttattcaccatgtacacagcctgtacccttctgctcctttcctggcagcaggggtttcaatgggagggtaaggttttccctttctaaaataatctctgagagggaagctattttattggctgtctctttgagaggactataagctagctgtatggacactttttaaataaatgtctgattatgtttatcatattttattaaatgcggttgattgaatgaacgaaggaaggaaagaattaattcaggtgaattttaatatttttcttaactacgggtctctgtgactgcggattttgtgagcctgaaggtttgtctgaagcccatgaagtcgattgcatcactcaccggctgccatgttgaccttctgattcctgacgcactcccagccatccctggagctgcgttctgaagctgaacttgtagcatgactttcatcactccagttacagaaataatcacttattgctctctccagctgcagtggccttcaaaattatttttccccagaatgctgcttctaaattacttgggcaaaattgggtccaaaacgcctttgatggcagctgcaactttttccgttggttggaacaccttcgcttgctcagagtcattggaaaaaccactgaactggctactttttaattactatttgacaacctgccttcagtcttcagttaataagcaccgacatatgtttgtaaaacaagttgatatggatcatgtcatgaaggctaaatccatcagagagtttgataagcgattcacttcagtcatgtttggataccaaacaattgatgattattatactgatgccagtccgagtcctagactgaagtcagtaggaattccagtattgtgtctaaattctgtggatgatgttttctcacccagtcatgctattccaatagaaactgctaagcaaaatcctaatgttgctttggtccttacttcttatggaggccatattggttttctggagggaatctggccaagacagtccacttacatggatcgtgtcttcaagcaatttgtgcaagccatggttgagcatggacatgaactctcttaacatgtagttctttgggtgcattttgtctgaaccacaattgtgaaggcagctcagcttagtgcacaaattttaactgttgtatataaagcaaataagccagcagatgggtgaagaggtccagaatgatatgcaaaaactactttttagagaaacaaaacaactttgtagcaacaaattaaatatagtattagattgttacttacgtagattttatttttactatgccttaccaagtacatccttaaacaaagtagtatgtacatgaaattgcacttaaccaaaactattgtgtaaaacaaattttaattcctcagggttttaatttaaactagtatttttttagattatttgttttaggtgatttaatggtactttaataactactaagaaatattggctatttcaatgtaagttataaggtggtacattcctaagggtatttatagttgatgataacatgaaaactgaaataagataaaatacaacgtgctaaa

SEQ ID NO: 103289 - DNA, 1836 bp, Homo sapiens
  Payload ID: 142
  Gene Symbol: ABHD3
  Gene Name: abhydrolase domain containing 3
  ENST ID: ENST00000580981
  CDS Start-End: 103-1173
tcgggagtaggcagcggcgccgcgtccgctctcgcccgctctcgcccgctcgccagccggctctcctcccgccgcaggacccgcgcgccgcgctcgggggccatgcagcgcctggccatggacctgcggatgttgtcccgggagctctccctctacctggaacaccaagtccgggtggggttcttcggctcgggggtgggcttatcccttatcctgggcttcagcgtcgcttatgccttctactacctgagcagcattgccaagaaaccccagttagtgaccgggggtgagagtttcagccgcttccttcaagaccactgtcccgtggttacagaaacgtactacccgacggtctggtgctgggagggtcgaggacagaccctgcttagacctttcatcacttcgaagcccccggtgcagtacaggaatgaacttattaaaactgcagatggaggacagatttcactggactggtttgataatgataacagtacgtgttatatggatgccagcaccagacctactatcttattgttgcctggcctcacgggaacaagcaaggagtcatatatccttcatatgatccatcttagtgaagaattaggatacagaatgctgcttctaaattacttgggcaaaattgggtccaaaacgcctttgatggcagctgcaactttttccgttggttggaacaccttcgcttgctcagagtcattggaaaaaccactgaactggctactttttaattactatttgacaacctgccttcagtcttcagttaataagcaccgacatatgtttgtaaaacaagttgatatggatcatgtcatgaaggctaaatccatcagagagtttgataagcgattcacttcagtcatgtttggataccaaacaattgatgattattatactgatgccagtccgagtcctagactgaagtcagtaggaattccagtattgtgtctaaattctgtggatgatgttttctcacccagtcatgctattccaatagaaactgctaagcaaaatcctaatgttgctttggtccttacttcttatggaggccatattggttttctggagggaatctggccaagacagtccacttacatggatcgtgtcttcaagcaatttgtgcaagccatggttgagcatggacatgaactctcttaacatgtagttctttgggtgcattttgtctgaaccacaattgtgaaggcagctcagcttagtgcacaaattttaactgttgtatataaagcaaataagccagcagatgggtgaagaggtccagaatgatatgcaaaaactactttttagagaaacaaaacaactttgtagcaacaaattaaatatagtattagattgttacttacgtagattttatttttactatgccttaccaagtacatccttaaacaaagtagtatgtacatgaaattgcacttaaccaaaactattgtgtaaaacaaattttaattcctcagggttttaatttaaactagtatttttttagattatttgttttaggtgatttaatggtactttaataactactaagaaatattggctatttcaatgtaagttataaggtggtacattcctaagggtatttatagttgatgataacatgaaaactgaaataagataaaatacaacgtgctaaatcttttatgtattctaactttaaaagacaagtgcaacaaagttagactgacttctatatgtgctcttttactctgataatattaaattaggactaacttatgttttataatgattataatttacatgcttatttttaaaatagtatatgtggacacatatatatcatta

SEQ ID NO: 103290 - DNA, 1311 bp, Homo sapiens
  Payload ID: 142
  Gene Symbol: ABHD3
  Gene Name: abhydrolase domain containing 3
  Uniprot ID: Q8WU67
  ENST ID: ENST00000577891
  CDS Start-End: 110-520
actgtggtcgggagtaggcagcggcgccgcgtccgctctcgcccgctctcgcccgctcgccagccggctctcctcccgccgcaggacccgcgcgccgcgctcgggggccatgcagcgcctggccatggacctgcggatgttgtcccgggagctctccctctacctggaacaccaagtccgggtggggttcttcggctcgggggtgggcttatcccttatcctgggcttcagcgtcgcttatgccttctactacctgagcagcattgccaagaaacgtactacccgacggtctggtgctgggagggtcgaggacagaccctgcttagacctttcatcacttcgaagcccccggtgcagtacaggaatgaacttattaaaactgcagatggaggacagatttcactggactggtttgataatgataacagtacgtgttatatggatgccagcaccagacctactatcttattgttgcctggcctcacgggaacaagcaaggagtcatatatccttcatatgatccatcttagtgaagaattaggatacagatgtgtggtttttaacaacagaggagtggcgggggagaatctcttgacgccaaggacttattgttgtgctaacactgaagacttggagacagttattcaccatgtacacagcctgtacccttctgctcctttcctggcagcaggggtttcaatgggagggtaaggttttccctttctaaaataatctctgagagggaagctattttattggctgtctctttgagaggactataagctagctgtatggacactttttaaataaatgtctgattatgtttatcatattttattaaatgcggttgattgaatgaacgaaggaaggaaagaattaattcaggtgaattttaatatttttcttaactacgggtctctgtgactgcggattttgtgagcctgaaggtttgtctgaagcccatgaagtcgattgcatcactcaccggctgccatgttgaccttctgattcctgacgcactcccagccatccctggagctgcgttctgaagctgaacttgtagcatgactttcatcactccagttacagaaataatcacttattgctctctccagctgcagtggccttcaaaattatttttccccagaatgctgcttctaaattacttgggcaaaattgggtccaaaacgcctttgatggcagctgcaactttttccgttggttggaacaccttcgcttgctcagagtcattggaaaaaccactgaactggctactttttaattactatttgacaacctgccttcagtctt

SEQ ID NO: 103291 - DNA, 440 bp, Homo sapiens
  Payload ID: 142
  Gene Symbol: ABHD3
  Gene Name: abhydrolase domain containing 3
  ENST ID: ENST00000584464
  CDS Start-End: 1-337
cgtggttacagaaacgtactacccgacggtctggtgctgggagggtcgaggacagaccctgcttagacctttcatcacttcgaagcccccggtgcagtacaggaatgaacttattaaaactgcagatggaggacagatttcactggactggtttgataatgataacagtacgtgttatatggatgccagcaccagacctactatcttattgttgcctggcctcacgggaacaagcaaggagtcatatatccttcatatgatccatcttagtgaagaattaggatacagatgtgtggtttttaacaacagaggagtggcgggggagaatctcttgtgacttaggcactggaggaaatgaagatcaacacgatttcgaaagcaaaagttgcagagtgttatggtcttactcaagtgccttgtaataaatagcttgacgtgaa

SEQ ID NO: 103292 - DNA, 291 bp, Homo sapiens
  Payload ID: 142
  Gene Symbol: ABHD3
  Gene Name: abhydrolase domain containing 3
  ENST ID: ENST00000580477
  CDS Start-End: 1-113
attatactgatgccagtccgagtcctagactgaagtcagtaggaattccagtattgtgtctaaattctgtggatgatgttttctcacccagtcatggtaatcttagaagctgaaacttacagccttgaccacaatttagaaaatgaaactctgaactttaatatcagttgacttacatggtgattgttttagcatattttcattggattaaggaagtccagtatttctctacccgtttttatatttcactgccctttttaccaataaaaagttcccaacattttaacctta

SEQ ID NO: 103293 - DNA, 716 bp, Homo sapiens
  Payload ID: 143
  Gene Symbol: ABHD4
  Gene Name: abhydrolase domain containing 4
  ENST ID: ENST00000216327
  CDS Start-End: 8-457
gtttactatggccgatgatctggagcagcagtctcaaggctggctgagtagctggctgcccacgtggcgccccacttccatgtctcagctgaagaatgtggaagccaggatcctccagtgcttcgggcgaagctcaaggccagcattcccaagggacccggagggggctgaggatgagtttgtgacatcgatagagacatggcgggagaccatggggatccccagcatgatcctcctggggcacagtttgggaggattcctggccacttcttactcaatcaagtaccctgatagagttaaacacctcatcctggtggacccatggggctttcccctccgaccaactaaccccagtgagatccgtgcacccccagcctgggtcaaagccgtggcatctgtcctaggacgttccaatccattggctgttcttcgagtagctgggccctggggtgagtagcctgaatacaaaggtgactaagattctgcctcagtctctgaagagaccaacaagttgacatattctgctgtgaagtttattgctgttttgcttttgacagtggtgagacagcattcaaagccatgatggagtcctttggctgggcccggcgccctatgctggagcgaattcacttgattcgaaaagatgtgcctatcactatgatctacgggtccgacacctggatagataccagtacgggaaaaaaggtgaagatgca

SEQ ID NO: 103294 - DNA, 1003 bp, Homo sapiens
  Payload ID: 143
  Gene Symbol: ABHD4
  Gene Name: abhydrolase domain containing 4
  Uniprot ID: Q8TB40
  ENST ID: ENST00000418446
  CDS Start-End: 4-549
actatggccgatgatctggagcagcagtctcaaggctggctgagtagctggctgcccacgtggcgccccacttccatgtctcagctgaagaatgtggaagccaggatcctccagtgtctccagaataagttcctggccagatatgtatccctcccaaaccagaataagatctggacggtgactgtgagccccgagcaaaacgaccgcacccccttggtgatggtgcatggttttgggggcggcgtgggtctctggatcctcaacatggactcactgagtgcccgccgcacactgcacaccttcgatctgcttggcttcgggcgaagctcaaggccagcattcccaagggacccggagggggctgaggatgagtttgtgacatcgatagagacatggcgggagaccatggggatccccagcatgatcctcctggggcacagtttgggaggattcctggccacttcttactcaatcaagtaccctgatagggcctggtctggtgcagcgattccggccggacttcaaacgcaagtttgcagacttctttgaagatgataccatatcagagtatatttaccactgcaacgcacagaatcccagtggtgagacagcattcaaagccatgatggagtcctttggctgggcccggcgccctatgctggagcgaattcacttgattcgaaaagatgtgcctatcactatgatctacgggtccgacacctggatagataccagtacgggaaaaaaggtgaagatgcagcggccggattcctatgtccgagacatggagattaagggtgcctcccaccatgtctatgctgaccagccacacatcttcaatgctgtggtggaggagatctgcgactcagttgattgagctgctctctgaagaggaagaggagaaagccagagagtcactcttacctccctgtctgcttactcacccactctgtcctttcctcaccaactaacatgtgccagccaggcagagtcttgtgctgtt

SEQ ID NO: 103295 - DNA, 3366 bp, Homo sapiens
  Payload ID: 143
  Gene Symbol: ABHD4
  Gene Name: abhydrolase domain containing 4
  Uniprot ID: Q8TB40
  ENST ID: ENST00000428304
  CDS Start-End: 71-1099
ctcccgggtcagctggtgctggcgtcaggcgctgggcgggctcgccaggacctggcaaggcttgtttactatggccgatgatctggagcagcagtctcaaggctggctgagtagctggctgcccacgtggcgccccacttccatgtctcagctgaagaatgtggaagccaggatcctccagtgtctccagaataagttcctggccagatatgtatccctcccaaaccagaataagatctggacggtgactgtgagccccgagcaaaacgaccgcacccccttggtgatggtgcatggttttgggggcggcgtgggtctctggatcctcaacatggactcactgagtgcccgccgcacactgcacaccttcgatctgcttggcttcgggcgaagctcaaggccagcattcccaagggacccggagggggctgaggatgagtttgtgacatcgatagagacatggcgggagaccatggggatccccagcatgatcctcctggggcacagtttgggaggattcctggccacttcttactcaatcaagtaccctgatagagttaaacacctcatcctggtggacccatggggctttcccctccgaccaactaaccccagtgagatccgtgcacccccagcctgggtcaaagccgtggcatctgtcctaggacgttccaatccattggctgttcttcgagtagctgggccctgggggcctggtctggtgcagcgattccggccggacttcaaacgcaagtttgcagacttctttgaagatgataccatatcagagtatatttaccactgcaacgcacagaatcccagtggtgagacagcattcaaagccatgatggagtcctttggctgggcccggcgccctatgctggagcgaattcacttgattcgaaaagatgtgcctatcactatgatctacgggtccgacacctggatagataccagtacgggaaaaaaggtgaagatgcagcggccggattcctatgtccgagacatggagattaagggtgcctcccaccatgtctatgctgaccagccacacatcttcaatgctgtggtggaggagatctgcgactcagttgattgagctgctctctgaagaggaagaggagaaagccagagagtcactcttacctccctgtctgcttactcacccactctgtcctttcctcaccaactaacatgtgccagccaggcagagtcttgtgctgttcccagaacaggacgacagtgaaaagaacactcttgaccctacactgaaggctgaaggcagaagccacaagaggccttgagtgccacccccagggaagaacataaagggttgcacaatgccacccatccactccttgccaagtgttacccagatggtggaggatgtgaagggattgcaccaagccacattcactctctctgtggcctttcttcctctgggcaaagaagggcttccagtggcctttcctcactctgtagtgtttgtggggataggttccatgcaagaacaccttcctcctccatcccccacttcaccccatcccataccagttccatccagggtctgcttaactgccaagagcaggtcctggagttcccttcacctgcagagtccttttcatgacctaggaggtcttattcaaagccctcattgacagaggaggaaacaggccaaggcaggacatggctggaccatggtgatacagctctgtgtgattcaagttctggcagagcttgtaaggctagagcccaggtctgccgacaccctgtgcttgttgcacacttgatttgctaaggctggagacaggcaccattgccatggggctggtcctagtcactggccgaggataagcccgtccctgtcccacattctagccccactatgcgggggtgctgttgtcctgcctgtgtctcatccccggctgcctaagctagggacactcaagtgcttccttccttgccccatcttcctcccaactggaggcctctgagcctcccctgtgccttgggccctgaagccccatatgtagtatagagcaaaggtggctcctggtgaagagagggtggaaaggcccttcagccccagggccatgtctgggttctccatgcccatcagtctctgcagtttctctacctgcccccagagctgaggccatctgcaagcccctgcccatggcccaatggggagcctccagccacaagttccctgtccttatcagccactgggtggttcccactgcatgaccctctatccctgccatctgtccccatggtttccagctcaatccacccctgacccatctgtcagctttttcccagggagccgtttcaggggttctgggcagtaggctgggcctggcctcagaacctggtggctcctgcctgctccttcacttttgtaaaaccatccccttcaccagaatggtattaactcctggtgctttgtactactggtccagctgccctgggctccttttctatattaataaagaaacgagtaaaaattaccggtggggatgatgtttaaaattgctctgatcactggtggtgctgaattcgcaacagcctgtgtgatgcctgagagaagggagtcctgagggttgcctgcctacccacgactccttctccttttagtgtggcgtttgcccgctagacccagcccagagtccaggtcagcacaggccctctcagccaaccactcatgacaaatgaggagtcgagatccacagtgtggatggggcaagccccagttcacagtagagaggtggaacttagtacttcctgctgcccattagacaccctttcttcctaagttcaagggaagcccacacatgtactgctccctgcatcctgctctaacttcctctcatcctctggatctcagctcaaatattccttatgcagagatgccttcccctgattccctaaactagactcggacccctctgttctgcatctctgtggcatatcatctgccccttttgtaaaacttataaacttgtggttacttgtttagcgtctctttcctccccagaccataagcaacataaagacaaagggtacatctagcacatagttcgtgttcaataaatgtttgttttcatcatgccacgggaagtgagatataccaagtattcaaaaaagtgttcaaatcattactaacagtgcttgctctgtgctggctgagtccagctgggcccagaattccacggttctaaatggcgcatattccatgtgcataggctgattgaaaatgtattaaacctaaattttaaaaaaaaagcacatgatactacacatgtcatgatgaatgaatagacagaactcctcctgaatataattacaaagttctgatccatctca

SEQ ID NO: 103296 - DNA, 465 bp, Homo sapiens
  Payload ID: 143
  Gene Symbol: ABHD4
  Gene Name: abhydrolase domain containing 4
  ENST ID: ENST00000542041
  CDS Start-End: 195-465
ttgtttactatggccgatgatctggagcagcagtgagttaatcctgtccctttctctctttctctctctctctctgggccatgatcctgggactgtctgtggctgaggaacagttgtagacaccttcccgctcttccttttccaggtctcaaggctggctgagtagctggctgcccacgtggcgccccacttccatgtctcagctgaagaatgtggaagccaggatcctccagtgtctccagaataagttcctggccagatatgtatccctcccaaaccagaataagatctggacggtgactgtgagccccgagcaaaacgaccgcacccccttggtgatggtgcatggttttgggggcggcgtgggtctctggatcctcaacatggactcactgagtgcccgccgcacactgcacaccttcgatctgcttggcttcgggcgaagctcaaggccagcattcccaa

SEQ ID NO: 103297 - DNA, 662 bp, Homo sapiens
  Payload ID: 143
  Gene Symbol: ABHD4
  Gene Name: abhydrolase domain containing 4
  ENST ID: ENST00000541962
  CDS Start-End: 1-163
gtctcaaggctggctgagtagctggctgcccacgtggcgccccacttccatgtctcagctgaagaatgtggaagccaggatcctccagtgtctccagaataagttcctggccagatatgtatccctcccaaaccagaataagatctggacggtgactagttaaacacctcatcctggtggacccatggggctttcccctccgaccaactaaccccagtgagatccgtgcacccccagcctgggtcaaagccgtggcatctgtcctaggacgttccaatccattggctgttcttcgagtagctgggccctgggggcctggtctggtgcagcgattccggccggacttcaaacgcaagtttgcagacttctttgaagatgataccatatcagagtatatttaccactgcaacgcacagaatcccagtggtgagacagcattcaaagccatgatggagtcctttggctgggcccggcgccctatgctggagcgaattcacttgattcgaaaagatgtgcctatcactatgatctacgggtccgacacctggatagataccagtacgggaaaaaaggtgaagatgcagcggccggattcctatgtccgagacatggagattaagggtgcctcccaccatgtctatgctgaccagccacacatcttc

SEQ ID NO: 103298 - DNA, 550 bp, Homo sapiens
  Payload ID: 143
  Gene Symbol: ABHD4
  Gene Name: abhydrolase domain containing 4
  ENST ID: ENST00000537243
  CDS Start-End: 18-275
ggcaaggcttgtttactatggccgatgatctggagcagcagtctcaaggctggctgagtagctggctgcccacgtggcgccccacttccatgtctcagctgaagaatgtggaagccaggatcctccagtgtctccagaataagttcctggccagatatgtatccctcccaaaccagaataagatctggacggtgactgtgagccccgagcaaaacgaccgcacccccttggtgatgctcaaggccagcattcccaagggacccggagggggctgaggatgagtttgtgacatcgatagagacatggcgggagaccatggggatccccagcatgatcctcctggggcacagtttgggaggattcctggccacttcttactcaatcaagtaccctgatagagttaaacacctcatcctggtggacccatggggctttcccctccgaccaactaaccccagtgagatccgtgcacccccagcctgggtcaaagccgtggcatctgtcctaggacgttccaatccattggctgttcttcgagtagctgggccct

SEQ ID NO: 103299 - DNA, 185 bp, Homo sapiens
  Payload ID: 143
  Gene Symbol: ABHD4
  Gene Name: abhydrolase domain containing 4
  ENST ID: ENST00000545034
  CDS Start-End: 53-185
ttattacctcccttttaaagatgaggaagctctgacacagaaaagctaaataatgtgcccacagtcacattgctggtctcaaggctggctgagtagctggctgcccacgtggcgccccacttccatgtctcagctgaagaatgtggaagccaggatcctccagtgtctccagaataagttcctgg

SEQ ID NO: 103300 - DNA, 833 bp, Homo sapiens
  Payload ID: 144
  Gene Symbol: ABHD5
  Gene Name: abhydrolase domain containing 5
  ENST ID: ENST00000013894
  CDS Start-End: 43-177
gccggcttcgagataagtcccggcgcttgcgcggcggcggctatggcggcggaggaggaggaggtggactctgccgacaccggagagaggtcaggatggctaactggttggctccccacatggtgccctacgtctatatcacaccttaaagaagctgaagagaagatgttaaaataaagtacagaaatgaatgtcgggggctggcaggagtataataccctcatttgacagatgtggaaagaagttagaaggtaatatgacttgccaaagaccttgatcacaggttacttgaggtttgtctgaggtgtgccttgcacatacaaaaaagaacctgttcgtatatctaatggaaataaaatatggacactgaagttctctcataatatttcaaataagactccacttgtccttctccatggttttggaggaggtcttgggctctgggcactgaattttggagatctttgcaccaacagacctgtctatgcttttgacctattgggttttggacgaagtagtagacccaggtttgacagtgatgcagaagaagtggagaatcagtttgtggaatccattgaagagtggagatgtgccctaggattggacaaaatgatcttgcttgggcacaacctaggtggattcttggctgctgcttactcgctgaagtacccatcaagggttaatcatctcattttagtggagccttggggtttccctgaacgaccagaccttgctgatcaagacagaccaattccagtttggatcagagccttgggagcagcattgactccctttaaccctttagctggcctaaggattgcaggaccctttgg

SEQ ID NO: 103301 - DNA, 1690 bp, Homo sapiens
  Payload ID: 144
  Gene Symbol: ABHD5
  Gene Name: abhydrolase domain containing 5
  Uniprot ID: Q8WTS1
  ENST ID: ENST00000458276
  CDS Start-End: 124-1173
agtgcgcggaagacgcatgcgctggcggcctgcgccgccttaagtgccgcgccagcccggggcggcccagtcggcctgtcagccggcttcgagataagtcccggcgcttgcgcggcggcggctatggcggcggaggaggaggaggtggactctgccgacaccggagagaggtcaggatggctaactggttggctccccacatggtgccctacgtctatatcacaccttaaagaagctgaagagaagatgttaaaatgtgtgccttgcacatacaaaaaagaacctgttcgtatatctaatggaaataaaatatggacactgaagttctctcataatatttcaaataagactccacttgtccttctccatggttttggaggaggtcttgggctctgggcactgaattttggagatctttgcaccaacagacctgtctatgcttttgacctattgggttttggacgaagtagtagacccaggtttgacagtgatgcagaagaagtggagaatcagtttgtggaatccattgaagagtggagatgtgccctaggattggacaaaatgatcttgcttgggcacaacctaggtggattcttggctgctgcttactcgctgaagtacccatcaagggttaatcatctcattttagtggagccttggggtttccctgaacgaccagaccttgctgatcaagacagaccaattccagtttggatcagagccttgggagcagcattgactccctttaaccctttagctggcctaaggattgcaggaccctttggtttaagtctagtgcagcgtttaaggcctgatttcaaacgaaagtattcttcaatgttcgaagacgatactgtgacagaatacatctaccactgtaatgtgcagactccaagtggtgagacagctttcaagaatatgactattccttatggatgggcaaaaaggccaatgctccagcgaattggtaaaatgcaccctgacattccagtttcagtgatctttggcgcccgatcctgcatagatggcaattctggcaccagcatccagtccttacgaccacattcatatgtgaagacaatagctattcttggggcaggacattatgtatatgcagatcaaccagaagaattcaaccagaaagtaaaggagatctgcgacactgtggactgaacacactgaagctctgatgggaaaacctggtgactgatatagttgttcagcaataattcatagtctgtgatgaagagtagtgaatacaacacacaaccaggcagccttcttgactatactttgcacatgttttctttaggaattcactcacacatttaaaccagttagtgccttctagaagaatggctttcctttctcctacacaaaattgaaatatacaagtctctaaatataatacctttaaataaaaggttatttgtccctctgatgtactgaaaaactgtaatttttcagctgaaaattttttaatctaactttgctagttatttttatattgcaatctatattaccaatttaggaagtgatttctgagtctcttacactgtaaaggtgcactttattttctttgtcttccccatcatgtatttattgtgtcttgataactgatattaatctaaattcaatgtgtttttatgtaaaaatttgtcagttgtttagaatatttcactttgttttt

SEQ ID NO: 103302 - DNA, 876 bp, Homo sapiens
  Payload ID: 144
  Gene Symbol: ABHD5
  Gene Name: abhydrolase domain containing 5
  ENST ID: ENST00000456453
  CDS Start-End: 497-876
gcaatggtgcgatctcggctcaccgcaacctccgcctcccgagttcaagcgattctcctacctcaggctcccgagtagctggaattacaggtatctagagagtcgagtgggagggaaattgctggctctggccactacagtaacatcagcacctagagcagtgctcaactgactgaaggctcctgtgagtcgccctctccccctggccccccaacccgcggggaaaggctggcgggacgccacacagcacctcgattacgccatttcatttgccactgcaccatctatcggacactagctaggctcttccaggaccggacgcacctccgtccccaaggtgccacctgacagccaacaccgacggggtgatgcatgaatacagtcattattcaaattagctaaaacacctaactcattcgggtcaggatggctaactggttggctccccacatggtgccctacgtctatatcacaccttaaagaagctgaagagaagatgttaaaatgtgtgccttgcacatacaaaaaagaacctgttcgtatatctaatggaaataaaatatggacactgaagttctctcataatatttcaaataagactccacttgtccttctccatggttttggaggaggtcttgggctctgggcactgaattttggagatctttgcaccaacagacctgtctatgcttttgacctattgggttttggacgaagtagtagacccaggtttgacagtgatgcagaagaagtggagaatcagtttgtggaatccattgaagagtggagatgtgccctaggattggacaaaatgatcttgcttgggcacaacctaggtggattcttggctgctgcttactcgctgaagtacccatc

SEQ ID NO: 103303 - DNA, 525 bp, Homo sapiens
  Payload ID: 144
  Gene Symbol: ABHD5
  Gene Name: abhydrolase domain containing 5
  ENST ID: ENST00000413300
  CDS Start-End: 1-468
agggttaatcatctcattttagtggagccttggggtttccctgaacgaccagaccttgctgatcaagacagaccaattccagtttggatcagagccttgggagcagcattgactccctttaaccctttagctggcctaaggattgcaggaccctttggtttaagtctagtgcagcgtttaaggcctgatttcaaacgaaagtattcttcaatgttcgaagacgatactgtgacagaatacatctaccactgtaatgtgcagactccaagtttcagtgatctttggcgcccgatcctgcatagatggcaattctggcaccagcatccagtccttacgaccacattcatatgtgaagacaatagctattcttggggcaggacattatgtatatgcagatcaaccagaagaattcaaccagaaagtaaaggagatctgcgacactgtggactgaacacactgaagctctgatgggaaaacctggtgactgatatagttgttcagcaataattcatagtctgtgatgaa

SEQ ID NO: 103304 - DNA, 464 bp, Homo sapiens
  Payload ID: 144
  Gene Symbol: ABHD5
  Gene Name: abhydrolase domain containing 5
  ENST ID: ENST00000454293
  CDS Start-End: 330-464
gtctgagccggactccggccgcgccgggaggccgccttgaccccgcgcggagggtccgccccgttgttgtataagccaccccgcgggccggcgacggagctggccgcggcggccgcaccggctcgggctctgccaagggacccggcctgccccaatgccgccggcgggcggtgcccggtcgaccctgcacctgactgcgaggcgcgggaaatgaccgggtctgtcagcctcccatcgcggcttccgtctacaggtcaggatggctaactggttggctccccacatggtgccctacgtctatatcacaccttaaagaagctgaagagaagatgttaaaatgtgtgccttgcacatacaaaaaagaacctgttcgtatatctaatggaaataaaatatggacactgaagttctctcataatatttcaaataagactccacttgtccttctccatggttttggagga

SEQ ID NO: 103305 - DNA, 2393 bp, Homo sapiens
  Payload ID: 145
  Gene Symbol: ABHD6
  Gene Name: abhydrolase domain containing 6
  Uniprot ID: Q9BV23
  ENST ID: ENST00000295962
  CDS Start-End: 411-1424
acctctgtaggcgatcctgctctcgccgtggctttcgggtgctaggagacagttgccggcgttgggttgtgcgagacgctaactgtaccctccgggtttaacgctgtgaggcagcgcgcggaggaactggggataagcgccccggagcccccaaacagagcgcggccgctgggggacagcgcgcggcgccgggtcggggcggggcggcttttctgtcggaggacgcgaaccggcacgctgcgcctttaaggagtccagctgggctgggcgccggagctgggagcggcgcgggtaggagcccggcggcaggtcccagcccggggctagagaccgagggccggggtccgggcccggcggcgggacccaggcggttgaggctggtcaggagtcagccagcctgaaagagcaggatggatcttgatgtggttaacatgtttgtgattgcgggcggcacgctggccatcccaatcctggcatttgtggcttcatttcttctgtggccttcagcactgataagaatctattattggtactggcggaggacattgggcatgcaagtccgctatgttcaccatgaagactatcagttctgttattccttccggggcaggcctgggcacaaaccctccatcctcatgctccacggattctctgcccacaaggatatgtggctcagtgtggtcaagttccttccaaagaacctgcacttggtctgcgtggacatgccaggacatgagggcaccacccgctcctccctggatgacctgtccatagatgggcaagttaagaggatacaccagtttgtagaatgcctgaagctgaacaaaaaacctttccacctggtaggcacctccatgggtggccaggtggctggggtgtatgctgcttactacccatcggatgtctccagcctgtgtctcgtgtgtcctgctggcctgcagtactcaactgacaatcaatttgtacaacggctcaaagaactgcagggctctgccgccgtggagaagattcccttgatcccgtctaccccagaagagatgagtgaaatgcttcagctctgctcctatgtccgcttcaaggtgccccagcagatcctgcaaggccttgtcgatgtccgcatccctcataacaacttctaccgaaagttgtttttggaaatcgtcagtgagaagtccagatactctctccatcagaacatggacaagatcaaggttccgacgcagatcatctgggggaaacaagaccaggtgctggatgtgtctggggcagacatgttggccaagtcaattgccaactgccaggtggagcttctggaaaactgtgggcactcagtagtgatggaaagacccaggaagacagccaagctcataatcgactttttagcttctgtgcacaacacagacaacaacaagaagctggactgaggccccgactgcagcctgcattctgcacacagcatctgctcccatcccccaagtctgacgcagccaccactctcagggatcctgccccaaatgcggtcggagcgccagtgaccctgaggaagcccgtcccttatccctggtatccacggttccccagagctttggggaccacgcgaaaacctccaagatatttttcacaaaatagaaactcatatggaacaaaataagaaaccccagccatgaaatctaccatgaagtcttcaagttcatgtcactgagaagcttgtgcaaagcagccaccttggaccataattaaatcaaggacattttctttgagacattccttatagttggagactcaagatatttttgttgcatcaggtgtattcccttgcatgggcagtggcttttataggagcattagtcctcattcgctgaaccctgttgtttaggtctaatttaagttttacatagagacccatgtatgactgcagcccattggctgcaagaccagggaggaaagtggcaagctgtagaaaatgtttacacgcatggaggggcattgctctagccctcagagcgtccggagcagcagggtacatgggtgggaggttcattcagcacccaccagtcaggtatgttctgagtgaacccacagcagtcgcagaatgagcacctggcagggtgggtttcctaggaataatttattatttttaaaaataggcctaataaagcaataatgttctagacatctgtctaagtaatcagactcaggttccacacacaagcaacaactcgtgggcctcttttctatttcaatgtgctactaagaacccttggatgtaacatactagttagttaatgaattctgtgaattctgtgaagagtaatgtgattgaaaataagtctaaacagctgtaaaagtgaccacaatgacatgaaataaatttaataagtctagatcagcaa

SEQ ID NO: 103306 - DNA, 593 bp, Homo sapiens
  Payload ID: 145
  Gene Symbol: ABHD6
  Gene Name: abhydrolase domain containing 6
  ENST ID: ENST00000475982
  CDS Start-End: 96-251
gcccggggctagagaccgagggccggggtccgggcccggcggcgggacccaggcggttgaggctggtcaggagtcagccagcctgaaagagcaggatggatcttgatgtggttaacatgtttgtgattgcgggcggcacgctggccatcccaatcctggcatttgtggcttcatttcttctgtggccttcagcactgataagaatctattattgcatgagcagcgtgaaagatgtagcagccctgagctgagcctttctccttgttggaatcagaaggttaacagtcaaaaagaaagtgactttctcatgatgtgcttcattgccttttcatgccactgtccaattatcaaatgaaattgcccttcccacccccatggtgtacatcccctgatgaagggagcatcgaaatagacctggttcctctctgtgctataggtactggcggaggacattgggcatgcaagtccgctatgttcaccatgaagactatcagttctgttattccttccggggcaggcctgggcacaaaccctccatcctcatgctccacggattctctgcccacaaggatatgtggctcagtgtggtcaag

SEQ ID NO: 103307 - DNA, 768 bp, Homo sapiens
  Payload ID: 145
  Gene Symbol: ABHD6
  Gene Name: abhydrolase domain containing 6
  ENST ID: ENST00000485900
  CDS Start-End: 249-768
ttccctttccccagcctgccccggctcccgtgcccttgcgccccttccgtgtcgaaacacttgaatcaggatgctgtccagccaggtacccgccggcaacttgcggtcccccgcctacagcgacacaggtttcacggctgccttagaaatgcggattgtgtaacgccggctgcagggcagtgcacgtgcagggtttgcgcccctgagcccacagcgaggccaggagtcagccagcctgaaagagcaggatggatcttgatgtggttaacatgtttgtgattgcgggcggcacgctggccatcccaatcctggcatttgtggcttcatttcttctgtggccttcagcactgataagaatctattattggtactggcggaggacattgggcatgcaagtccgctatgttcaccatgaagactatcagttctgttattccttccggggcaggcctgggcacaaaccctccatcctcatgctccacggattctctgcccacaaggatatgtggctcagtgtggtcaagttccttccaaagaacctgcacttggtctgcgtggacatgccaggacatgagggcaccacccgctcctccctggatgacctgtccatagatgggcaagttaagaggatacaccagtttgtagaatgcctgaagctgaacaaaaaacctttccacctggtaggcacctccatgggtggccaggtggctggggtgtatgctgcttactacccatcggatgtctccagcctgtgtctcgtgtgtcctg

SEQ ID NO: 103308 - DNA, 2482 bp, Homo sapiens
  Payload ID: 145
  Gene Symbol: ABHD6
  Gene Name: abhydrolase domain containing 6
  Uniprot ID: Q9BV23
  ENST ID: ENST00000478253
  CDS Start-End: 502-1515
ccgggcgctcgggctccgcccccggtacctctgtaggcgatcctgctctcgccgtggctttcgggtgctaggagacagttgccggcgttgggttgtgcgagacgctaactgtaccctccgggtttaacgctgtgaggcagcgcgcggaggaactggggataagcgccccggagcccccaaacagagcgcggccgctgggggacagcgcgcggcgccgggtcggggcggggcggcttttctgtcggaggacgcgaaccggcacgctgcgcctttaaggagtccagctgggctgggcgccggagctgggagcggcgcgggtaggagcccggcggcaggtcccagcccggggctagagaccgagggccggggtccgggcccggcggcgggacccaggcggttgaggctggtcagaatctcattttcagcttctgccagagccagtagcagttgggaaagaaggctgtgctctttgaagagagtcagccagcctgaaagagcaggatggatcttgatgtggttaacatgtttgtgattgcgggcggcacgctggccatcccaatcctggcatttgtggcttcatttcttctgtggccttcagcactgataagaatctattattggtactggcggaggacattgggcatgcaagtccgctatgttcaccatgaagactatcagttctgttattccttccggggcaggcctgggcacaaaccctccatcctcatgctccacggattctctgcccacaaggatatgtggctcagtgtggtcaagttccttccaaagaacctgcacttggtctgcgtggacatgccaggacatgagggcaccacccgctcctccctggatgacctgtccatagatgggcaagttaagaggatacaccagtttgtagaatgcctgaagctgaacaaaaaacctttccacctggtaggcacctccatgggtggccaggtggctggggtgtatgctgcttactacccatcggatgtctccagcctgtgtctcgtgtgtcctgctggcctgcagtactcaactgacaatcaatttgtacaacggctcaaagaactgcagggctctgccgccgtggagaagattcccttgatcccgtctaccccagaagagatgagtgaaatgcttcagctctgctcctatgtccgcttcaaggtgccccagcagatcctgcaaggccttgtcgatgtccgcatccctcataacaacttctaccgaaagttgtttttggaaatcgtcagtgagaagtccagatactctctccatcagaacatggacaagatcaaggttccgacgcagatcatctgggggaaacaagaccaggtgctggatgtgtctggggcagacatgttggccaagtcaattgccaactgccaggtggagcttctggaaaactgtgggcactcagtagtgatggaaagacccaggaagacagccaagctcataatcgactttttagcttctgtgcacaacacagacaacaacaagaagctggactgaggccccgactgcagcctgcattctgcacacagcatctgctcccatcccccaagtctgacgcagccaccactctcagggatcctgccccaaatgcggtcggagcgccagtgaccctgaggaagcccgtcccttatccctggtatccacggttccccagagctttggggaccacgcgaaaacctccaagatatttttcacaaaatagaaactcatatggaacaaaataagaaaccccagccatgaaatctaccatgaagtcttcaagttcatgtcactgagaagcttgtgcaaagcagccaccttggaccataattaaatcaaggacattttctttgagacattccttatagttggagactcaagatatttttgttgcatcaggtgtattcccttgcatgggcagtggcttttataggagcattagtcctcattcgctgaaccctgttgtttaggtctaatttaagttttacatagagacccatgtatgactgcagcccattggctgcaagaccagggaggaaagtggcaagctgtagaaaatgtttacacgcatggaggggcattgctctagccctcagagcgtccggagcagcagggtacatgggtgggaggttcattcagcacccaccagtcaggtatgttctgagtgaacccacagcagtcgcagaatgagcacctggcagggtgggtttcctaggaataatttattatttttaaaaataggcctaataaagcaataatgttctagacatctgtctaagtaatcagactcaggttccacacacaagcaacaactcgtgggcctcttttctatttcaatgtgctactaagaacccttggatgtaacatactagttagttaatgaattctgtgaattctgtgaagagtaatgtgattgaaaataagtctaaacagctgtaaaagtgaccacaatgacatgaaataaatttaataagtctagatcagc

SEQ ID NO: 103309 - DNA, 921 bp, Homo sapiens
  Payload ID: 145
  Gene Symbol: ABHD6
  Gene Name: abhydrolase domain containing 6
  ENST ID: ENST00000463756
  CDS Start-End: 247-921
agagtcggcgatctgcacttgcctttccactccgctccccgcgcgggcgctgcccccacctcccgctgcctggataggtttgagatgcccgaaacccggcgccccatttcctgggtccagccagcctcttgaagccgggggacagagtgaggacggaatctcattttcagcttctgccagagccagtagcagttgggaaagaaggctgtgctctttgaagagagtcagccagcctgaaagagcaggatggatcttgatgtggttaacatgtttgtgattgcgggcggcacgctggccatcccaatcctggcatttgtggcttcatttcttctgtggccttcagcactgataagaatctattattggtactggcggaggacattgggcatgcaagtccgctatgttcaccatgaagactatcagttctgttattccttccggggcaggcctgggcacaaaccctccatcctcatgctccacggattctctgcccacaaggatatgtggctcagtgtggtcaagttccttccaaagaacctgcacttggtctgcgtggacatgccaggacatgagggcaccacccgctcctccctggatgacctgtccatagatgggcaagttaagaggatacaccagtttgtagaatgcctgaagctgaacaaaaaacctttccacctggtaggcacctccatgggtggccaggtggctggggtgtatgctgcttactacccatcggatgtctccagcctgtgtctcgtgtgtcctgctggcctgcagtactcaactgacaatcaatttgtacaacggctcaaagaactgcagggctctgccgccgtggagaagattcccttgatcccgtctaccccagaagagatgagtgaaatgcttcagctctgctcctatgtccgcttcaaggtgccc

SEQ ID NO: 103310 - DNA, 1367 bp, Homo sapiens
  Payload ID: 145
  Gene Symbol: ABHD6
  Gene Name: abhydrolase domain containing 6
  ENST ID: ENST00000613521
  CDS Start-End: 411-1367
acctctgtaggcgatcctgctctcgccgtggctttcgggtgctaggagacagttgccggcgttgggttgtgcgagacgctaactgtaccctccgggtttaacgctgtgaggcagcgcgcggaggaactggggataagcgccccggagcccccaaacagagcgcggccgctgggggacagcgcgcggcgccgggtcggggcggggcggcttttctgtcggaggacgcgaaccggcacgctgcgcctttaaggagtccagctgggctgggcgccggagctgggagcggcgcgggtaggagcccggcggcaggtcccagcccggggctagagaccgagggccggggtccgggcccggcggcgggacccaggcggttgaggctggtcaggagtcagccagcctgaaagagcaggatggatcttgatgtggttaacatgtttgtgattgcgggcggcacgctggccatcccaatcctggcatttgtggcttcatttcttctgtggccttcagcactgataagaatctattattggtactggcggaggacattgggcatgcaagtccgctatgttcaccatgaagactatcagttctgttattccttccggggcaggcctgggcacaaaccctccatcctcatgctccacggattctctgcccacaaggatatgtggctcagtgtggtcaagttccttccaaagaacctgcacttggtctgcgtggacatgccaggacatgagggcaccacccgctcctccctggatgacctgtccatagatgggcaagttaagaggatacaccagtttgtagaatgcctgaagctgaacaaaaaacctttccacctggtaggcacctccatgggtggccaggtggctggggtgtatgctgcttactacccatcggatgtctccagcctgtgtctcgtgtgtcctgctggcctgcagtactcaactgacaatcaatttgtacaacggctcaaagaactgcagggctctgccgccgtggagaagattcccttgatcccgtctaccccagaagagatgagtgaaatgcttcagctctgctcctatgtccgcttcaaggtgccccagcagatcctgcaaggccttgtcgatgtccgcatccctcataacaacttctaccgaaagttgtttttggaaatcgtcagtgagaagtccagatactctctccatcagaacatggacaagatcaaggttccgacgcagatcatctgggggaaacaagaccaggtgctggatgtgtctggggcagacgttggccaagtcaattgccaactgccaggtggagcttctggaaaactgtgggcactcagtagtgatggaaagccaggaagacagccaagctcataa

SEQ ID NO: 103311 - DNA, 2090 bp, Homo sapiens
  Payload ID: 146
  Gene Symbol: ABHD8
  Gene Name: abhydrolase domain containing 8
  Uniprot ID: Q96I13
  ENST ID: ENST00000247706
  CDS Start-End: 241-1560
agtgcccgcccgtcggcacgtggctccgcctactcgggggaggaacttaaagggccggctgtttcggcggccgcgggatgcccctgcgctgaccgccaggggcaggtgcccgcccgcgtagacgcacccggcctgaccccgcgccaccatgtaaacggcgccagcaggcggacgctggcttctccgcctgggacccctccgccccgacccgggccccgcggccctcgatgaggacacaccatgctgaccggggtgaccgacggtatcttctgttgcctgctgggcacgccccccaacgccgtggggccactggagagcgtcgagtccagcgatggctacacctttgtagaggtcaagcccggccgcgtgctgcgggtgaagcatgcaggacccgccccagccgctgccccacctccaccatcatccgcatcctcggatgcagcccagggggacctctccggcttggtccgctgtcagcgccggatcaccgtgtaccgcaatgggcggttgctggtggaaaacctgggccgagcccctcgagccgacctcctacacgggcagaatggctctggggagccgccggccgccctggaggtggagctggcagatccggcgggcagcgatggccgcttggcccccggcagcgcaggcagcggcagcggcagtggcagtggtgggcggcggcggcgagccaggcgccccaagaggaccatccatattgactgtgagaagcgcatcactagctgcaaaggcgcccaggccgacgtggtgctctttttcatccatggtgtcggcggttccctggccatctggaaggagcagctggacttctttgtgcgcctaggctatgaggtggtggctcctgacctggccggccacggggccagctctgcgccccaggtggccgcagcctacaccttctatgcgctggctgaggacatgcgagcaatcttcaagcgctatgccaagaagcgaaatgtgctcattggccattcctacggtgtctctttctgcacattcctggcacatgagtacccagacctagtgcacaaggtgatcatgatcaatggcgggggccctacggcgctggagcccagcttctgctcaatcttcaacatgcccacctgcgtcctgcactgcttgtcgccctgcctggcctggagcttcctcaaggccggcttcgcccgccaaggagccaaggagaagcagctgttaaaggagggcaacgctttcaacgtgtcatccttcgtactccgggccatgatgagcggccagtactggcccgagggcgacgaggtctaccacgccgagctcaccgtgcccgtcctgcttgtccacggcatgcacgataagtttgtgccggtggaggaagaccagcgcatggccgagatcctgctcctggcattcctgaagctcatcgacgagggcagccacatggtgatgctggaatgccctgagacggtcaacacgctgctccacgaattcctgctctgggagcccgagccctcgcccaaggctctaccggagccactgccggcgcctccagaagacaagaagtagccgctgggccggcggggcatcgcttggtgagcacagccgcagcaggaggaggcccgagcctgcgccaggtctgcagcgcagaccacctgggcgggccgttcgctccggtgggcggggccaggtcagggagacgcccccaggctgcctgggcggggcgtggcatccgagggagcccagcggacattccgctctccgcttccgtcccgcggggcccatcggcgttttggggccgcagccgggaccctcacggaagatgaccttgtacagaagctctccctcaccttccccccaacgccacggccaaggcaggccccccaccccgctgtcttccgtgtcagccgtgcttgatcctgggacccacgagccccacagggaccctcgaggccccatcccgttatccgagacccttcctaccccccattcctcggcgctgggagctatttttgcccaagggggggggatgggggggctggcgccaccgaacctgcacatctcaacttgtaactcaataaacagaagtgacaatcgga

SEQ ID NO: 103312 - DNA, 555 bp, Homo sapiens
  Payload ID: 146
  Gene Symbol: ABHD8
  Gene Name: abhydrolase domain containing 8
  ENST ID: ENST00000593489
  CDS Start-End: 31-555
actgctaccctcatttcacagggacaatccatgcggatcggagataaaagtttttcattcttagaggcgggacacaccatgctgaccggggtgaccgacggtatcttctgttgcctgctgggcacgccccccaacgccgtggggccactggagagcgtcgagtccagcgatggctacacctttgtagaggtcaagcccggccgcgtgctgcgggtgaagcatgcaggacccgccccagccgctgccccacctccaccatcatccgcatcctcggatgcagcccagggggacctctccggcttggtccgctgtcagcgccggatcaccgtgtaccgcaatgggcggttgctggtggaaaacctgggccgagcccctcgagccgacctcctacacgggcagaatggctctggggagccgccggccgccctggaggtggagctggcagatccggcgggcagcgatggccgcttggcccccggcagcgcaggcagcggcagcggcagtggcagtggtgggcggcggcggcgagccaggcgccccaagaggaccatccat

SEQ ID NO: 103313 - DNA, 570 bp, Homo sapiens
  Payload ID: 146
  Gene Symbol: ABHD8
  Gene Name: abhydrolase domain containing 8
  ENST ID: ENST00000594194
  CDS Start-End: 180-570
aaagggccggctgtttcggcggccgcgggatgcccctgcgctgaccgccaggggcaggtgcccgcccgcgtagacgcacccggcctgaccccgcgccaccatgtaaacggcgccagcaggcggacgctggcttctccgcctgggacccctccgccccgacccgggccccgcggccctcgatgaggaacatccccacacaagacgccaccaccttccctgtggacaccctgtggggacacaccatgctgaccggggtgaccgacggtatcttctgttgcctgctgggcacgccccccaacgccgtggggccactggagagcgtcgagtccagcgatggctacacctttgtagaggtcaagcccggccgcgtgctgcgggtgaagcatgcaggacccgccccagccgctgccccacctccaccatcatccgcatcctcggatgcagcccagggggacctctccggcttggtccgctgtcagcgccggatcaccgtgtaccgcaatgggcggttgctggtggaaaacctgggccgagcccctcgagccgacctcctacacgggcagaatggct

SEQ ID NO: 103314 - DNA, 2109 bp, Homo sapiens
  Payload ID: 147
  Gene Symbol: ABI3
  Gene Name: ABI family, member 3
  Uniprot ID: Q9P2A4
  ENST ID: ENST00000225941
  CDS Start-End: 499-1599
tcctatccaccctccactcccctgtcccttggtgactcatccctgagcttcccaaggaagcccccaccctctgccctttcctcccgccttccatgagtggaaaatccacctccgccccctatagcaggccagcccccttcctccccagtctccgaccccatcccccagccgaccagtttcctctccaggaccagggagcaatcacagctgccccgaccttggcttcctctgctgggtgggattgggggctgggcccccaaatgggcccctggcttcccccttcctctgggcaggggacagagagacacaggctcggggagcaggactgacttcctcttgtcccggaatgagcatgcctgccctttgcaagcaggtttgggtctcacgcagaggaaaccaaaagcaataagagggagggaaggcagagcaaccaatcaagggcagggtgagactcaaaacgagcgggctccctggggagccagacagaggctgggggtgatggcggagctacagcagctgcaggagtttgagatccccactggccgggaggctctgaggggcaaccacagtgccctgctgcgggtcgctgactactgcgaggacaactatgtgcaggccacagacaagcggaaggcgctggaggagaccatggccttcactacccaggcactggccagcgtggcctaccaggtgggcaacctggccgggcacactctgcgcatgttggacctgcagggggccgccctgcggcaggtggaagcccgtgtaagcacgctgggccagatggtgaacatgcatatggagaaggtggcccgaagggagatcggcaccttagccactgtccagcggctgccccccggccagaaggtcatcgccccagagaacctaccccctctcacgccctactgcaggagacccctcaactttggctgcctggacgacattggccatgggatcaaggacctcagcacgcagctgtcaagaacaggcaccctgtctcgaaagagcatcaaggcccctgccacacccgcctccgccaccttggggagaccaccccggattcccgagccagtgcacctgccggtggtgcccgacggcagactctccgccgcctcctctgcgttttccctggcctcggccggcagcgccgaaggtgtcggtggggcccccacgcccaaggggcaggcagcacctccagccccacctctccccagctccttggacccacctcctccaccagcagccgtcgaggtgttccagcggcctcccacgctggaggagttgtccccacccccaccggacgaagagctgcccctgccactggacctgcctcctcctccacccctggatggagatgaattggggctgcctccacccccaccaggatttgggcctgatgagcccagctgggtgcctgcctcatacttggagaaagtggtgacactgtacccatacaccagccagaaggacaatgagctctccttctctgagggcactgtcatctgtgtcactcgccgctactccgatggctggtgcgagggcgtcagctcagaggggactggattcttccctgggaactatgtggagcccagctgctgacagcccagggctctctgggcagctgatgtctgcactgagtgggtttcatgagccccaagccaaaaccagctccagtcacagctggactgggtctgcccacctcttgggctgtgagctgtgttctgtccttcctcccatcggagggagaaggggtcctggggagagagaatttatccagaggcctgctgcagatggggaagagctggaaaccaagaagtttgtcaacagaggacccctactccatgcaggacagggtctcctgctgcaagtcccaactttgaataaaacagatgatgtcctgtgactgccccacagagataaggggccaggagggattgaaaggcatcccagttctaaggctgctgctaattacagcccccaacctccaacccaccagctgacctagaagcagcatcttcccatttcctcagtacccacaaagtgcagcccacattggaccccagacacccctctgcagccattgactgcaacttgttcttttgcccattg

SEQ ID NO: 103315 - DNA, 1718 bp, Homo sapiens
  Payload ID: 147
  Gene Symbol: ABI3
  Gene Name: ABI family, member 3
  Uniprot ID: Q9P2A4
  ENST ID: ENST00000419580
  CDS Start-End: 315-1397
ccaggaccagggagcaatcacagctgccccgaccttggcttcctctgctgggtgggattgggggctgggcccccaaatgggcccctggcttcccccttcctctgggcaggggacagagagacacaggctcggggagcaggactgacttcctcttgtcccggaatgagcatgcctgccctttgcaagcaggtttgggtctcacgcagaggaaaccaaaagcaataagagggagggaaggcagagcaaccaatcaagggcagggtgagactcaaaacgagcgggctccctggggagccagacagaggctgggggtgatggcggagctacagcagctgcaggagtttgagatccccactggccgggaggctctgaggggcaaccacagtgccctgctgcgggtcgctgactactgcgaggacaactatgtgcaggccacagacaagcggaaggcgctggaggagaccatggccttcactacccaggcactggccagcgtggcctaccaggtgggcaacctggccgggcacactctgcgcatgttggacctgcagggggccgccctgcggcaggtggaagcccgtatggtgaacatgcatatggagaaggtggcccgaagggagatcggcaccttagccactgtccagcggctgccccccggccagaaggtcatcgccccagagaacctaccccctctcacgccctactgcaggagacccctcaactttggctgcctggacgacattggccatgggatcaaggacctcagcacgcagctgtcaagaacaggcaccctgtctcgaaagagcatcaaggcccctgccacacccgcctccgccaccttggggagaccaccccggattcccgagccagtgcacctgccggtggtgcccgacggcagactctccgccgcctcctctgcgttttccctggcctcggccggcagcgccgaaggtgtcggtggggcccccacgcccaaggggcaggcagcacctccagccccacctctccccagctccttggacccacctcctccaccagcagccgtcgaggtgttccagcggcctcccacgctggaggagttgtccccacccccaccggacgaagagctgcccctgccactggacctgcctcctcctccacccctggatggagatgaattggggctgcctccacccccaccaggatttgggcctgatgagcccagctgggtgcctgcctcatacttggagaaagtggtgacactgtacccatacaccagccagaaggacaatgagctctccttctctgagggcactgtcatctgtgtcactcgccgctactccgatggctggtgcgagggcgtcagctcagaggggactggattcttccctgggaactatgtggagcccagctgctgacagcccagggctctctgggcagctgatgtctgcactgagtgggtttcatgagccccaagccaaaaccagctccagtcacagctggactgggtctgcccacctcttgggctgtgagctgtgttctgtccttcctcccatcggagggagaaggggtcctggggagagagaatttatccagaggcctgctgcagatggggaagagctggaaaccaagaagtttgtcaacagaggacccctactccatgcaggacagggtctcctgctgcaagtcccaactttgaataaaacagatgatgtcctgtgactgccccacagagataa

SEQ ID NO: 103316 - DNA, 866 bp, Homo sapiens
  Payload ID: 147
  Gene Symbol: ABI3
  Gene Name: ABI family, member 3
  ENST ID: ENST00000571035
  CDS Start-End: 1-574
gagaccaccccggattcccgagccagtgcacctgccggtggtgcccgacggcagactctccgccgcctcctctgcgttttccctggcctcggccggcagcgccgaaggtgtcggtggggcccccacgcccaaggggcaggcagcacctccagccccacctctccccagctccttggacccacctcctccaccagcagccgtcgaggtgttccagcggcctcccacgctggaggagttgtccccacccccaccggcctttctgcttttcccccaagacgaagagctgcccctgccactggacctgcctcctcctccacccctggatggagatgaattggggctgcctccacccccaccaggatttgggcctgatgagcccagctgggtgcctgcctcatacttggagaaagtggtgacactgtacccatacaccagccagaaggacaatgagctctccttctctgagggcactgtcatctgtgtcactcgccgctactccgatggctggtgcgagggcgtcagctcagaggggactggattcttccctgggaactatgtggagcccagctgctgacagcccagggctctctgggcagctgatgtctgcactgagtgggtttcatgagccccaagccaaaaccagctccagtcacagctggactgggtctgcccacctcttgggctgtgagctgtgttctgtccttcctcccatcggagggagaaggggtcctggggagagagaatttatccagaggcctgctgcagatggggaagagctggaaaccaagaagtttgtcaacagaggacccctactccatgcaggacagggtctcctgctgcaagtcccaactttgaataaaacagat

SEQ ID NO: 103317 - DNA, 810 bp, Homo sapiens
  Payload ID: 147
  Gene Symbol: ABI3
  Gene Name: ABI family, member 3
  ENST ID: ENST00000573347
  CDS Start-End: 1-481
aacaggcaccctgtctcgaaagagcatcaaggcccctgccacacccgcctccgccaccttggggagaccaccccggattcccgagccagtgcacctgccggtggtgcccgacggcagactctccgccgcctcctctgcgttttccctggcctcggccggcagcgccgaaggtgtcggtggggcccccacgcccaaggggcaggcagcacctccagccccacctctccccagctccttggacccacctcctccaccagcagccgtcgaggtgttccagcggcctcccacgctggaggagttgtccccacccccaccggcctttctgcttttcccccaagacgaagagctgcccctgccactggacctgcctcctcctccacccctggatggagatgaattggggctgcctccacccccaccaggatttgggcctgatgagcccagctgggtgcctgcctcatacttggagaaaggtacctgacttctgggactgaggggcaccggatcccacttcctctgttgccctgatccccattctcctccctctgcaaaggtgtgaatctatcccccgggccccccacacaatttttctgacgaactgacagaactggggagagggcagctggcctggtattaaatattaactaagctggggaggggtcctgaaggcttgcaagaaggcccccaagatggcccctagagtctagtacttgagaccgtgcatccccatggtggtggggggtgagggggagagggcaagaggcattatctcacggcaccctcttctcttgccctgcagtggtgacactg

SEQ ID NO: 103318 - DNA, 4498 bp, Homo sapiens
  Payload ID: 148
  Gene Symbol: ABI3BP
  Gene Name: ABI family, member 3 (NESH) binding protein
  Uniprot ID: Q7Z7G0
  ENST ID: ENST00000284322
  CDS Start-End: 111-3338
gtgagtaagcccacggcacagctaagtgcagccgcccgcctctgtcactgggagacagtccacttaaatgcagctccagggttgcgaggcacccaccagcatcattccccatgcgaggtggcaaatgcaacatgctctccagtttggggtgtctacttctctgtggaagtattacactagccctgggaaatgcacagaaattgccaaaaggtaaaaggccaaacctcaaagtccacatcaataccacaagtgactccatcctcttgaagttcttgcgtccaagtccaaatgtaaagcttgaaggtcttctcctgggatatggcagcaatgtatcaccaaaccagtacttccctcttcccgctgaagggaaattcacagaagctatagttgatgcagagccgaaatatctgatagttgtgcgacctgctccacctccaagtcaaaagaagtcatgttcaggtaaaactcgttctcgcaaacctctgcagctggtggttggcactctgacaccgagctcggtcttcctgtcctggggtttcctcatcaacccacaccatgactggacattgccaagtcactgtcccaatgacagattttatacaattcgctatcgagaaaaggataaagaaaagaagtggatttttcaaatctgtccagccactgaaacaattgtggaaaacctaaagcccaacacagtttatgaatttggagtgaaagacaatgtggaaggtggaatttggagtaagattttcaatcacaagactgttgttggaagtaaaaaagtaaatgggaaaatccaaagtacctatgaccaagaccacacagtgccagcatatgtcccaaggaaactaatcccaataacaatcatcaagcaagtgattcagaatgttactcacaaggattcagctaaatccccagaaaaagctccactgggaggagtgatactagtccaccttattattccaggtcttaatgaaactactgtaaaacttcctgcatccctaatgtttgagatttcagatgcactcaagacacaattagctaagaatgaaaccttggcattacctgccgaatctaaaacaccagaggttgaaaaaatctcagcacgacccacaacagtgactcctgaaacagttccaagaagcactaaacccactacgtctagtgcattagatgtttcagaaacaacactggcttcaagtgaaaagccatggattgtgcctacagctaaaatatctgaagattccaaagttctgcagcctcaaactgcaacttatgatgttttctcaagccctacaacatcagatgagcctgagatatcagattcctacacagcaacaagtgatcgtattctggattctatcccacctaaaacttctagaactcttgaacagccaagggcaacactggctccaagtgaaacaccatttgttcctcaaaaactggaaatctttaccagtccagaaatgcagcctacgacacctgctccccagcaaactacatctatcccttctacacctaaacgacgcccccggcccaaaccgccaagaaccaaacctgaaagaaccacaagtgccggaacaattacacctaaaatttctaaaagccctgaacctacatggacaacaccggctcccggtaaaacacaatttatttctctgaaacctaaaatccctctcagcccagaagtgacacacaccaaacctgctcccaagcagacaccacgtgctcctcctaagccaaaaacatcaccacgcccaagaatcccacaaacacaaccagttcctaaggtgccccagcgtgttactgcaaaaccaaaaacgtcaccaagtccagaagtgtcatacaccacacctgctccaaaagatgtgctccttcctcataaaccataccctgaggtctctcagagcgaacctgctcctctagagacacgaggcatcccttttatacccatgatttccccaagtcctagtcaagaggaactacagaccactctggaagaaacagaccaatccacccaagaacctttcacaactaagattccacgaacaactgaactagcaaagacaactcaggcgccacacagattttatactactgtgaggcccagaacatctgacaagccacacatcagacctggggtcaagcaagcacccaggccatcaggtgctgatagaaatgtatcagtggactctacccaccccactaaaaagccagggactcgccgcccacccttgccacccagacctacacacccacgaagaaaacctttaccaccaaataatgtcactggaaagccaggaagtgcaggaatcatttcatcaggcccaataactacaccacccctgaggtcaacacccaggcctactggaactcccttggagagaatagagacagatataaagcaaccaacagttcctgcctctggagaagaactggaaaatataactgactttagctcaagcccaacaagagaaactgatcctcttgggaagccaagattcaaaggacctcatgtgcgatacatccaaaagcctgacaacagtccctgctccattactgactctgtcaaacggttccccaaagaggaggccacagaggggaatgccaccagcccaccacagaacccacccaccaacctcactgtggtcaccgtggaagggtgcccctcatttgtcatcttggactgggaaaagccactaaatgacactgtcactgaatatgaagttatatccagagaaaatgggtcattcagtgggaagaacaagtccattcaaatgacaaatcagacattttccacagtagaaaatctgaaaccaaacacgagttatgaattccaggtgaaacccaaaaacccgcttggtgaaggcccggtcagcaacacagtggcattcagtactgaatcagcggacccaagagtgagtgagccagtttctgcaggaagagatgccatctggactgaaagaccctttaattcagactcttactcagagtgtaagggcaaacaatatgtcaaaaggacatggtataaaaaatttgtaggagtgcagctgtgcaactctctcagatacaagatttacttgagcgactccctcacaggaaaattttataacataggtgatcagaggggccatggagaagatcactgccagtttgtggattcatttttagatggacgcactgggcagcaactcacttctgaccagttaccaatcaaagaaggttatttcagagcagttcgccaggaacctgtccaatttggagaaataggtggtcacacccaaatcaattatgttcagtggtatgaatgtgggactacaattcctggaaaatggtagatgctgcacaaagttaccttctgtttcatcattgcaaacaaaaatcattgaaaatactatgccgcattcatttaaagctattttgtttactatgtataaaagtctacaatctaattaatagcaatactagatgtttattattagaaaagattgctgagagtatttatcaggttttacaaagtcattttaagaaagcaagatactgatgttaacagaataacatttttggggaagctggctccctattcatggtattttaagagatcatttgtatattatttatcacactgttgtaatgatgttttgagatacttttataacaaaattaacatcaaaaaggtatatactttttaaaaaaaatttacttttattgatgtgtactcttcctattgatgagttaattccataaatctctacttagtttaacttattggatcaaattatcttcagcatgtatatctggggaaaaaaggtccgaattttcacatttatatttaaacttcaattttttatatttaaacttcaattttttagcaacagctgaatagctttgcggaggagtttaatagttacacattcatgctaatatacatttcctttaaacatccacaaattcttaaaaagattgaatcagtaaatttcatttcagctaaaaatggagtctaatatattgtttcaaaagatacatttttacccaccataaatgttacaatatctgaatatgctttgtcaaactatccctttatgcaatcgtcttcatattgtttttatgattctaatcaagctgtatgtagagactgaatgtgaagtcaagtctgagcacaaaaagataatgcacgatgagattgcctaccattttataggatatttactatgtatttatacgttaagacctctatgaatgaatgtatcagagaatgtctttgtaactgtttaattcaatctgtaataaaaatctaactaactaactcatttatttctattaaaaaggtattgtcctttaggcggggaatgggaatccttgctgcactgttgcagtcattctgaaaggacctttccctgtacttacctttcaacatgcttcaatcttatcaacgctacattttgtatttttcaaacaagtataaattctgcaataaagagatgtagtttttttttaa

SEQ ID NO: 103319 - DNA, 251 bp, Homo sapiens
  Payload ID: 148
  Gene Symbol: ABI3BP
  Gene Name: ABI family, member 3 (NESH) binding protein
  ENST ID: ENST00000459682
  CDS Start-End: 1-251
ttttgagaaacctaggggcacattggcttcaagtgaaaagccatggattgtgcctacagctaaaatatctgaagattccaaagttctgcagcctcaaactgcaacaagtgatcgtattctggattctatcccacctaaaacttctagaactcttgaacagccaagggcaacactggctccaagtgaaacaccatttgttcctcaaaaactggaaatctttaccagtccagaaatgcagcctacgacacctg

SEQ ID NO: 103320 - DNA, 561 bp, Homo sapiens
  Payload ID: 148
  Gene Symbol: ABI3BP
  Gene Name: ABI family, member 3 (NESH) binding protein
  ENST ID: ENST00000478235
  CDS Start-End: 1-561
ctaaaaccacgccccatccagaagtacctcaaactaaactggctcccaaagtgcctcaacgaactcatcgtccacatcccaaacctaaaaccacactgagtcccgaagagcttcagactgaactggttcctgctacaatctttgaaccagtttctcctataaaagaggctccagggacaacattcgttcctgttacagacctcgagcctgttacttttagaactgagatccctgcaacaaccttagctaccaaaacatcaaaaagaacccgccctccacgtcccagacctaaaactacaccgagccctcaggcacctgagaccaaacctgctcccaagcagacaccacgtgctcctcctaagccaaaaacatcaccacgcccaagaatcccacaaacacaaccagttcctaaggtgccccagcgtgttactgcaaaaccaaaaacgtcaccaagtccagaagtgtcatacaccacacctgctcctctagagacacgaggcatcccttttatacccatgatttccccaagtcctagtcaagaggaactacagaccactctgg

SEQ ID NO: 103321 - DNA, 922 bp, Homo sapiens
  Payload ID: 148
  Gene Symbol: ABI3BP
  Gene Name: ABI family, member 3 (NESH) binding protein
  ENST ID: ENST00000471901
  CDS Start-End: 1-922
atcccaaacctaaaaccacgccccatccagaagtacctcaaactaaactggctaccaaaacatcaaaaagaacccgccctccacgtcccagacctaaaactacaccgagccctcaggcacctgagaccaaacctgttcctgctacagtcctagaacctgtcactcttagacctgaggcctcaacaacattagcttccaaaacatcacaacggacacgtcgtccacgtctcagaacaaaaaccacaccacgtcctgaagcacctgaatccaaaccagttcctactgcggagctcaaacctgttacactcagaactgagacttgggtgacaacacaagctcccaagcagacaccacgtgctcctcctaagccaaaaacatcaccacgcccaagaatcccacaaacacaaccagttcctaaggtgccccagcgtgttactgcaaaaccaaaaacgtcaccaagtccagaagtgtcatacaccacacctgctccaaaagatgtgctccttcctcataaaccataccctgaggtctctcagagcgaacctgctcctctagagacacgaggcatcccttttatacccatgatttccccaagtcctagtcaagaggaactacagaccactctggaagaaacagaccaatccacccaagaacctttcacaactaagattccacgaacaactgaactagcaaagacaactcaggcgccacacagattttatactactgtgaggcccagaacatctgacaagccacacatcagacctgttctgaataggacaactacaagacctactaggcccaaacccagtgggatgcccagtgggaatggagtgggaacaggggtcaagcaagcacccaggccatcaggtgctgatagaaatgtatcagtggactctacccaccccactaaaaagccagg

SEQ ID NO: 103322 - DNA, 560 bp, Homo sapiens
  Payload ID: 148
  Gene Symbol: ABI3BP
  Gene Name: ABI family, member 3 (NESH) binding protein
  ENST ID: ENST00000466947
  CDS Start-End: 1-560
atttatttctctgaaacctaaaatccctctcagcccagaagtgacacacaccaaacctgctccaaaaacatcgcaacgaacaagaacacgtcgtccacgtcccaaacataaaaccacgccacgcccagagacactgcagaccaaactagactttggacctattactcctgggacatcttcagctccaacaacaacaacaaaaagaacccgtcgtccacatcccaaacctaaaaccacgccccatccagaagtacctcaaactaaactggctcccaagcagacaccacgtgctcctcctaagccaaaaacatcaccacgcccaagaatcccacaaacacaaccagttcctaaggtgccccagcgtgttactgcaaaaccaaaaacgtcaccaagtccagaagtgtcatacaccacacctgctccaaaagatgtgctccttcctcataaaccataccctgaggtctctcagagcgaacctgctcctctagagacacgaggcatcccttttatacccatgatttccccaagtcctagtcaagaggaactacagaccactctgg

SEQ ID NO: 103323 - DNA, 560 bp, Homo sapiens
  Payload ID: 148
  Gene Symbol: ABI3BP
  Gene Name: ABI family, member 3 (NESH) binding protein
  ENST ID: ENST00000483129
  CDS Start-End: 1-560
aaatgggaaaatccaaagtacctatgaccaagaccacacagtgccagcatatgtcccaaggaaactaatcccaataacaatcatcaagcaagtgattcagaatgttactcacaaggattcagctaaatccccagaaaaagctccactgggaggagtgatactagtccaccttattattccaggtcttaatgaaactactgtaaaacttcctgcatccctaatgtttgagatttcagatgcactcaagacacaattagctaagaatgaaaccttggcattacctgccgaatctaaaacaccagaggttgaaaaaatctcagcacgacccacaacagtgactcctgaaacagttccaagaagcactaaacccactacgtctagtgcattagatgtttcagaaacaacactggttctcagcaaaaggaccccggaaacattgcaaactattctaatacctcagtttgaattgccactgagcactctagcttcaagtgaaaagccatggattgtgcctacagctaaaatatctgaagattccaaagttctgcagcctcaaactg

SEQ ID NO: 103324 - DNA, 475 bp, Homo sapiens
  Payload ID: 148
  Gene Symbol: ABI3BP
  Gene Name: ABI family, member 3 (NESH) binding protein
  ENST ID: ENST00000482765
  CDS Start-End: 1-475
gtttctgatgttctggaatcggttacacttagtactgagtcaccaaaggagaccatagcaccagccaaaacagactatgtatatcccactgccaaagcaccactctggccagaggagccaaagactgaagttgtggaatctattacatatgtatctgaaccacctgagaccacactagaaacgtcgcctctgccttctcaatctataaccctacccagcccagatgagcctcagactgaacctgctcccaagcagacaccacgtgctcctcctaagccaaaaacatcaccacgcccaagaatcccacaaacacaaccagttcctaaggtgccccagcgtgttactgcaaaaccaaaaacgtcaccaagtccagaagtgtcatacaccacacctgctcctctagagacacgaggcatcccttttatacccatgatttccccaagtcctagtcaagaggaactacagaccactctgg

SEQ ID NO: 103325 - DNA, 3650 bp, Homo sapiens
  Payload ID: 148
  Gene Symbol: ABI3BP
  Gene Name: ABI family, member 3 (NESH) binding protein
  ENST ID: ENST00000495591
  CDS Start-End: 1-3395
ttatttctctgaaacctaaaatccctctcagcccagaagtgacacacaccaaacctgccccagaacctcagactctactgccatcacagtcaacaataggacctgaaacaccaggaaccaaaccttcaacaacattagctctggaacctgccacgatacaaccggagcccttggtgcccacaactgcctcaaaaccatctgagagacctaaaaccacacacagaccagatgcacctcaaattcagcctggttcaaaaccaccaaaacaattacttcctaaaccccaaaccacagcagaaccagacatgccaccaactaaatccgtctctgagcctgttccatttgaaactgaagctccctcaatgaccatagttcccaccacagacattgagcctgtaactgtgagaactgaggctacagtgacaacattagctccaaaaacatcgcaacgaacaagaacacgtcgtccacgtcccaaacataaaaccacgccacgcccagagacactgcagaccaaactagactttggacctattactcctgggacatcttcagctccaacaacaacaacaaaaagaacccgtcgtccacatcccaaacctaaaaccacgccccatccagaagtacctcaaactaaactggttcctgccacaatcctcgaaccagttcttagaactgaggcttcagggacaacagcagttcctgctacaatctttgaaccagtttctcctataaaagaggctccagggacaacattcgttcctgttacagacctcgagcctgttacttttagaactgagatccctgcaacaaccttagctaccaaaacatcaaaaagaacccgccctccacgtcccagacctaaaactacaccgagccctcaggcacctgagaccaaacctgttcctgctacagtcctagaacctgtcactcttagacctgaggcctcaacaacattagcttccaaaacatcacaacggacacgtcgtccacgtctcagaacaaaaaccacaccacgtcctgaagcacctgaatccaaaccagttcctactgcggagctcaaacctgttacactcagaactgagacttgggtgacaacacaagctcctaaaacatcacaacgaactcgtcgtccacgtcccaaaactaaaaccacaccaagtcctgaggttcctcaaaccaaactggttccttctacagatcttgaacctggtactctcagaactgaagctccaaaaaccatggttgttactacagtccttgaacctgacacttttagaaccaagtttccagaaacaacgttagctcctaaaacacaacggacacgtcgtccccgtcccagacccaaaactacatcaagtcctgaagtacctcagaacaaatcggtttctgttacaggctttgaacctgttgttcatagtactgatgctccaggaacaacatttgctctgactgaactgcaaactcttattttgaaaccagtgacatcaccaagcctagaaatgacagaaagtcaacctgtttctgatgttctggaatcggttacacttagtactgagtcaccaaaggagaccatagcaccagccaaaacagactatgtatatcccactgccaaagcaccactctggccagaggagccaaagactgaagttgtggaatctattacatatgtatctgaaccacctgagaccacactagaaacgtcgcctctgccttctcaatctataaccctacccagcccagatgagcctcagactgaacctgctcccaagcagacaccacgtgctcctcctaagccaaaaacatcaccacgcccaagaatcccacaaacacaaccagttcctaaggtgccccagcgtgttactgcaaaaccaaaaacgtcaccaagtccagaagtgtcatacaccacacctgctccaaaagatgtgctccttcctcataaaccataccctgaggtctctcagagcgaacctgctcctctagagacacgaggcatcccttttatacccatgatttccccaagtcctagtcaagaggaactacagaccactctggaagaaacagaccaatccacccaagaacctttcacaactaagattccacgaacaactgaactagcaaagacaactcaggcgccacacagattttatactactgtgaggcccagaacatctgacaagccacacatcagacctggggtcaagcaagcacccaggccatcaggtgctgatagaaatgtatcagtggactctacccaccccactaaaaagccagggactcgccgcccacccttgccacccagacctacacacccacgaagaaaacctttaccaccaaataatgtcactggaaagccaggaagtgcaggaatcatttcatcaggcccaataactacaccacccctgaggtcaacacccaggcctactggaactcccttggagagaatagagacagatataaagcaaccaacagttcctgcctctggagaagaactggaaaatataactgactttagctcaagcccaacaagagaaactgatcctcttgggaagccaagattcaaaggacctcatgtgcgatacatccaaaagcctgacaacagtccctgctccattactgactctgtcaaacggttccccaaagaggaggccacagaggggaatgccaccagcccaccacagaacccacccaccaacctcactgtggtcaccgtggaagggtgcccctcatttgtcatcttggactgggaaaagccactaaatgacactgtcactgaatatgaagttatatccagagaaaatgggtcattcagtgggaagaacaagtccattcaaatgacaaatcagacattttccacagtagaaaatctgaaaccaaacacgagttatgaattccaggtgaaacccaaaaacccgcttggtgaaggcccggtcagcaacacagtggcattcagtactgaatcagcggacccaagagtgagtgagccagtttctgcaggaagagatgccatctggactgaaagaccctttaattcagactcttactcagagtgtaagggcaaacaatatgtcaaaaggacatggtataaaaaatttgtaggagtgcagctgtgcaactctctcagatacaagatttacttgagcgactccctcacaggaaaattttataacataggtgatcagaggggccatggagaagatcactgccagtttgtggattcatttttagatggacgcactgggcagcaactcacttctgaccagttaccaatcaaagaaggttatttcagagcagttcgccaggaacctgtccaatttggagaaataggtggtcacacccaaatcaattatgttcagtggtatgaatgtgggactacaattcctggaaaatggtagatgctgcacaaagttaccttctgtttcatcattgcaaacaaaaatcattgaaaatactatgccgcattcatttaaagctattttgtttactatgtataaaagtctacaatctaattaatagcaatactagatgtttattattagaaaagattgctgagagtatttatcaggttttacaaagtcattttaagaaagcaagatactgatgttaacagaataacatttttggggaagctggctccctattcatggtat

SEQ ID NO: 103326 - DNA, 700 bp, Homo sapiens
  Payload ID: 148
  Gene Symbol: ABI3BP
  Gene Name: ABI family, member 3 (NESH) binding protein
  ENST ID: ENST00000486770
  CDS Start-End: 1-700
cagcgtgttactgcaaaaccaaaaacgtcaccaagtccagaagtgtcatacaccacacctgctccaaaagatgtgctccttcctcataaaccataccctgaggtctctcagagcgaacctgctcctctagagacacgaggcatcccttttatacccatgatttccccaagtcctagtcaagaggaactacagaccactctggcgccacacagattttatactactgtgaggcccagaacatctgacaagccacacatcagacctggggtcaagcaagcacccaggccatcaggtgctgatagaaatgtatcagtggactctacccaccccactaaaaagccagggactcgccgcccacccttgccacccagacctacacacccacgaagaaaacctttaccaccaaataatgtcactggaaagccaggaagtgcaggaatcatttcatcaggcccaataactacaccacccctgaggtcaacacccaggcctactggaactcccttggagagaatagagacagatataaagcaaccaacagttcctgcctctggagaagaactggaaaatataactgactttagctcaagcccaacaagagaaactgatcctcttgggaagccaagattcaaaggacctcatgtgcgatacatccaaaagcctgacaacagtccctgctccattactgactctgtcaaac

SEQ ID NO: 103327 - DNA, 6783 bp, Homo sapiens
  Payload ID: 148
  Gene Symbol: ABI3BP
  Gene Name: ABI family, member 3 (NESH) binding protein
  ENST ID: ENST00000471714
  CDS Start-End: 111-5444
gtgagtaagcccacggcacagctaagtgcagccgcccgcctctgtcactgggagacagtccacttaaatgcagctccagggttgcgaggcacccaccagcatcattccccatgcgaggtggcaaatgcaacatgctctccagtttggggtgtctacttctctgtggaagtattacactagccctgggaaatgcacagaaattgccaaaaggtaaaaggccaaacctcaaagtccacatcaataccacaagtgactccatcctcttgaagttcttgcgtccaagtccaaatgtaaagcttgaaggtcttctcctgggatatggcagcaatgtatcaccaaaccagtacttccctcttcccgctgaagggaaattcacagaagctatagttgatgcagagccgaaatatctgatagttgtgcgacctgctccacctccaagtcaaaagaagtcatgttcaggtaaaactcgttctcgcaaacctctgcagctggtggttggcactctgacaccgagctcggtcttcctgtcctggggtttcctcatcaacccacaccatgactggacattgccaagtcactgtcccaatgacagattttatacaattcgctatcgagaaaaggataaagaaaagaagtggatttttcaaatctgtccagccactgaaacaattgtggaaaacctaaagcccaacacagtttatgaatttggagtgaaagacaatgtggaaggtggaatttggagtaagattttcaatcacaagactgttgttggaagtaaaaaagtaaatgggaaaatccaaagtacctatgaccaagaccacacagtgccagcatatgtcccaaggaaactaatcccaataacaatcatcaagcaagtgattcagaatgttactcacaaggattcagctaaatccccagaaaaagctccactgggaggagtgatactagtccaccttattattccaggtcttaatgaaactactgtaaaacttcctgcatccctaatgtttgagatttcagatgcactcaagacacaattagctaagaatgaaaccttggcattacctgccgaatctaaaacaccagaggttgaaaaaatctcagcacgacccacaacagtgactcctgaaacagttccaagaagcactaaacccactacgtctagtgcattagatgtttcagaaacaacactggttctcagcaaaaggaccccggaaacattgcaaactattctaatacctcagtttgaattgccactgagcactctagctccaaaaagccttccagaatttcctgaggcaaaaacacccttcccttttgagaaacctaggggcacattggcttcaagtgaaaagccatggattgtgcctacagctaaaatatctgaagattccaaagttctgcagcctcaaactgcaacttatgatgttttctcaagccctacaacatcagatgagcctgagatatcagattcctacacagcaacaagtgatcgtattctggattctatcccacctaaaacttctagaactcttgaacagccaagggcaacactggctccaagtgaaacaccatttgttcctcaaaaactggaaatctttaccagtccagaaatgcagcctacgacacctgctccccagcaaactacatctatcccttctacacctaaacgacgcccccggcccaaaccgccaagaaccaaacctgaaagaaccacaagtgccggaacaattacacctaaaatttctaaaagccctgaacctacatggacaacaccggctcccggtaaaacacaatttatttctctgaaacctaaaatccctctcagcccagaagtgacacacaccaaacctgccccagaacctcagactctactgccatcacagtcaacaataggacctgaaacaccaggaaccaaaccttcaacaacattagcaccacgaaagaccaaaagaccaggtcgtcgcccccgcccccgtccccgccctaaaaccacacctagtccagaagtgcccaagtccaaacccgctctggaacctgccacgatacaaccggagcccttggtgcccacaactgcctcaaaaccatctgagagacctaaaaccacacacagaccagatgcacctcaaattcagcctggttcaaaaccaccaaaacaattacttcctaaaccccaaaccacagcagaaccagacatgccaccaactaaatccgtctctgagcctgttccatttgaaactgaagctccctcaatgaccatagttcccaccacagacattgagcctgtaactgtgagaactgaggctacagtgacaacattagctccaaaaacatcgcaacgaacaagaacacgtcgtccacgtcccaaacataaaaccacgccacgcccagagacactgcagaccaaactagactttggacctattactcctgggacatcttcagctccaacaacaacaacaaaaagaacccgtcgtccacatcccaaacctaaaaccacgccccatccagaagtacctcaaactaaactggttcctgccacaatcctcgaaccagttcttagaactgaggcttcagggacaacagcagctcccaaagtgcctcaacgaactcatcgtccacatcccaaacctaaaaccacactgagtcccgaagagcttcagactgaactggttcctgctacaatctttgaaccagtttctcctataaaagaggctccagggacaacattcgttcctgttacagacctcgagcctgttacttttagaactgagatccctgcaacaaccttagctaccaaaacatcaaaaagaacccgccctccacgtcccagacctaaaactacaccgagccctcaggcacctgagaccaaacctgttcctgctacagtcctagaacctgtcactcttagacctgaggcctcaacaacattagcttccaaaacatcacaacggacacgtcgtccacgtctcagaacaaaaaccacaccacgtcctgaagcacctgaatccaaaccagttcctactgcggagctcaaacctgttacactcagaactgagacttgggtgacaacacaagctcctaaaacatcacaacgaactcgtcgtccacgtcccaaaactaaaaccacaccaagtcctgaggttcctcaaaccaaactggttccttctacagatcttgaacctggtactctcagaactgaagctccaaaaaccatggttgttactacagtccttgaacctgacacttttagaaccaagtttccagaaacaacgttagctcctaaaacacaacggacacgtcgtccccgtcccagacccaaaactacatcaagtcctgaagtacctcagaacaaatcggtttctgttacaggctttgaacctgttgttcatagtactgatgctccaggaacaacatttgctctgactgaactgcaaactcttattttgaaaccagtgacatcaccaagcctagaaatgacagaaagtcaacctgtttctgatgttctggaatcggttacacttagtactgagtcaccaaaggagaccatagcaccagccaaaacagactatgtatatcccactgccaaagcaccactctggccagaggagccaaagactgaagttgtggaatctattacatatgtatctgaaccacctgagaccacactagaaacgtcgcctctgccttctcaatctataaccctacccagcccagatgagcctcagactgaacctgctcccaagcagacaccacgtgctcctcctaagccaaaaacatcaccacgcccaagaatcccacaaacacaaccagttcctaaggtgccccagcgtgttactgcaaaaccaaaaacgtcaccaagtccagaagtgtcatacaccacacctgctccaaaagatgtgctccttcctcataaaccataccctgaggtctctcagagcgaacctgctcctctagagacacgaggcatcccttttatacccatgatttccccaagtcctagtcaagaggaactacagaccactctggaagaaacagaccaatccacccaagaacctttcacaactaagattccacgaacaactgaactagcaaagacaactcaggcgccacacagattttatactactgtgaggcccagaacatctgacaagccacacatcagacctgttctgaataggacaactacaagacctactaggcccaaacccagtgggatgcccagtgggaatggagtgggaacaggggtcaagcaagcacccaggccatcaggtgctgatagaaatgtatcagtggactctacccaccccactaaaaagccagggactcgccgcccacccttgccacccagacctacacacccacgaagaaaacctttaccaccaaataatgtcactggaaagccaggaagtgcaggaatcatttcatcaggcccaataactacaccacccctgaggtcaacacccaggcctactggaactcccttggagagaatagagacagatataaagcaaccaacagttcctgcctctggagaagaactggaaaatataactgactttagctcaagcccaacaagagaaactgatcctcttgggaagccaagattcaaaggacctcatgtgcgatacatccaaaagcctgacaacagtccctgctccattactgactctgtcaaacggttccccaaagaggaggccacagaggggaatgccaccagcccaccacagaacccacccaccaacctcactgtggtcaccgtggaagggtgcccctcatttgtcatcttggactgggaaaagccactaaatgacactgtcactgaatatgaagttatatccagagaaaatgggtcattcagtgggaagaacaagtccattcaaatgacaaatcagacattttccacagtagaaaatctgaaaccaaacacgagttatgaattccaggtgaaacccaaaaacccgcttggtgaaggcccggtcagcaacacagtggcattcagtactgaatcagcggacccaagagtgagtgagccagtttctgcaggaagagatgccatctggactgaaagaccctttaattcagactcttactcagagtgtaagggcaaacaatatgtcaaaaggacatggtataaaaaatttgtaggagtgcagctgtgcaactctctcagatacaagatttacttgagcgactccctcacaggaaaattttataacataggtgatcagaggggccatggagaagatcactgccagtttgtggattcatttttagatggacgcactgggcagcaactcacttctgaccagttaccaatcaaagaaggttatttcagagcagttcgccaggaacctgtccaatttggagaaataggtggtcacacccaaatcaattatgttcagtggtatgaatgtgggactacaattcctggaaaatggtagatgctgcacaaagttaccttctgtttcatcattgcaaacaaaaatcattgaaaatactatgccgcattcatttaaagctattttgtttactatgtataaaagtctacaatctaattaatagcaatactagatgtttattattagaaaagattgctgagagtatttatcaggttttacaaagtcattttaagaaagcaagatactgatgttaacagaataacatttttggggaagctggctccctattcatggtattttaagagatcatttgtatattatttatcacactgttgtaatgatgttttgagatacttttataacaaaattaacatcaaaaaggtatatactttttaaaaaaaatttacttttattgatgtgtactcttcctattgatgagttaattccataaatctctacttagtttaacttattggatcaaattatcttcagcatgtatatctggggaaaaaaggtccgaattttcacatttatatttaaacttcaattttttatatttaaacttcaattttttagcaacagctgaatagctttgcggaggagtttaatagttacacattcatgctaatatacatttcctttaaacatccacaaattcttaaaaagattgaatcagtaaatttcatttcagctaaaaatggagtctaatatattgtttcaaaagatacatttttacccaccataaatgttacaatatctgaatatgctttgtcaaactatccctttatgcaatcgtcttcatattgtttttatgattctaatcaagctgtatgtagagactgaatgtgaagtcaagtctgagcacaaaaagataatgcacgatgagattgcctaccattttataggatatttactatgtatttatacgttaagacctctatgaatgaatgtatcagagaatgtctttgtaactgtttaattcaatctgtaataaaaatctaactaactaactcatttatttctattaaaaaggtattgtcctttaggcggggaatgggaatccttgctgcactgttgcagtcattctgaaaggacctttccctgtacttacctttcaacatgcttcaatcttatcaacgctacattttgtatttttcaaacaagtataaattctgcaataaagagatgtagtttttttttaagattgagtttttgtttgttatttctgaatggttcatcagtatgttaactataccttttatcgagaaggaaaatcactaagttttattcaggctctaccaacccccattatatctactgtttgtttatgtcctaaattaacctttcatcctatgaagtaataaagttcattttaaaccaa

SEQ ID NO: 103328 - DNA, 566 bp, Homo sapiens
  Payload ID: 148
  Gene Symbol: ABI3BP
  Gene Name: ABI family, member 3 (NESH) binding protein
  ENST ID: ENST00000497395
  CDS Start-End: 1-566
tactgcaaaaccaaaaacgtcaccaagtccagaagtgtcatacaccacacctgctcctctagagacacgaggcatcccttttatacccatgatttccccaagtcctagtcaagaggaactacagaccactctggaagaaacagaccaatccacccaagaacctttcacaactaagattccacgaacaactgaactagcaaagacaactcaggcgccacacagattttatactactgtgaggcccagaacatctgacaagccacacatcagacctgttctgaataggacaactacaagacctactaggcccaaacccagtgggatgcccagtgggaatggagtgggaacaggggtcaagcaagcacccaggccatcaggtgctgatagaaatgtatcagtggactctacccaccccactaaaaagccagggactcgccgcccacccttgccacccagacctacacacccacgaagaaaacctttaccaccaaataatgtcactggaaagccaggaagtgcaggaatcatttcatcaggcccaataactacaccacccctgaggtcaa

SEQ ID NO: 103329 - DNA, 453 bp, Homo sapiens
  Payload ID: 148
  Gene Symbol: ABI3BP
  Gene Name: ABI family, member 3 (NESH) binding protein
  ENST ID: ENST00000527943
  CDS Start-End: 1-453
ttgtggaatctattacatatgtatctgaaccacctgagaccacactagaaacgtcgcctctgccttctcaatctataaccctacccagcccagatgagcctcagactgaacctgctcccaagcagacaccacgtgctcctcctaagccaaaaacatcaccacgcccaagaatcccacaaacacaaccagttcctaaggtgccccagcgtgttactgcaaaaccaaaaacgtcaccaagtccagaagtgtcatacaccacacctgctccaaaagatgtgctccttcctcataaaccataccctgaggtctctcagagcgaacctgttctgcagcctgttacctttagatttgagccaccaaagacaacaatagctcctctagagacacgaggcatcccttttatacccatgatttccccaagtcctagtcaagaggaactacagaccactctgg

SEQ ID NO: 103330 - DNA, 375 bp, Homo sapiens
  Payload ID: 148
  Gene Symbol: ABI3BP
  Gene Name: ABI family, member 3 (NESH) binding protein
  ENST ID: ENST00000528305
  CDS Start-End: 1-375
ctaagaatgaaaccttggcattacctgccgaatctaaaacaccagaggttgaaaaaatctcagcacgacccacaacagtgactcctgaaacagttccaagaagcactaaacccactacgtctagtgcattagatgtttcagaaacaacactggctccaaaaagccttccagaatttcctgaggcaaaaacacccttcccttttgagaaacctaggggcacattggcttcaagtgaaaagccatggattgtgcctacagctaaaatatctgaagattccaaagttctgcagcctcaaactgctctgactgaactgcaaactcttattttgaaaccagtgacatcaccaagcctagaaatgacagaaagtcaacctg

SEQ ID NO: 103331 - DNA, 563 bp, Homo sapiens
  Payload ID: 148
  Gene Symbol: ABI3BP
  Gene Name: ABI family, member 3 (NESH) binding protein
  ENST ID: ENST00000533795
  CDS Start-End: 1-563
ccacgaaagaccaaaagaccaggtcgtcgcccccgcccccgtccccgccctaaaaccacacctagtccagaagtgcccaagtccaaacccgctctggaacctgccacgatacaaccggagcccttggtgcccacaactgcctcaaaaccatctgagagacctaaaaccacacacagaccagatgcacctcaaattcagcctgtctctgagcctgttccatttgaaactgaagctccctcaatgaccatagttcccaccacagacattgagcctgtaactgtgagaactgaggctacagtgacaacattagctccaaaaacatcgcaacgaacaagaacacgtcgtccacgtcccaaacataaaaccacgccacgcccagagacactgcagaccaaactagactttggacctattactcctgggacatcttcagctccaacaacaacaacaaaaagaacccgtcgtccacatcccaaacctaaaaccacgccccatccagaagtacctcaaactaaactggctcccaagcagacaccacgtgctcctcctaagccaaaaacatc

SEQ ID NO: 103332 - DNA, 3714 bp, Homo sapiens
  Payload ID: 148
  Gene Symbol: ABI3BP
  Gene Name: ABI family, member 3 (NESH) binding protein
  ENST ID: ENST00000495063
  CDS Start-End: 49-3066
cttaaatgcagctccagggttgcgaggcacccaccagcatcattccccatgcgaggtggcaaatgcaacatgctctccagtttggggtgtctacttctctgtggaagtattacactagccctgggaaatgcacagaaattgccaaaaggtaaaaggccaaacctcaaagtccacatcaataccacaagtgactccatcctcttgaagttcttgcgtccaagtccaaatgtaaagcttgaaggtcttctcctgggatatggcagcaatgtatcaccaaaccagtacttccctcttcccgctgaagggaaattcacagaagctatagttgatgcagagccgaaatatctgatagttgtgcgacctgctccacctccaagtcaaaagaagtcatgttcaggtaaaactcgttctcgcaaacctctgcagctggtggttggcactctgacaccgagctcggtcttcctgtcctggggtttcctcatcaacccacaccatgactggacattgccaagtcactgtcccaatgacagattttatacaattcgctatcgagaaaaggataaagaaaagaagtggatttttcaaatctgtccagccactgaaacaattgtggaaaacctaaagcccaacacagtttatgaatttggagtgaaagacaatgtggaaggtggaatttggagtaagattttcaatcacaagactgttgttggaagtaaaaaagtaaatgggaaaatccaaagtacctatgaccaagaccacacagtgccagcatatgtcccaaggaaactaatcccaataacaatcatcaagcaagtgattcagaatgttactcacaaggattcagctaaatccccagaaaaagctccactgggaggagtgatactagtccaccttattattccaggtcttaatgaaactactgtaaaacttcctgcatccctaatgtttgagatttcagatgcactcaagacacaattagctaagaatgaaaccttggcattacctgccgaatctaaaacaccagaggttgaaaaaatctcagcacgacccacaacagtgactcctgaaacagttccaagaagcactaaacccactacgtctagtgcattagatgtttcagaaacaacactggttctcagcaaaaggaccccggaaacattgcaaactattctaatacctcagtttgaattgccactgagcactctagctccaaaaagccttccagaatttcctgaggcaaaaacacccttcccttttgagaaacctaggggcacattggcttcaagtgaaaagccatggattgtgcctacagctaaaatatctgaagattccaaagttctgcagcctcaaactgcaacttatgatgttttctcaagccctacaacatcagatgagcctgagatatcagattcctacacagcaacaagtgatcgtattctggattctatcccacctaaaacttctagaactcttgaacagccaagggcaacactggctccaagtgaaacaccatttgttcctcaaaaactggaaatctttaccagtccagaaatgcagcctacgacacctgctccccagcaaactacatctatcccttctacacctaaacgacgcccccggcccaaaccgccaagaaccaaacctgaaagaaccacaagtgccggaacaattacacctaaaatttctaaaagccctgaacctacatggacaacaccggctcccggtaaaacacaatttatttctctgaaacctaaaatccctctcagcccagaagtgacacacaccaaacctgccccagaacctcagactctactgccatcacagtcaacaataggacctgaaacaccaggaaccaaaccttcaacaacattagcaccacgaaagaccaaaagaccaggtcgtcgcccccgcccccgtccccgccctaaaaccacacctagtccagaagtgcccaagtccaaacccgctctggaacctgccacgatacaaccggagcccttggtgcccacaactgcctcaaaaccatctgagagacctaaaaccacacacagaccagatgcacctcaaattcagcctggttcaaaaccaccaaaacaattacttcctaaaccccaaaccacagcagaaccagacatgccaccaactaaatccgtctctgagcctgttccatttgaaactgaagctccctcaatgaccatagttcccaccacagacattgagcctgtaactgtgagaactgaggctacagtgacaacattagctccaaaaacatcgcaacgaacaagaacacgtcgtccacgtcccaaacataaaaccacgccacgcccagagacactgcagaccaaactagactttggacctattactcctgggacatcttcagctccaacaacaacaacaaaaagaacccgtcgtccacatcccaaacctaaaaccacgccccatccagaagtacctcaaactaaactggctaccaaaacatcaaaaagaacccgccctccacgtcccagacctaaaactacaccgagccctcaggcacctgagaccaaacctgttcctgctacagtcctagaacctgtcactcttagacctgaggcctcaacaacattagcttccaaaacatcacaacggacacgtcgtccacgtctcagaacaaaaaccacaccacgtcctgaagcacctgaatccaaaccagttcctactgcggagctcaaacctgttacactcagaactgagacttgggtgacaacacaagctcctaaaacatcacaacgaactcgtcgtccacgtcccaaaactaaaaccacaccaagtcctgaggttcctcaaaccaaactggttccttctacagatcttgaacctggtactctcagaactgaagctccaaaaaccatggttgttactacagtccttgaacctgacacttttagaaccaagtttccagaaacaacgttagctcctaaaacacaacggacacgtcgtccccgtcccagacccaaaactacatcaagtcctgaagtacctcagaacaaatcgggtaaatgtatgaatccttggcttaagtagccaaggaacctgaaccctggcaggctgtcccaataaagtcctaaagaaatgcctatgacgggaagtaacagtcatcatgttttctaagaatcaaattatttaacatgggtagcaactgcttctcgtacagagctatccaggagaacatggcttggagccacttgtgtgcctgatctcctaaatgacttggtttggatgacgttcttggtccctctttaaagatgtgtttacagcgagattagcatactcatgggtatttattgctatatctgcattgaaacatgtgatccatttgttatgattacataaacaggcatttattttcaacttccaagaaaagcaacaagttactttcatatatatttctctctgtattttcgtatctgttgcctaaacaaatttccaaagccaaatatccatactagttagaaaaccaaatacctaggaaaacctcatgtggataatatcaagatatgtaacagagttcaaaggttgtaactaccttctttgatgaattgttctagctagtgtggccaaatcttccaaaagcaactatatgctgcctatcaattcaaaagttttaaaaaattgtgtatcatttgaaactcatgttttaaaataaaaattgaggattttttttaaaaagtc

SEQ ID NO: 103333 - DNA, 553 bp, Homo sapiens
  Payload ID: 148
  Gene Symbol: ABI3BP
  Gene Name: ABI family, member 3 (NESH) binding protein
  ENST ID: ENST00000530236
  CDS Start-End: 17-199
accagcatcattccccatgcgaggtggcaaatgcaacatgctctccagtttggggtgtctacttctctgtggaagtattacactagccctgggaaatgcacagaaattgccaaaagcaaataaaaggactgaactagtgatacagcatggatggatgagtctcataaaaatgatgctgaatgaaagaagccaggtgtgaagagaacatgtcatgtaaaaggccaaacctcaaagtccacatcaataccacaagtgactccatcctcttgaagttcttgcgtccaagtccaaatgtaaagcttgaaggtcttctcctgggatatggcagcaatgtatcaccaaaccagtacttccctcttcccgctgaagggaaattcacagaagctatagttgatgcagagccgaaatatctgatagttgtgcgacctgctccacctccaagtcaaaagaagtcatgttcaggtaaaactcgttctcgcaaacctctgcagctggtggttggcactctgacaccgagctcggtcttcctgtcctggggtttcctcatcaaccc

SEQ ID NO: 103334 - DNA, 261 bp, Homo sapiens
  Payload ID: 148
  Gene Symbol: ABI3BP
  Gene Name: ABI family, member 3 (NESH) binding protein
  ENST ID: ENST00000534256
  CDS Start-End: 1-261
ctcagactctactgccatcacagtcaacaataggacctgaaacaccaggaaccaaaccttcaacaacattagcaccacgaaagaccaaaagaccaggtcgtcgcccccgcccccgtccccgccctaaaaccacacctagtccagaagtgcccaagtccaaacccgctctggaacctgccacgatacaaccggagcccttggtgcccacaactgtctctgagcctgttccatttgaaactgaagctccctcaatgaccatag

SEQ ID NO: 103335 - DNA, 573 bp, Homo sapiens
  Payload ID: 148
  Gene Symbol: ABI3BP
  Gene Name: ABI family, member 3 (NESH) binding protein
  ENST ID: ENST00000527258
  CDS Start-End: 1-573
tgcattgttgttctgtggtacggctggctgcacttttatgcagagccgaaatatctgatagttgtgcgacctgctccacctccaagtcaaaagaagtcatgttcaggtaaaactcgttctcgcaaacctctgcagctggtggttggcactctgacaccgagctcggtcttcctgtcctggggtttcctcatcaacccacaccatgactggacattgccaagtcactgtcccaatgacagattttatacaattcgctatcgagaaaaggataaagaaaagaagtggatttttcaaatctgtccagccactgaaacaattgtggaaaacctaaagcccaacacagtttatgaatttggagtgaaagacaatgtggaaggtggaatttggagtaagattttcaatcacaagactgttgttggaagtaaaaaagtaaatgggaaaatccaaagtacctatgaccaagaccacacagtgccagcatatgtcccaaggaaactaatcccaataacaatcatcaagcaagtgattcagaatgttactcacaaggattcagctaaatccccagaaaaagct

SEQ ID NO: 103336 - DNA, 561 bp, Homo sapiens
  Payload ID: 148
  Gene Symbol: ABI3BP
  Gene Name: ABI family, member 3 (NESH) binding protein
  ENST ID: ENST00000528490
  CDS Start-End: 1-561
aaagaaccacaagtgccggaacaattacacctaaaatttctaaaagccctgaacctacatggacaacaccggctcccggtaaaacacaatttatttctctgaaacctaaaatccctctcagcccagaagtgacacacaccaaacctgttcccaccacagacattgagcctgtaactgtgagaactgaggctacagtgacaacattagctccaaaaacatcgcaacgaacaagaacacgtcgtccacgtcccaaacataaaaccacgccacgcccagagacactgcagaccaaactagactttggacctattactcctgggacatcttcagctccaacaacaacaacaaaaagaacccgtcgtccacatcccaaacctaaaaccacgccccatccagaagtacctcaaactaaactggctcccaaagtgcctcaacgaactcatcgtccacatcccaaacctaaaaccacactgagtcccgaagagcttcagactgaactggttcctgctacaatctttgaaccagtttctcctataaaagaggctccagggacaacattcg

SEQ ID NO: 103337 - DNA, 571 bp, Homo sapiens
  Payload ID: 148
  Gene Symbol: ABI3BP
  Gene Name: ABI family, member 3 (NESH) binding protein
  ENST ID: ENST00000530539
  CDS Start-End: 88-571
aagtgcagccgcccgcctctgtcactgggagacagtccacttaaatgcagctccagggttgcgaggcacccaccagcatcattccccatgcgaggtggcaaatgcaacatgctctccagtttggggtgtctacttctctgtggaagtattacactagccctgggaaatgcacagaaattgccaaaagatgcagagccgaaatatctgatagttgtgcgacctgctccacctccaagtcaaaagaagtcatgttcaggtaaaactcgttctcgcaaacctctgcagctggtggttggcactctgacaccgagctcggtcttcctgtcctggggtttcctcatcaacccacaccatgactggacattgccaagtcactgtcccaatgacagattttatacaattcgctatcgagaaaaggataaagaaaagaagtggatttttcaaatctgtccagccactgaaacaattgtggaaaacctaaagcccaacacagtttatgaatttggagtgaaagacaatgtggaaggtggaatttggagtaagattttcaatcacaagactgttgttggaa

SEQ ID NO: 103338 - DNA, 910 bp, Homo sapiens
  Payload ID: 148
  Gene Symbol: ABI3BP
  Gene Name: ABI family, member 3 (NESH) binding protein
  ENST ID: ENST00000533855
  CDS Start-End: 1-910
aaacaccagaggttgaaaaaatctcagcacgacccacaacagtgactcctgaaacagttccaagaagcactaaacccactacgtctagtgcattagatgtttcagaaacaacactggcttcaagtgaaaagccatggattgtgcctacagctaaaatatctgaagattccaaagttctgcagcctcaaactgcaacttatgatgttttctcaagccctacaacatcagatgagcctgagatatcagattcctacacagcaacaagtgatcgtattctggattctatcccacctaaaacttctagaactcttgaacagccaagggcaacactggctccaagtgaaacaccatttgttcctcaaaaactggaaatctttaccagtccagaaatgcagcctacgacacctgctccccagcaaactacatctatcccttctacacctaaacgacgcccccggcccaaaccgccaagaaccaaacctgaaagaaccacaagtgccggaacaattacacctaaaatttctaaaagccctgaacctacatggacaacaccggctcccggtaaaacacaatttatttctctgaaacctaaaatccctctcagcccagaagtgacacacaccaaacctgccccagaacctcagactctactgccatcacagtcaacaataggacctgaaacaccaggaaccaaaccttcaacaacattagcaccacgaaagaccaaaagaccaggtcgtcgcccccgcccccgtccccgccctaaaaccacacctagtccagaagtgcccaagtccaaacccgctctggaacctgccacgatacaaccggagcccttggtgcccacaactgcctcaaaaccatctgagagacctaaaaccacacacagaccagatgcacctcaaattca

SEQ ID NO: 103339 - DNA, 450 bp, Homo sapiens
  Payload ID: 148
  Gene Symbol: ABI3BP
  Gene Name: ABI family, member 3 (NESH) binding protein
  ENST ID: ENST00000534413
  CDS Start-End: 1-450
gacctgaaacaccaggaaccaaaccttcaacaacattagcaccacgaaagaccaaaagaccaggtcgtcgcccccgcccccgtccccgccctaaaaccacacctagtccagaagtgcccaagtccaaacccgctctggaacctgccacgatacaaccggagcccttggtgcccacaactgttcccaccacagacattgagcctgtaactgtgagaactgaggctacagtgacaacattagctccaaaaacatcgcaacgaacaagaacacgtcgtccacgtcccaaacataaaaccacgccacgcccagagacactgcagaccaaactagactttggacctattactcctgggacatcttcagctccaacaacaacaacaaaaagaacccgtcgtccacatcccaaacctaaaaccacgccccatccagaagtacctcaaactaaactgg

SEQ ID NO: 103340 - DNA, 5766 bp, Homo sapiens
  Payload ID: 149
  Gene Symbol: ABL1
  Gene Name: ABL proto-oncogene 1, non-receptor tyrosine kinase
  Uniprot ID: P00519
  ENST ID: ENST00000318560
  CDS Start-End: 382-3774
ggccttccccctgcgaggatcgccattggcccgggttggctttggaaagcggcggtggctttgggccgggctcggcctcgggaacgccaggggcccctgggtgcggacgggcgcggccaggagggggttaaggcgcaggcggcggcggggcgggggcgggcctggcgggcgccctctccgggccctttgttaacaggcgcgtcccggccaggcggagacgcggccgcggccatgggcgggcgcgggcgcgcggggcggcggtgagggcggctggcggggccgggggcgccgggggggcgcgcgggccgagccgggcctgagccgggcccgcggaccgagctgggagaggggttccggcccccgacgtgctggcgcgggaaaatgttggagatctgcctgaagctggtgggctgcaaatccaagaaggggctgtcctcgtcctccagctgttatctggaagaagcccttcagcggccagtagcatctgactttgagcctcagggtctgagtgaagccgctcgttggaactccaaggaaaaccttctcgctggacccagtgaaaatgaccccaaccttttcgttgcactgtatgattttgtggccagtggagataacactctaagcataactaaaggtgaaaagctccgggtcttaggctataatcacaatggggaatggtgtgaagcccaaaccaaaaatggccaaggctgggtcccaagcaactacatcacgccagtcaacagtctggagaaacactcctggtaccatgggcctgtgtcccgcaatgccgctgagtatctgctgagcagcgggatcaatggcagcttcttggtgcgtgagagtgagagcagtcctggccagaggtccatctcgctgagatacgaagggagggtgtaccattacaggatcaacactgcttctgatggcaagctctacgtctcctccgagagccgcttcaacaccctggccgagttggttcatcatcattcaacggtggccgacgggctcatcaccacgctccattatccagccccaaagcgcaacaagcccactgtctatggtgtgtcccccaactacgacaagtgggagatggaacgcacggacatcaccatgaagcacaagctgggcgggggccagtacggggaggtgtacgagggcgtgtggaagaaatacagcctgacggtggccgtgaagaccttgaaggaggacaccatggaggtggaagagttcttgaaagaagctgcagtcatgaaagagatcaaacaccctaacctggtgcagctccttggggtctgcacccgggagcccccgttctatatcatcactgagttcatgacctacgggaacctcctggactacctgagggagtgcaaccggcaggaggtgaacgccgtggtgctgctgtacatggccactcagatctcgtcagccatggagtacctggagaagaaaaacttcatccacagagatcttgctgcccgaaactgcctggtaggggagaaccacttggtgaaggtagctgattttggcctgagcaggttgatgacaggggacacctacacagcccatgctggagccaagttccccatcaaatggactgcacccgagagcctggcctacaacaagttctccatcaagtccgacgtctgggcatttggagtattgctttgggaaattgctacctatggcatgtccccttacccgggaattgacctgtcccaggtgtatgagctgctagagaaggactaccgcatggagcgcccagaaggctgcccagagaaggtctatgaactcatgcgagcatgttggcagtggaatccctctgaccggccctcctttgctgaaatccaccaagcctttgaaacaatgttccaggaatccagtatctcagacgaagtggaaaaggagctggggaaacaaggcgtccgtggggctgtgagtaccttgctgcaggccccagagctgcccaccaagacgaggacctccaggagagctgcagagcacagagacaccactgacgtgcctgagatgcctcactccaagggccagggagagagcgatcctctggaccatgagcctgccgtgtctccattgctccctcgaaaagagcgaggtcccccggagggcggcctgaatgaagatgagcgccttctccccaaagacaaaaagaccaacttgttcagcgccttgatcaagaagaagaagaagacagccccaacccctcccaaacgcagcagctccttccgggagatggacggccagccggagcgcagaggggccggcgaggaagagggccgagacatcagcaacggggcactggctttcacccccttggacacagctgacccagccaagtccccaaagcccagcaatggggctggggtccccaatggagccctccgggagtccgggggctcaggcttccggtctccccacctgtggaagaagtccagcacgctgaccagcagccgcctagccaccggcgaggaggagggcggtggcagctccagcaagcgcttcctgcgctcttgctccgcctcctgcgttccccatggggccaaggacacggagtggaggtcagtcacgctgcctcgggacttgcagtccacgggaagacagtttgactcgtccacatttggagggcacaaaagtgagaagccggctctgcctcggaagagggcaggggagaacaggtctgaccaggtgacccgaggcacagtaacgcctccccccaggctggtgaaaaagaatgaggaagctgctgatgaggtcttcaaagacatcatggagtccagcccgggctccagcccgcccaacctgactccaaaacccctccggcggcaggtcaccgtggcccctgcctcgggcctcccccacaaggaagaagctggaaagggcagtgccttagggacccctgctgcagctgagccagtgacccccaccagcaaagcaggctcaggtgcaccagggggcaccagcaagggccccgccgaggagtccagagtgaggaggcacaagcactcctctgagtcgccagggagggacaaggggaaattgtccaggctcaaacctgccccgccgcccccaccagcagcctctgcagggaaggctggaggaaagccctcgcagagcccgagccaggaggcggccggggaggcagtcctgggcgcaaagacaaaagccacgagtctggttgatgctgtgaacagtgacgctgccaagcccagccagccgggagagggcctcaaaaagcccgtgctcccggccactccaaagccacagtccgccaagccgtcggggacccccatcagcccagcccccgttccctccacgttgccatcagcatcctcggccctggcaggggaccagccgtcttccaccgccttcatccctctcatatcaacccgagtgtctcttcggaaaacccgccagcctccagagcggatcgccagcggcgccatcaccaagggcgtggtcctggacagcaccgaggcgctgtgcctcgccatctctaggaactccgagcagatggccagccacagcgcagtgctggaggccggcaaaaacctctacacgttctgcgtgagctatgtggattccatccagcaaatgaggaacaagtttgccttccgagaggccatcaacaaactggagaataatctccgggagcttcagatctgcccggcgacagcaggcagtggtccagcggccactcaggacttcagcaagctcctcagttcggtgaaggaaatcagtgacatagtgcagaggtagcagcagtcaggggtcaggtgtcaggcccgtcggagctgcctgcagcacatgcgggctcgcccatacccgtgacagtggctgacaagggactagtgagtcagcaccttggcccaggagctctgcgccaggcagagctgagggccctgtggagtccagctctactacctacgtttgcaccgcctgccctcccgcaccttcctcctccccgctccgtctctgtcctcgaattttatctgtggagttcctgctccgtggactgcagtcggcatgccaggacccgccagccccgctcccacctagtgccccagactgagctctccaggccaggtgggaacggctgatgtggactgtctttttcatttttttctctctggagcccctcctcccccggctgggcctccttcttccacttctccaagaatggaagcctgaactgaggccttgtgtgtcaggccctctgcctgcactccctggccttgcccgtcgtgtgctgaagacatgtttcaagaaccgcatttcgggaagggcatgcacgggcatgcacacggctggtcactctgccctctgctgctgcccggggtggggtgcactcgccatttcctcacgtgcaggacagctcttgatttgggtggaaaacagggtgctaaagccaaccagcctttgggtcctgggcaggtgggagctgaaaaggatcgaggcatggggcatgtcctttccatctgtccacatccccagagcccagctcttgctctcttgtgacgtgcactgtgaatcctggcaagaaagcttgagtctcaagggtggcaggtcactgtcactgccgacatccctcccccagcagaatggaggcaggggacaagggaggcagtggctagtggggtgaacagctggtgccaaatagccccagactgggcccaggcaggtctgcaagggcccagagtgaaccgtcctttcacacatctgggtgccctgaaagggcccttcccctcccccactcctctaagacaaagtagattcttacaaggccctttcctttggaacaagacagccttcacttttctgagttcttgaagcatttcaaagccctgcctctgtgtagccgccctgagagagaatagagctgccactgggcacctgcgcacaggtgggaggaaagggcctggccagtcctggtcctggctgcactcttgaactgggcgaatgtcttatttaattaccgtgagtgacatagcctcatgttctgtgggggtcatcagggagggttaggaaaaccacaaacggagcccctgaaagcctcacgtatttcacagagcacgcctgccatcttctccccgaggctgccccaggccggagcccagatacgggggctgtgactctgggcagggacccggggtctcctggaccttgacagagcagctaactccgagagcagtgggcaggtggccgcccctgaggcttcacgccgggagaagccaccttcccaccccttcataccgcctcgtgccagcagcctcgcacaggccctagctttacgctcatcacctaaacttgtactttatttttctgatagaaatggtttcctctggatcgttttatgcggttcttacagcacatcacctctttgcccccgacggctgtgacgcagccggagggaggcactagtcaccgacagcggccttgaagacagagcaaagcgcccacccaggtcccccgactgcctgtctccatgaggtactggtcccttccttttgttaacgtgatgtgccactatattttacacgtatctcttggtatgcatcttttatagacgctcttttctaagtggcgtgtgcatagcgtcctgccctgccccctcgggggcctgtggtggctccccctctgcttctcggggtccagtgcattttgtttctgtatatgattctctgtggttttttttgaatccaaatctgtcctctgtagtattttttaaataaatcagtgtttacattagaa

SEQ ID NO: 103341 - DNA, 3824 bp, Homo sapiens
  Payload ID: 149
  Gene Symbol: ABL1
  Gene Name: ABL proto-oncogene 1, non-receptor tyrosine kinase
  Uniprot ID: P00519
  ENST ID: ENST00000372348
  CDS Start-End: 375-3824
tgtgagaattgaaatgactagcattattgacccttttcagcatcccctgtgaatatttctgtttaggtttttcttcttgaaaagaaattgttattcagcccgtttaaaacaaatcaagaaacttttgggtaacattgcaattacatgaaattgataaccgcgaaaataattggaactcctgcttgcaagtgtcaacctaaaaaaagtgcttccttttgttatggaagatgtctttctgtgattgacttcaattgctgacttgtggagatgcagcgaatgtgaaatcccacgtatatgccatttccctctacgctcgctgaccgttctggaagatcttgaaccctcttctggaaaggggtacctattattactttatggggcagcagcctggaaaagtacttggggaccaaagaaggccaagcttgcctgccctgcattttatcaaaggagcagggaagaaggaatcatcgaggcatgggggtccacactgcaatgtttttgtggaacatgaagcccttcagcggccagtagcatctgactttgagcctcagggtctgagtgaagccgctcgttggaactccaaggaaaaccttctcgctggacccagtgaaaatgaccccaaccttttcgttgcactgtatgattttgtggccagtggagataacactctaagcataactaaaggtgaaaagctccgggtcttaggctataatcacaatggggaatggtgtgaagcccaaaccaaaaatggccaaggctgggtcccaagcaactacatcacgccagtcaacagtctggagaaacactcctggtaccatgggcctgtgtcccgcaatgccgctgagtatctgctgagcagcgggatcaatggcagcttcttggtgcgtgagagtgagagcagtcctggccagaggtccatctcgctgagatacgaagggagggtgtaccattacaggatcaacactgcttctgatggcaagctctacgtctcctccgagagccgcttcaacaccctggccgagttggttcatcatcattcaacggtggccgacgggctcatcaccacgctccattatccagccccaaagcgcaacaagcccactgtctatggtgtgtcccccaactacgacaagtgggagatggaacgcacggacatcaccatgaagcacaagctgggcgggggccagtacggggaggtgtacgagggcgtgtggaagaaatacagcctgacggtggccgtgaagaccttgaaggaggacaccatggaggtggaagagttcttgaaagaagctgcagtcatgaaagagatcaaacaccctaacctggtgcagctccttggggtctgcacccgggagcccccgttctatatcatcactgagttcatgacctacgggaacctcctggactacctgagggagtgcaaccggcaggaggtgaacgccgtggtgctgctgtacatggccactcagatctcgtcagccatggagtacctggagaagaaaaacttcatccacagagatcttgctgcccgaaactgcctggtaggggagaaccacttggtgaaggtagctgattttggcctgagcaggttgatgacaggggacacctacacagcccatgctggagccaagttccccatcaaatggactgcacccgagagcctggcctacaacaagttctccatcaagtccgacgtctgggcatttggagtattgctttgggaaattgctacctatggcatgtccccttacccgggaattgacctgtcccaggtgtatgagctgctagagaaggactaccgcatggagcgcccagaaggctgcccagagaaggtctatgaactcatgcgagcatgttggcagtggaatccctctgaccggccctcctttgctgaaatccaccaagcctttgaaacaatgttccaggaatccagtatctcagacgaagtggaaaaggagctggggaaacaaggcgtccgtggggctgtgagtaccttgctgcaggccccagagctgcccaccaagacgaggacctccaggagagctgcagagcacagagacaccactgacgtgcctgagatgcctcactccaagggccagggagagagcgatcctctggaccatgagcctgccgtgtctccattgctccctcgaaaagagcgaggtcccccggagggcggcctgaatgaagatgagcgccttctccccaaagacaaaaagaccaacttgttcagcgccttgatcaagaagaagaagaagacagccccaacccctcccaaacgcagcagctccttccgggagatggacggccagccggagcgcagaggggccggcgaggaagagggccgagacatcagcaacggggcactggctttcacccccttggacacagctgacccagccaagtccccaaagcccagcaatggggctggggtccccaatggagccctccgggagtccgggggctcaggcttccggtctccccacctgtggaagaagtccagcacgctgaccagcagccgcctagccaccggcgaggaggagggcggtggcagctccagcaagcgcttcctgcgctcttgctccgcctcctgcgttccccatggggccaaggacacggagtggaggtcagtcacgctgcctcgggacttgcagtccacgggaagacagtttgactcgtccacatttggagggcacaaaagtgagaagccggctctgcctcggaagagggcaggggagaacaggtctgaccaggtgacccgaggcacagtaacgcctccccccaggctggtgaaaaagaatgaggaagctgctgatgaggtcttcaaagacatcatggagtccagcccgggctccagcccgcccaacctgactccaaaacccctccggcggcaggtcaccgtggcccctgcctcgggcctcccccacaaggaagaagctggaaagggcagtgccttagggacccctgctgcagctgagccagtgacccccaccagcaaagcaggctcaggtgcaccagggggcaccagcaagggccccgccgaggagtccagagtgaggaggcacaagcactcctctgagtcgccagggagggacaaggggaaattgtccaggctcaaacctgccccgccgcccccaccagcagcctctgcagggaaggctggaggaaagccctcgcagagcccgagccaggaggcggccggggaggcagtcctgggcgcaaagacaaaagccacgagtctggttgatgctgtgaacagtgacgctgccaagcccagccagccgggagagggcctcaaaaagcccgtgctcccggccactccaaagccacagtccgccaagccgtcggggacccccatcagcccagcccccgttccctccacgttgccatcagcatcctcggccctggcaggggaccagccgtcttccaccgccttcatccctctcatatcaacccgagtgtctcttcggaaaacccgccagcctccagagcggatcgccagcggcgccatcaccaagggcgtggtcctggacagcaccgaggcgctgtgcctcgccatctctaggaactccgagcagatggccagccacagcgcagtgctggaggccggcaaaaacctctacacgttctgcgtgagctatgtggattccatccagcaaatgaggaacaagtttgccttccgagaggccatcaacaaactggagaataatctccgggagcttcagatctgcccggcgacagcaggcagtggtccagcggccactcaggacttcagcaagctcctcagttcggtgaaggaaatcagtgacatagtgcagaggtag

SEQ ID NO: 103342 - DNA, 532 bp, Homo sapiens
  Payload ID: 149
  Gene Symbol: ABL1
  Gene Name: ABL proto-oncogene 1, non-receptor tyrosine kinase
  ENST ID: ENST00000393293
  CDS Start-End: 341-532
tttcagcatcccctgtgaatatttctgtttaggtttttcttcttgaaaagaaattgttattcagcccgtttaaaacaaatcaagaaacttttgggtaacattgcaattacatgaaattgataaccgcgaaaataattggaactcctgcttgcaagtgtcaacctaaaaaaagtgcttccttttgttatggaagatgtctttctgtgattgacttcaattgctgacttgtggagatgcagcgaatgtgaaatcccacgtatatgccatttccctctacgctcgctgaccgttctggaagatcttgaaccctcttctggaaaggggtacctattattactttatggggcagcagcctggaaaagtacttggggaccaaagaaggccaagcttgcctgccctgcattttatcaaaggagcagggaagaaggaatcatcgaggcatgggggtccacactgcaatgtttttgtggaacatgcccttcagcggccagtagcatctgactttgagcctcagggtctgagtgaagccgct

SEQ ID NO: 103343 - DNA, 6910 bp, Homo sapiens
  Payload ID: 150
  Gene Symbol: ABL2
  Gene Name: ABL proto-oncogene 2, non-receptor tyrosine kinase
  Uniprot ID: P42684
  ENST ID: ENST00000344730
  CDS Start-End: 46-3240
ctctttacacagaacagtttaacttttgtgcttctgggcagaggtatggtccttgggacagttctccttccacctaatagttatggcagagatcaggacacttcactttgctgcctgtgcactgaggcctcagaatctgctctacccgacttaacagatcactttgccagctgtgtggaggatggatttgagggagacaagactggaggcagtagtccagaagctttgcatcgtccctatggttgtgatgttgaaccccaggcactaaatgaggctatcaggtggagctccaaggagaacttgctcggagccactgagagtgaccctaatctcttcgttgcactttatgattttgtagcaagtggtgataacacactcagcatcactaaaggtgaaaagctacgagtccttggttacaaccagaatggtgagtggagtgaagttcgctctaagaatgggcagggctgggtgccaagcaactacatcaccccagtgaacagcctggaaaaacactcctggtaccatggacctgtgtcacgcagtgcagctgagtatctgctcagcagtctaatcaatggcagcttcctggtgcgagaaagtgagagtagccctgggcagctgtccatctcgctcaggtacgagggacgtgtgtatcactacaggatcaataccactgcagatggcaaggtgtatgtgactgctgagagccgcttcagcaccttggcagagcttgtacaccatcactccacagtggctgatgggctggtgacaacattacactacccagcacccaagtgtaataagcctacagtctatggtgtgtcccccatccacgacaaatgggaaatggagcgaacagatattaccatgaagcacaaacttgggggcggtcagtatggagaggtttacgttggcgtctggaagaaatacagccttacagttgctgtgaaaacattgaaggaagataccatggaggtagaagaattcctgaaagaagctgcagtaatgaaggaaatcaagcatcctaatctggtacaacttttaggtgtgtgtactttggagccaccattttacattgtgactgaatacatgccatacgggaatttgctggattacctccgagaatgcaaccgagaagaggtgactgcagttgtgctgctctacatggccactcagatttcttctgcaatggagtacttagagaagaagaatttcatccatagagatcttgcagctcgtaactgcctagtgggagaaaaccatgtggtaaaagtggctgactttggcttaagtagattgatgactggagacacttatactgctcatgctggagccaaatttcctattaagtggacagcaccagagagtcttgcctacaataccttctcaattaaatctgacgtctgggcttttggggtattgttgtgggaaattgctacctatggaatgtcaccatatccaggtattgacctgtctcaggtctatgacctactagaaaaaggatatcgaatggaacagcctgagggatgcccccctaaggtttatgaacttatgagagcatgctggaagtggagccctgccgataggccctcttttgctgaaacacaccaagcttttgaaaccatgttccatgactccagcatttctgaagaggtagctgaggagcttgggagagccgcctcctcgtcatctgttgttccatacctgccccggctacctatacttccttccaagactcggacactgaagaaacaggtggagaacaaggagaacattgaaggggcacaagatgccacagaaaattctgcttccagtttagcaccagggttcatcagaggtgcacaggcctctagtggatccccagcactgcctcgaaagcaaagagacaagtcacccagcagcctcttggaagatgccaaagagacatgcttcaccagggataggaaggggggcttcttcagctccttcatgaagaagagaaatgctcctacaccccccaaacgcagcagctccttccgagaaatggagaatcagccccataagaaatacgaactcacggggcttccagagcaggataggatggcaatgacccttcccaggaactgccagaggtccaaactccagctggaaaggacagtgtccacctcttctcagccagaagagaatgtggacagggccaatgacatgcttccaaaaaaatcagaggaaagtgctgctccaagcagggagagaccaaaagccaagttattgcccagaggagccacagctcttcctctcagaacaccctctggggatctagccattacagagaaggaccctccaggggtgggagtggctggagtggcagctgcccccaagggtaaagagaagaatggtggggcacgacttgggatggctggagttccagaggatggagagcagccgggctggccttctccagccaaggctgcccccgtcctcccaaccactcacaaccacaaagtgccagtccttatctcacccactctgaaacacactccagctgacgtgcagctcattggcacagactctcaggggaataaattcaagctcttatctgagcatcaggtcacatcctctggagacaaggaccgaccccgacgggtaaaaccaaagtgtgccccacccccaccaccagtgatgagactactgcagcatccgtccatctgctcagaccctacagaagagccaactgccctaactgcaggacagtccacatcagaaacacaggaaggaggaaagaaggcagctctgggcgcagtgcccatcagtgggaaagctgggaggccagtgatgcctccacctcaagtgcctctgcccacatcttccatctcgccagccaaaatggccaatggcacagcaggtactaaagtggctctgagaaaaaccaaacaggccgctgagaaaatctcagcagacaaaatcagcaaagaggccctgctggaatgtgctgacctactgtccagtgcactcacggaacctgtgcccaacagccagctggtagacactggacaccagctgcttgactactgctcaggctatgtggactgcatccctcaaactcgcaacaaatttgccttccgagaggctgtgagcaaactggaactcagcctgcaggagctacaggtttcttcagcagctgctggtgtgcccgggacaaaccctgtccttaataacttattgtcatgtgtacaggaaatcagtgatgtggtgcagaggtagccactgttagcctggtgggaaaatgcacacatttctgaggggagagggaaaaggacttgttttcctgtgttcttgttttcagaaaatgaaagactcatacttgagtgtgtttatgtgaagtacctcagatccctgagttctcacgtttacagtttcatctcaaaaataagaagcaaaccacataagtataggagaggtaaattaagtgggggcaaggcagtagtggacagggttggaaactgcactggaaaatagggaacatgtgtatgtcataaggaaggcaatgcagcccatccctacctggaatgctgggaagtgctaggcagggctgctctcagcaagactgcagcagctgcacccagacctggggctctggtaggtactaatggtgattatgctccaatttacctaatgaatttggtgggacagcagaaaagaaagctgggaatgtaccaagagaaatttttgttcagggctgttggaagtagctgttagccttgcttccacaaggccattgctgctgtaataagaactgcaaatcagagtgctacaacataaaactgggaaatatggccctatctgaatgcctctgtcctattttccgctggtgtatcagttagtgcaggaagtaaagaatgctggaaagttgaatcagaaattgaaaaccttctaaaatcttacacagattagcagaagtcacttctcccagtctggtatattatttcataatggaccaggatcggcttcctgcctgttggtggctatctgtaaaccataagtacaggggtctccctagtggttcttctctgtcttttgctgggcaggctgtcttcctttattcctggtagcattcagagcattaaccagtgttgattttgaaaatagtagtccctacaggttctcacaaaggaatgaatcctgttctgatacagttcccctgcatactgacatactggccaaggacttgagcagctgtgtatttttctttatcaactaaaataccagggagatggtcttttcttgaaacccagtggcctgtatgtgactgagaggaaaagctggcttggtcctaatggctgtttctctgtacctttcccttcccttaccaccttaagcccaatccaggtagagaatagggagaggcattctcctctctatggatttgaagtgaatcacccccacattattctcacatgcttttcttctctcacatattcctccctactcccccacccaatcattgtgcttatttgtacagatcttattgggaatattctttatttattttgtcatttcacttctattttaagaatgcataattgaaggagtagtcattttcagggagcaccaggtagaccctgggaacctaatgacttaatccttaaatatgttttgcccttgaaaaataggccttttccttccttccttagttataattgtggaagctaattaggatggcatggaagtgaatctaatgagttaggtattattaatgttcttggtatcgggtctaattccagttactgcttcattctctttttaaagctttatgaatacttcccccatcctccccaaggagagctcaatacacacatatttttattttattctctcaaaggaatattagcttaggaagataggaattcaacattgagcactgagttttcttctggctctgtcattgatacactgtcaaaccacagcctcatctcttaatctatttaattaaggtaacagtacatgttctcaagggtgttgcaagtaagtgtgcagctatcccttggagagcctctctggaaagctcttttagtgcagtgttgttatgctgaattgttttccattatcttatttgctgagtagaaaatattaatgaaattaagaattgttgagattatatgaattgggctagaatactaaggggaaaactatgttttgaatagagtttggcatttttgaccaagaacaaaattgagttttcattggaaagaaaggaaaccttgattcttaccattgctgctccaaaggaggcccaggttaagaggattagaggagacacgcggtgctgggcattcctggcaggtgttgggtgatccccgcagtatgtcacctgcagttgcagcacaggcagctagtgattgggttcatctcctcctagtggttggaagagaactcagatgtaaaaaccagcggtccttctcccaccttctttcctgccattcttgctcatcatacatgtccgtaaacttgaagaactcgttttagcagctagccttttaaggtcgaggatgggaaagctaaaactgtagaatattattatgctgctttttaggtttatccctgttgttgtgggatgcaagttaagggattgtaattgtttttcagggtttttttgttttttgttttttaagcaagggctctattttcccttgagagttctggaactaagccttggagaaacactactgagtgtatttaggctccctggttttcttgcccaacaacaatctgaagggtagggggtgggggctgtgtcttactcaggggcagcacctagctgtcttgcctacagtgggtgcacgatatataaatggaattgatttttgtcaacactgtcaagagtggcattgactattggagcataccccgtccacatgatgcttgaactatgtaacttcaggggttgagggctcaaggttcaggttaaagaggcactgtcaacttactatacaagcataatttaggtttttcctttttctacttgaaaaggaccagcttaaacacaaacccttatgtaaattaaaaggtttgaatccaaagcagagagaactgcttctggaaaagtgtagtttaattttaactattctaaaagcaatgagcaaaggcccttgtccaaggcgttgacagttttctaaagtggttatgctgtatatctggatgcatgcctttgggctgccactgcttgattcctttcatgtacagataatattacttcagtttagatttcccactttaaaatgcagtgatttgtgttgaatacatcttgattgtgctttacctaaagtattttcttaaaaggctttgtgtaaaatttaaatgtatatattttcctgtagacttccatcatgattttcagagattagccttaaaaaatttggccctaagaaattcattcagtgtttttctagatgacctctgtacatagaggtcattatagtggagaccctttaccagcagcattttaagatttaaattagatagaaagtttcttaggattcaactgaaaattggctagtaaaatatgtcccaggtaataaagcatgctgactttgctaaggcactgcccatttttatttaactaaagtcatggagattttgagtttaaaggatgcagtatagatagtggtttagtgtttaggctctaatgccagtctaaaaggcaagtcatttaaccttgggagcctcagtttcctcactgtaaaacagggataataatagtaactacctcagggttgttgtaaggattaaatgagatgatatttgtaagatacttagctcaagtgcctggcacacaatgagcacactctataaatgttctactactactattattaacacctagtctagggatgcacagcagaatcccctagggttaaaaaacaaaacaaaacaa

SEQ ID NO: 103344 - DNA, 3486 bp, Homo sapiens
  Payload ID: 150
  Gene Symbol: ABL2
  Gene Name: ABL proto-oncogene 2, non-receptor tyrosine kinase
  Uniprot ID: P42684
  ENST ID: ENST00000367623
  CDS Start-End: 1-3486
atggggcagcaggtgggccgcgtcggggaagctccggggctccagcagcctcagccccgcgggatccggggcagcagtgcagccaggccctccggccgcaggcgggacccggcggggcgcaccacagagaccggcttcaatatcttcacccagcatgaagctttgcatcgtccctatggttgtgatgttgaaccccaggcactaaatgaggctatcaggtggagctccaaggagaacttgctcggagccactgagagtgaccctaatctcttcgttgcactttatgattttgtagcaagtggtgataacacactcagcatcactaaaggtgaaaagctacgagtccttggttacaaccagaatggtgagtggagtgaagttcgctctaagaatgggcagggctgggtgccaagcaactacatcaccccagtgaacagcctggaaaaacactcctggtaccatggacctgtgtcacgcagtgcagctgagtatctgctcagcagtctaatcaatggcagcttcctggtgcgagaaagtgagagtagccctgggcagctgtccatctcgctcaggtacgagggacgtgtgtatcactacaggatcaataccactgcagatggcaaggtgtatgtgactgctgagagccgcttcagcaccttggcagagcttgtacaccatcactccacagtggctgatgggctggtgacaacattacactacccagcacccaagtgtaataagcctacagtctatggtgtgtcccccatccacgacaaatgggaaatggagcgaacagatattaccatgaagcacaaacttgggggcggtcagtatggagaggtttacgttggcgtctggaagaaatacagccttacagttgctgtgaaaacattgaaggaagataccatggaggtagaagaattcctgaaagaagctgcagtaatgaaggaaatcaagcatcctaatctggtacaacttttaggtgtgtgtactttggagccaccattttacattgtgactgaatacatgccatacgggaatttgctggattacctccgagaatgcaaccgagaagaggtgactgcagttgtgctgctctacatggccactcagatttcttctgcaatggagtacttagagaagaagaatttcatccatagagatcttgcagctcgtaactgcctagtgggagaaaaccatgtggtaaaagtggctgactttggcttaagtagattgatgactggagacacttatactgctcatgctggagccaaatttcctattaagtggacagcaccagagagtcttgcctacaataccttctcaattaaatctgacgtctgggcttttggggtattgttgtgggaaattgctacctatggaatgtcaccatatccaggtattgacctgtctcaggtctatgacctactagaaaaaggatatcgaatggaacagcctgagggatgcccccctaaggtttatgaacttatgagagcatgctggaagtggagccctgccgataggccctcttttgctgaaacacaccaagcttttgaaaccatgttccatgactccagcatttctgaagaggtagctgaggagcttgggagagccgcctcctcgtcatctgttgttccatacctgccccggctacctatacttccttccaagactcggacactgaagaaacaggtggagaacaaggagaacattgaaggggcacaagatgccacagaaaattctgcttccagtttagcaccagggttcatcagaggtgcacaggcctctagtggatccccagcactgcctcgaaagcaaagagacaagtcacccagcagcctcttggaagatgccaaagagacatgcttcaccagggataggaaggggggcttcttcagctccttcatgaagaagagaaatgctcctacaccccccaaacgcagcagctccttccgagaaatggagaatcagccccataagaaatacgaactcacgggtaacttctcatctgttgcttctctacagcatgctgatgggttctctttcactcctgcccagcaagaggcgaatctggtgccacccaagtgctatggggggagctttgcacagaggaacctctgtaatgacgacggtggtgggggtgggggcagtggcactgctgggggtgggtggtctggcatcacaggcttctttacaccacgcttaatcaaaaagacactgggcttacgagcaggtaaacccacagccagtgatgacacttccaagccttttccaaggtcaaactctacatcttccatgtcctcagggcttccagagcaggataggatggcaatgacccttcccaggaactgccagaggtccaaactccagctggaaaggacagtgtccacctcttctcagccagaagagaatgtggacagggccaatgacatgcttccaaaaaaatcagaggaaagtgctgctccaagcagggagagaccaaaagccaagttattgcccagaggagccacagctcttcctctcagaacaccctctggggatctagccattacagagaaggaccctccaggggtgggagtggctggagtggcagctgcccccaagggtaaagagaagaatggtggggcacgacttgggatggctggagttccagaggatggagagcagccgggctggccttctccagccaaggctgcccccgtcctcccaaccactcacaaccacaaagtgccagtccttatctcacccactctgaaacacactccagctgacgtgcagctcattggcacagactctcaggggaataaattcaagctcttatctgagcatcaggtcacatcctctggagacaaggaccgaccccgacgggtaaaaccaaagtgtgccccacccccaccaccagtgatgagactactgcagcatccgtccatctgctcagaccctacagaagagccaactgccctaactgcaggacagtccacatcagaaacacaggaaggaggaaagaaggcagctctgggcgcagtgcccatcagtgggaaagctgggaggccagtgatgcctccacctcaagtgcctctgcccacatcttccatctcgccagccaaaatggccaatggcacagcaggtactaaagtggctctgagaaaaaccaaacaggccgctgagaaaatctcagcagacaaaatcagcaaagaggccctgctggaatgtgctgacctactgtccagtgcactcacggaacctgtgcccaacagccagctggtagacactggacaccagctgcttgactactgctcaggctatgtggactgcatccctcaaactcgcaacaaatttgccttccgagaggctgtgagcaaactggaactcagcctgcaggagctacaggtttcttcagcagctgctggtgtgcccgggacaaaccctgtccttaataacttattgtcatgtgtacaggaaatcagtgatgtggtgcagaggtag

SEQ ID NO: 103345 - DNA, 2140 bp, Homo sapiens
  Payload ID: 150
  Gene Symbol: ABL2
  Gene Name: ABL proto-oncogene 2, non-receptor tyrosine kinase
  Uniprot ID: P42684
  ENST ID: ENST00000392043
  CDS Start-End: 288-1916
gctcggtggtttaaagatggcggcggcggtggcggcggcggcggcggcggcgttgggggcgcggagccgcgacaggaggagggaaaagcagaatctgtgagtcgcctggaggcagcgcggcggctgccgtgaggaggccgggtgcggagccgccggtggcccagccactcagggccagggcctgggctgggagggagagaccggagcagcgccaggagcccgaggccggagccgaggaggaatgtgaccaggggtcggcgggggcgcgggagtacgcgagagcagggatggggcagcaggtgggccgcgtcggggaagctccggggctccagcagcctcagccccgcgggatccggggcagcagtgcagccaggccctccggccgcaggcgggacccggcggggcgcaccacagagaccggcttcaatatcttcacccagcatgaagctttgcatcgtccctatggttgtgatgttgaaccccaggcactaaatgaggctatcaggtggagctccaaggagaacttgctcggagccactgagagtgaccctaatctcttcgttgcactttatgattttgtagcaagtggtgataacacactcagcatcactaaaggtgaaaagctacgagtccttggttacaaccagaatggtgagtggagtgaagttcgctctaagaatgggcagggctgggtgccaagcaactacatcaccccagtgaacagcctggaaaaacactcctggtaccatggacctgtgtcacgcagtgcagctgagtatctgctcagcagtctaatcaatggcagcttcctggtgcgagaaagtgagagtagccctgggcagctgtccatctcgctcaggtacgagggacgtgtgtatcactacaggatcaataccactgcagatggcaaggtgtatgtgactgctgagagccgcttcagcaccttggcagagcttgtacaccatcactccacagtggctgatgggctggtgacaacattacactacccagcacccaagtgtaataagcctacagtctatggtgtgtcccccatccacgacaaatgggaaatggagcgaacagatattaccatgaagcacaaacttgggggcggtcagtatggagaggtttacgttggcgtctggaagaaatacagccttacagttgctgtgaaaacattgaaggaagataccatggaggtagaagaattcctgaaagaagctgcagtaatgaaggaaatcaagcatcctaatctggtacaacttttaggtgtgtgtactttggagccaccattttacattgtgactgaatacatgccatacgggaatttgctggattacctccgagaatgcaaccgagaagaggtgactgcagttgtgctgctctacatggccactcagatttcttctgcaatggagtacttagagaagaagaatttcatccatagagatcttgcagctcgtaactgcctagtgggagaaaaccatgtggtaaaagtggctgactttggcttaagtagattgatgactggagacacttatactgctcatgctggagccaaatttcctattaagtggacagcaccagagagtcttgcctacaataccttctcaattaaatctgacgtctgggcttttggggtattgttgtgggaaattgctacctatggaatgtcaccatatccaggtattgacctgtctcaggtctatgacctactagaaaaaggatatcgaatggaacagcctgagggatgcccccctaaggtttatgaacttatgagagcatgctggaagtggagccctgccgataggccctcttttgctgaaacacaccaagcttttgaaaccatgttccatgactccagcatttctgaagttctcctacattgtgccaatcagacgtgcataacattgtgaaccaaaagacacagagcaggatgatgctagcaacgtattcatagtaactccaaactggaaacaacctaaacatccatcaagaggagaacaggtggattgtggtatattcacacgttggcatgctacacagcaatgagaacccctgccacatgcagcagcgtggacgaatctacacacatgatactgggcgaaagaagccagacaaaagagtacatactttatga

SEQ ID NO: 103346 - DNA, 3177 bp, Homo sapiens
  Payload ID: 150
  Gene Symbol: ABL2
  Gene Name: ABL proto-oncogene 2, non-receptor tyrosine kinase
  Uniprot ID: P42684
  ENST ID: ENST00000507173
  CDS Start-End: 1-3177
atggggcagcaggtgggccgcgtcggggaagctccggggctccagcagcctcagccccgcgggatccggggcagcagtgcagccaggccctccggccgcaggcgggacccggcggggcgcaccacagagaccggcttcaatatcttcacccagcatgaagctttgcatcgtccctatggttgtgatgttgaaccccaggcactaaatgaggctatcaggtggagctccaaggagaacttgctcggagccactgagagtgaccctaatctcttcgttgcactttatgattttgtagcaagtggtgataacacactcagcatcactaaaggtgaaaagctacgagtccttggttacaaccagaatggtgagtggagtgaagttcgctctaagaatgggcagggctgggtgccaagcaactacatcaccccagtgaacagcctggaaaaacactcctggtaccatggacctgtgtcacgcagtgcagctgagtatctgctcagcagtctaatcaatggcagcttcctggtgcgagaaagtgagagtagccctgggcagctgtccatctcgctcaggtacgagggacgtgtgtatcactacaggatcaataccactgcagatggcaaggtgtatgtgactgctgagagccgcttcagcaccttggcagagcttgtacaccatcactccacagtggctgatgggctggtgacaacattacactacccagcacccaagtgtaataagcctacagtctatggtgtgtcccccatccacgacaaatgggaaatggagcgaacagatattaccatgaagcacaaacttgggggcggtcagtatggagaggtttacgttggcgtctggaagaaatacagccttacagttgctgtgaaaacattgaaggaagataccatggaggtagaagaattcctgaaagaagctgcagtaatgaaggaaatcaagcatcctaatctggtacaacttttaggtgtgtgtactttggagccaccattttacattgtgactgaatacatgccatacgggaatttgctggattacctccgagaatgcaaccgagaagaggtgactgcagttgtgctgctctacatggccactcagatttcttctgcaatggagtacttagagaagaagaatttcatccatagagatcttgcagctcgtaactgcctagtgggagaaaaccatgtggtaaaagtggctgactttggcttaagtagattgatgactggagacacttatactgctcatgctggagccaaatttcctattaagtggacagcaccagagagtcttgcctacaataccttctcaattaaatctgacgtctgggcttttggggtattgttgtgggaaattgctacctatggaatgtcaccatatccaggtattgacctgtctcaggtctatgacctactagaaaaaggatatcgaatggaacagcctgagggatgcccccctaaggtttatgaacttatgagagcatgctggaagtggagccctgccgataggccctcttttgctgaaacacaccaagcttttgaaaccatgttccatgactccagcatttctgaagaggtagctgaggagcttgggagagccgcctcctcgtcatctgttgttccatacctgccccggctacctatacttccttccaagactcggacactgaagaaacaggtggagaacaaggagaacattgaaggggcacaagatgccacagaaaattctgcttccagtttagcaccagggttcatcagaggtgcacaggcctctagtggatccccagcactgcctcgaaagcaaagagacaagtcacccagcagcctcttggaagatgccaaagagacatgcttcaccagggataggaaggggggcttcttcagctccttcatgaagaagagaaatgctcctacaccccccaaacgcagcagctccttccgagaaatggagaatcagccccataagaaatacgaactcacggggcttccagagcaggataggatggcaatgacccttcccaggaactgccagaggtccaaactccagctggaaaggacagtgtccacctcttctcagccagaagagaatgtggacagggccaatgacatgcttccaaaaaaatcagaggaaagtgctgctccaagcagggagagaccaaaagccaagttattgcccagaggagccacagctcttcctctcagaacaccctctggggatctagccattacagagaaggaccctccaggggtgggagtggctggagtggcagctgcccccaagggtaaagagaagaatggtggggcacgacttgggatggctggagttccagaggatggagagcagccgggctggccttctccagccaaggctgcccccgtcctcccaaccactcacaaccacaaagtgccagtccttatctcacccactctgaaacacactccagctgacgtgcagctcattggcacagactctcaggggaataaattcaagctcttatctgagcatcaggtcacatcctctggagacaaggaccgaccccgacgggtaaaaccaaagtgtgccccacccccaccaccagtgatgagactactgcagcatccgtccatctgctcagaccctacagaagagccaactgccctaactgcaggacagtccacatcagaaacacaggaaggaggaaagaaggcagctctgggcgcagtgcccatcagtgggaaagctgggaggccagtgatgcctccacctcaagtgcctctgcccacatcttccatctcgccagccaaaatggccaatggcacagcaggtactaaagtggctctgagaaaaaccaaacaggccgctgagaaaatctcagcagacaaaatcagcaaagaggccctgctggaatgtgctgacctactgtccagtgcactcacggaacctgtgcccaacagccagctggtagacactggacaccagctgcttgactactgctcaggctatgtggactgcatccctcaaactcgcaacaaatttgccttccgagaggctgtgagcaaactggaactcagcctgcaggagctacaggtttcttcagcagctgctggtgtgcccgggacaaaccctgtccttaataacttattgtcatgtgtacaggaaatcagtgatgtggtgcagaggtag

SEQ ID NO: 103347 - DNA, 3635 bp, Homo sapiens
  Payload ID: 150
  Gene Symbol: ABL2
  Gene Name: ABL proto-oncogene 2, non-receptor tyrosine kinase
  Uniprot ID: P42684
  ENST ID: ENST00000512653
  CDS Start-End: 13-3516
ctgggcagaggtatggtccttgggacagttctccttccacctaatagttatggcagagatcaggacacttcactttgctgcctgtgcactgaggcctcagaatctgctctacccgacttaacagatcactttgccagctgtgtggaggatggatttgagggagacaagactggaggcagtagtccagaagctttgcatcgtccctatggttgtgatgttgaaccccaggcactaaatgaggctatcaggtggagctccaaggagaacttgctcggagccactgagagtgaccctaatctcttcgttgcactttatgattttgtagcaagtggtgataacacactcagcatcactaaaggtgaaaagctacgagtccttggttacaaccagaatggtgagtggagtgaagttcgctctaagaatgggcagggctgggtgccaagcaactacatcaccccagtgaacagcctggaaaaacactcctggtaccatggacctgtgtcacgcagtgcagctgagtatctgctcagcagtctaatcaatggcagcttcctggtgcgagaaagtgagagtagccctgggcagctgtccatctcgctcaggtacgagggacgtgtgtatcactacaggatcaataccactgcagatggcaaggtgtatgtgactgctgagagccgcttcagcaccttggcagagcttgtacaccatcactccacagtggctgatgggctggtgacaacattacactacccagcacccaagtgtaataagcctacagtctatggtgtgtcccccatccacgacaaatgggaaatggagcgaacagatattaccatgaagcacaaacttgggggcggtcagtatggagaggtttacgttggcgtctggaagaaatacagccttacagttgctgtgaaaacattgaaggaagataccatggaggtagaagaattcctgaaagaagctgcagtaatgaaggaaatcaagcatcctaatctggtacaacttttaggtgtgtgtactttggagccaccattttacattgtgactgaatacatgccatacgggaatttgctggattacctccgagaatgcaaccgagaagaggtgactgcagttgtgctgctctacatggccactcagatttcttctgcaatggagtacttagagaagaagaatttcatccatagagatcttgcagctcgtaactgcctagtgggagaaaaccatgtggtaaaagtggctgactttggcttaagtagattgatgactggagacacttatactgctcatgctggagccaaatttcctattaagtggacagcaccagagagtcttgcctacaataccttctcaattaaatctgacgtctgggcttttggggtattgttgtgggaaattgctacctatggaatgtcaccatatccaggtattgacctgtctcaggtctatgacctactagaaaaaggatatcgaatggaacagcctgagggatgcccccctaaggtttatgaacttatgagagcatgctggaagtggagccctgccgataggccctcttttgctgaaacacaccaagcttttgaaaccatgttccatgactccagcatttctgaagaggtagctgaggagcttgggagagccgcctcctcgtcatctgttgttccatacctgccccggctacctatacttccttccaagactcggacactgaagaaacaggtggagaacaaggagaacattgaaggggcacaagatgccacagaaaattctgcttccagtttagcaccagggttcatcagaggtgcacaggcctctagtggatccccagcactgcctcgaaagcaaagagacaagtcacccagcagcctcttggaagatgccaaagagacatgcttcaccagggataggaaggggggcttcttcagctccttcatgaagaagagaaatgctcctacaccccccaaacgcagcagctccttccgagaaatggagaatcagccccataagaaatacgaactcacgggtaacttctcatctgttgcttctctacagcatgctgatgggttctctttcactcctgcccagcaagaggcgaatctggtgccacccaagtgctatggggggagctttgcacagaggaacctctgtaatgacgacggtggtgggggtgggggcagtggcactgctgggggtgggtggtctggcatcacaggcttctttacaccacgcttaatcaaaaagacactgggcttacgagcaggtaaacccacagccagtgatgacacttccaagccttttccaaggtcaaactctacatcttccatgtcctcagggcttccagagcaggataggatggcaatgacccttcccaggaactgccagaggtccaaactccagctggaaaggacagtgtccacctcttctcagccagaagagaatgtggacagggccaatgacatgcttccaaaaaaatcagaggaaagtgctgctccaagcagggagagaccaaaagccaagttattgcccagaggagccacagctcttcctctcagaacaccctctggggatctagccattacagagaaggaccctccaggggtgggagtggctggagtggcagctgcccccaagggtaaagagaagaatggtggggcacgacttgggatggctggagttccagaggatggagagcagccgggctggccttctccagccaaggctgcccccgtcctcccaaccactcacaaccacaaagtgccagtccttatctcacccactctgaaacacactccagctgacgtgcagctcattggcacagactctcaggggaataaattcaagctcttatctgagcatcaggtcacatcctctggagacaaggaccgaccccgacgggtaaaaccaaagtgtgccccacccccaccaccagtgatgagactactgcagcatccgtccatctgctcagaccctacagaagagccaactgccctaactgcaggacagtccacatcagaaacacaggaaggaggaaagaaggcagctctgggcgcagtgcccatcagtgggaaagctgggaggccagtgatgcctccacctcaagtgcctctgcccacatcttccatctcgccagccaaaatggccaatggcacagcaggtactaaagtggctctgagaaaaaccaaacaggccgctgagaaaatctcagcagacaaaatcagcaaagaggccctgctggaatgtgctgacctactgtccagtgcactcacggaacctgtgcccaacagccagctggtagacactggacaccagctgcttgactactgctcaggctatgtggactgcatccctcaaactcgcaacaaatttgccttccgagaggctgtgagcaaactggaactcagcctgcaggagctacaggtttcttcagcagctgctggtgtgcccgggacaaaccctgtccttaataacttattgtcatgtgtacaggaaatcagtgatgtggtgcagaggtagccactgttagcctggtgggaaaatgcacacatttctgaggggagagggaaaaggacttgttttcctgtgttcttgttttcagaaaatgaaagactcatacttgagtgtgtttatgtgaa

SEQ ID NO: 103348 - DNA, 3240 bp, Homo sapiens
  Payload ID: 150
  Gene Symbol: ABL2
  Gene Name: ABL proto-oncogene 2, non-receptor tyrosine kinase
  Uniprot ID: P42684
  ENST ID: ENST00000511413
  CDS Start-End: 1-3240
atggggcagcaggtgggccgcgtcggggaagctccggggctccagcagcctcagccccgcgggatccggggcagcagtgcagccaggccctccggccgcaggcgggacccggcggggcgcaccacagagaccggcttcaatatcttcacccagcatgatcactttgccagctgtgtggaggatggatttgagggagacaagactggaggcagtagtccagaagctttgcatcgtccctatggttgtgatgttgaaccccaggcactaaatgaggctatcaggtggagctccaaggagaacttgctcggagccactgagagtgaccctaatctcttcgttgcactttatgattttgtagcaagtggtgataacacactcagcatcactaaaggtgaaaagctacgagtccttggttacaaccagaatggtgagtggagtgaagttcgctctaagaatgggcagggctgggtgccaagcaactacatcaccccagtgaacagcctggaaaaacactcctggtaccatggacctgtgtcacgcagtgcagctgagtatctgctcagcagtctaatcaatggcagcttcctggtgcgagaaagtgagagtagccctgggcagctgtccatctcgctcaggtacgagggacgtgtgtatcactacaggatcaataccactgcagatggcaaggtgtatgtgactgctgagagccgcttcagcaccttggcagagcttgtacaccatcactccacagtggctgatgggctggtgacaacattacactacccagcacccaagtgtaataagcctacagtctatggtgtgtcccccatccacgacaaatgggaaatggagcgaacagatattaccatgaagcacaaacttgggggcggtcagtatggagaggtttacgttggcgtctggaagaaatacagccttacagttgctgtgaaaacattgaaggaagataccatggaggtagaagaattcctgaaagaagctgcagtaatgaaggaaatcaagcatcctaatctggtacaacttttaggtgtgtgtactttggagccaccattttacattgtgactgaatacatgccatacgggaatttgctggattacctccgagaatgcaaccgagaagaggtgactgcagttgtgctgctctacatggccactcagatttcttctgcaatggagtacttagagaagaagaatttcatccatagagatcttgcagctcgtaactgcctagtgggagaaaaccatgtggtaaaagtggctgactttggcttaagtagattgatgactggagacacttatactgctcatgctggagccaaatttcctattaagtggacagcaccagagagtcttgcctacaataccttctcaattaaatctgacgtctgggcttttggggtattgttgtgggaaattgctacctatggaatgtcaccatatccaggtattgacctgtctcaggtctatgacctactagaaaaaggatatcgaatggaacagcctgagggatgcccccctaaggtttatgaacttatgagagcatgctggaagtggagccctgccgataggccctcttttgctgaaacacaccaagcttttgaaaccatgttccatgactccagcatttctgaagaggtagctgaggagcttgggagagccgcctcctcgtcatctgttgttccatacctgccccggctacctatacttccttccaagactcggacactgaagaaacaggtggagaacaaggagaacattgaaggggcacaagatgccacagaaaattctgcttccagtttagcaccagggttcatcagaggtgcacaggcctctagtggatccccagcactgcctcgaaagcaaagagacaagtcacccagcagcctcttggaagatgccaaagagacatgcttcaccagggataggaaggggggcttcttcagctccttcatgaagaagagaaatgctcctacaccccccaaacgcagcagctccttccgagaaatggagaatcagccccataagaaatacgaactcacggggcttccagagcaggataggatggcaatgacccttcccaggaactgccagaggtccaaactccagctggaaaggacagtgtccacctcttctcagccagaagagaatgtggacagggccaatgacatgcttccaaaaaaatcagaggaaagtgctgctccaagcagggagagaccaaaagccaagttattgcccagaggagccacagctcttcctctcagaacaccctctggggatctagccattacagagaaggaccctccaggggtgggagtggctggagtggcagctgcccccaagggtaaagagaagaatggtggggcacgacttgggatggctggagttccagaggatggagagcagccgggctggccttctccagccaaggctgcccccgtcctcccaaccactcacaaccacaaagtgccagtccttatctcacccactctgaaacacactccagctgacgtgcagctcattggcacagactctcaggggaataaattcaagctcttatctgagcatcaggtcacatcctctggagacaaggaccgaccccgacgggtaaaaccaaagtgtgccccacccccaccaccagtgatgagactactgcagcatccgtccatctgctcagaccctacagaagagccaactgccctaactgcaggacagtccacatcagaaacacaggaaggaggaaagaaggcagctctgggcgcagtgcccatcagtgggaaagctgggaggccagtgatgcctccacctcaagtgcctctgcccacatcttccatctcgccagccaaaatggccaatggcacagcaggtactaaagtggctctgagaaaaaccaaacaggccgctgagaaaatctcagcagacaaaatcagcaaagaggccctgctggaatgtgctgacctactgtccagtgcactcacggaacctgtgcccaacagccagctggtagacactggacaccagctgcttgactactgctcaggctatgtggactgcatccctcaaactcgcaacaaatttgccttccgagaggctgtgagcaaactggaactcagcctgcaggagctacaggtttcttcagcagctgctggtgtgcccgggacaaaccctgtccttaataacttattgtcatgtgtacaggaaatcagtgatgtggtgcagaggtag

SEQ ID NO: 103349 - DNA, 3132 bp, Homo sapiens
  Payload ID: 150
  Gene Symbol: ABL2
  Gene Name: ABL proto-oncogene 2, non-receptor tyrosine kinase
  Uniprot ID: P42684
  ENST ID: ENST00000504405
  CDS Start-End: 1-3132
atggtccttgggacagttctccttccacctaatagttatggcagagatcaggacacttcactttgctgcctgtgcactgaggcctcagaatctgctctacccgacttaacagaagctttgcatcgtccctatggttgtgatgttgaaccccaggcactaaatgaggctatcaggtggagctccaaggagaacttgctcggagccactgagagtgaccctaatctcttcgttgcactttatgattttgtagcaagtggtgataacacactcagcatcactaaaggtgaaaagctacgagtccttggttacaaccagaatggtgagtggagtgaagttcgctctaagaatgggcagggctgggtgccaagcaactacatcaccccagtgaacagcctggaaaaacactcctggtaccatggacctgtgtcacgcagtgcagctgagtatctgctcagcagtctaatcaatggcagcttcctggtgcgagaaagtgagagtagccctgggcagctgtccatctcgctcaggtacgagggacgtgtgtatcactacaggatcaataccactgcagatggcaaggtgtatgtgactgctgagagccgcttcagcaccttggcagagcttgtacaccatcactccacagtggctgatgggctggtgacaacattacactacccagcacccaagtgtaataagcctacagtctatggtgtgtcccccatccacgacaaatgggaaatggagcgaacagatattaccatgaagcacaaacttgggggcggtcagtatggagaggtttacgttggcgtctggaagaaatacagccttacagttgctgtgaaaacattgaaggaagataccatggaggtagaagaattcctgaaagaagctgcagtaatgaaggaaatcaagcatcctaatctggtacaacttttaggtgtgtgtactttggagccaccattttacattgtgactgaatacatgccatacgggaatttgctggattacctccgagaatgcaaccgagaagaggtgactgcagttgtgctgctctacatggccactcagatttcttctgcaatggagtacttagagaagaagaatttcatccatagagatcttgcagctcgtaactgcctagtgggagaaaaccatgtggtaaaagtggctgactttggcttaagtagattgatgactggagacacttatactgctcatgctggagccaaatttcctattaagtggacagcaccagagagtcttgcctacaataccttctcaattaaatctgacgtctgggcttttggggtattgttgtgggaaattgctacctatggaatgtcaccatatccaggtattgacctgtctcaggtctatgacctactagaaaaaggatatcgaatggaacagcctgagggatgcccccctaaggtttatgaacttatgagagcatgctggaagtggagccctgccgataggccctcttttgctgaaacacaccaagcttttgaaaccatgttccatgactccagcatttctgaagaggtagctgaggagcttgggagagccgcctcctcgtcatctgttgttccatacctgccccggctacctatacttccttccaagactcggacactgaagaaacaggtggagaacaaggagaacattgaaggggcacaagatgccacagaaaattctgcttccagtttagcaccagggttcatcagaggtgcacaggcctctagtggatccccagcactgcctcgaaagcaaagagacaagtcacccagcagcctcttggaagatgccaaagagacatgcttcaccagggataggaaggggggcttcttcagctccttcatgaagaagagaaatgctcctacaccccccaaacgcagcagctccttccgagaaatggagaatcagccccataagaaatacgaactcacggggcttccagagcaggataggatggcaatgacccttcccaggaactgccagaggtccaaactccagctggaaaggacagtgtccacctcttctcagccagaagagaatgtggacagggccaatgacatgcttccaaaaaaatcagaggaaagtgctgctccaagcagggagagaccaaaagccaagttattgcccagaggagccacagctcttcctctcagaacaccctctggggatctagccattacagagaaggaccctccaggggtgggagtggctggagtggcagctgcccccaagggtaaagagaagaatggtggggcacgacttgggatggctggagttccagaggatggagagcagccgggctggccttctccagccaaggctgcccccgtcctcccaaccactcacaaccacaaagtgccagtccttatctcacccactctgaaacacactccagctgacgtgcagctcattggcacagactctcaggggaataaattcaagctcttatctgagcatcaggtcacatcctctggagacaaggaccgaccccgacgggtaaaaccaaagtgtgccccacccccaccaccagtgatgagactactgcagcatccgtccatctgctcagaccctacagaagagccaactgccctaactgcaggacagtccacatcagaaacacaggaaggaggaaagaaggcagctctgggcgcagtgcccatcagtgggaaagctgggaggccagtgatgcctccacctcaagtgcctctgcccacatcttccatctcgccagccaaaatggccaatggcacagcaggtactaaagtggctctgagaaaaaccaaacaggccgctgagaaaatctcagcagacaaaatcagcaaagaggccctgctggaatgtgctgacctactgtccagtgcactcacggaacctgtgcccaacagccagctggtagacactggacaccagctgcttgactactgctcaggctatgtggactgcatccctcaaactcgcaacaaatttgccttccgagaggctgtgagcaaactggaactcagcctgcaggagctacaggtttcttcagcagctgctggtgtgcccgggacaaaccctgtccttaataacttattgtcatgtgtacaggaaatcagtgatgtggtgcagaggtag

SEQ ID NO: 103350 - DNA, 12144 bp, Homo sapiens
  Payload ID: 150
  Gene Symbol: ABL2
  Gene Name: ABL proto-oncogene 2, non-receptor tyrosine kinase
  Uniprot ID: P42684
  ENST ID: ENST00000502732
  CDS Start-End: 205-3753
aaaagcagaatctgtgagtcgcctggaggcagcgcggcggctgccgtgaggaggccgggtgcggagccgccggtggcccagccactcagggccagggcctgggctgggagggagagaccggagcagcgccaggagcccgaggccggagccgaggaggaatgtgaccaggggtcggcgggggcgcgggagtacgcgagagcagggatggggcagcaggtgggccgcgtcggggaagctccggggctccagcagcctcagccccgcgggatccggggcagcagtgcagccaggccctccggccgcaggcgggacccggcggggcgcaccacagagaccggcttcaatatcttcacccagcatgatcactttgccagctgtgtggaggatggatttgagggagacaagactggaggcagtagtccagaagctttgcatcgtccctatggttgtgatgttgaaccccaggcactaaatgaggctatcaggtggagctccaaggagaacttgctcggagccactgagagtgaccctaatctcttcgttgcactttatgattttgtagcaagtggtgataacacactcagcatcactaaaggtgaaaagctacgagtccttggttacaaccagaatggtgagtggagtgaagttcgctctaagaatgggcagggctgggtgccaagcaactacatcaccccagtgaacagcctggaaaaacactcctggtaccatggacctgtgtcacgcagtgcagctgagtatctgctcagcagtctaatcaatggcagcttcctggtgcgagaaagtgagagtagccctgggcagctgtccatctcgctcaggtacgagggacgtgtgtatcactacaggatcaataccactgcagatggcaaggtgtatgtgactgctgagagccgcttcagcaccttggcagagcttgtacaccatcactccacagtggctgatgggctggtgacaacattacactacccagcacccaagtgtaataagcctacagtctatggtgtgtcccccatccacgacaaatgggaaatggagcgaacagatattaccatgaagcacaaacttgggggcggtcagtatggagaggtttacgttggcgtctggaagaaatacagccttacagttgctgtgaaaacattgaaggaagataccatggaggtagaagaattcctgaaagaagctgcagtaatgaaggaaatcaagcatcctaatctggtacaacttttaggtgtgtgtactttggagccaccattttacattgtgactgaatacatgccatacgggaatttgctggattacctccgagaatgcaaccgagaagaggtgactgcagttgtgctgctctacatggccactcagatttcttctgcaatggagtacttagagaagaagaatttcatccatagagatcttgcagctcgtaactgcctagtgggagaaaaccatgtggtaaaagtggctgactttggcttaagtagattgatgactggagacacttatactgctcatgctggagccaaatttcctattaagtggacagcaccagagagtcttgcctacaataccttctcaattaaatctgacgtctgggcttttggggtattgttgtgggaaattgctacctatggaatgtcaccatatccaggtattgacctgtctcaggtctatgacctactagaaaaaggatatcgaatggaacagcctgagggatgcccccctaaggtttatgaacttatgagagcatgctggaagtggagccctgccgataggccctcttttgctgaaacacaccaagcttttgaaaccatgttccatgactccagcatttctgaagaggtagctgaggagcttgggagagccgcctcctcgtcatctgttgttccatacctgccccggctacctatacttccttccaagactcggacactgaagaaacaggtggagaacaaggagaacattgaaggggcacaagatgccacagaaaattctgcttccagtttagcaccagggttcatcagaggtgcacaggcctctagtggatccccagcactgcctcgaaagcaaagagacaagtcacccagcagcctcttggaagatgccaaagagacatgcttcaccagggataggaaggggggcttcttcagctccttcatgaagaagagaaatgctcctacaccccccaaacgcagcagctccttccgagaaatggagaatcagccccataagaaatacgaactcacgggtaacttctcatctgttgcttctctacagcatgctgatgggttctctttcactcctgcccagcaagaggcgaatctggtgccacccaagtgctatggggggagctttgcacagaggaacctctgtaatgacgacggtggtgggggtgggggcagtggcactgctgggggtgggtggtctggcatcacaggcttctttacaccacgcttaatcaaaaagacactgggcttacgagcaggtaaacccacagccagtgatgacacttccaagccttttccaaggtcaaactctacatcttccatgtcctcagggcttccagagcaggataggatggcaatgacccttcccaggaactgccagaggtccaaactccagctggaaaggacagtgtccacctcttctcagccagaagagaatgtggacagggccaatgacatgcttccaaaaaaatcagaggaaagtgctgctccaagcagggagagaccaaaagccaagttattgcccagaggagccacagctcttcctctcagaacaccctctggggatctagccattacagagaaggaccctccaggggtgggagtggctggagtggcagctgcccccaagggtaaagagaagaatggtggggcacgacttgggatggctggagttccagaggatggagagcagccgggctggccttctccagccaaggctgcccccgtcctcccaaccactcacaaccacaaagtgccagtccttatctcacccactctgaaacacactccagctgacgtgcagctcattggcacagactctcaggggaataaattcaagctcttatctgagcatcaggtcacatcctctggagacaaggaccgaccccgacgggtaaaaccaaagtgtgccccacccccaccaccagtgatgagactactgcagcatccgtccatctgctcagaccctacagaagagccaactgccctaactgcaggacagtccacatcagaaacacaggaaggaggaaagaaggcagctctgggcgcagtgcccatcagtgggaaagctgggaggccagtgatgcctccacctcaagtgcctctgcccacatcttccatctcgccagccaaaatggccaatggcacagcaggtactaaagtggctctgagaaaaaccaaacaggccgctgagaaaatctcagcagacaaaatcagcaaagaggccctgctggaatgtgctgacctactgtccagtgcactcacggaacctgtgcccaacagccagctggtagacactggacaccagctgcttgactactgctcaggctatgtggactgcatccctcaaactcgcaacaaatttgccttccgagaggctgtgagcaaactggaactcagcctgcaggagctacaggtttcttcagcagctgctggtgtgcccgggacaaaccctgtccttaataacttattgtcatgtgtacaggaaatcagtgatgtggtgcagaggtagccactgttagcctggtgggaaaatgcacacatttctgaggggagagggaaaaggacttgttttcctgtgttcttgttttcagaaaatgaaagactcatacttgagtgtgtttatgtgaagtacctcagatccctgagttctcacgtttacagtttcatctcaaaaataagaagcaaaccacataagtataggagaggtaaattaagtgggggcaaggcagtagtggacagggttggaaactgcactggaaaatagggaacatgtgtatgtcataaggaaggcaatgcagcccatccctacctggaatgctgggaagtgctaggcagggctgctctcagcaagactgcagcagctgcacccagacctggggctctggtaggtactaatggtgattatgctccaatttacctaatgaatttggtgggacagcagaaaagaaagctgggaatgtaccaagagaaatttttgttcagggctgttggaagtagctgttagccttgcttccacaaggccattgctgctgtaataagaactgcaaatcagagtgctacaacataaaactgggaaatatggccctatctgaatgcctctgtcctattttccgctggtgtatcagttagtgcaggaagtaaagaatgctggaaagttgaatcagaaattgaaaaccttctaaaatcttacacagattagcagaagtcacttctcccagtctggtatattatttcataatggaccaggatcggcttcctgcctgttggtggctatctgtaaaccataagtacaggggtctccctagtggttcttctctgtcttttgctgggcaggctgtcttcctttattcctggtagcattcagagcattaaccagtgttgattttgaaaatagtagtccctacaggttctcacaaaggaatgaatcctgttctgatacagttcccctgcatactgacatactggccaaggacttgagcagctgtgtatttttctttatcaactaaaataccagggagatggtcttttcttgaaacccagtggcctgtatgtgactgagaggaaaagctggcttggtcctaatggctgtttctctgtacctttcccttcccttaccaccttaagcccaatccaggtagagaatagggagaggcattctcctctctatggatttgaagtgaatcacccccacattattctcacatgcttttcttctctcacatattcctccctactcccccacccaatcattgtgcttatttgtacagatcttattgggaatattctttatttattttgtcatttcacttctattttaagaatgcataattgaaggagtagtcattttcagggagcaccaggtagaccctgggaacctaatgacttaatccttaaatatgttttgcccttgaaaaataggccttttccttccttccttagttataattgtggaagctaattaggatggcatggaagtgaatctaatgagttaggtattattaatgttcttggtatcgggtctaattccagttactgcttcattctctttttaaagctttatgaatacttcccccatcctccccaaggagagctcaatacacacatatttttattttattctctcaaaggaatattagcttaggaagataggaattcaacattgagcactgagttttcttctggctctgtcattgatacactgtcaaaccacagcctcatctcttaatctatttaattaaggtaacagtacatgttctcaagggtgttgcaagtaagtgtgcagctatcccttggagagcctctctggaaagctcttttagtgcagtgttgttatgctgaattgttttccattatcttatttgctgagtagaaaatattaatgaaattaagaattgttgagattatatgaattgggctagaatactaaggggaaaactatgttttgaatagagtttggcatttttgaccaagaacaaaattgagttttcattggaaagaaaggaaaccttgattcttaccattgctgctccaaaggaggcccaggttaagaggattagaggagacacgcggtgctgggcattcctggcaggtgttgggtgatccccgcagtatgtcacctgcagttgcagcacaggcagctagtgattgggttcatctcctcctagtggttggaagagaactcagatgtaaaaaccagcggtccttctcccaccttctttcctgccattcttgctcatcatacatgtccgtaaacttgaagaactcgttttagcagctagccttttaaggtcgaggatgggaaagctaaaactgtagaatattattatgctgctttttaggtttatccctgttgttgtgggatgcaagttaagggattgtaattgtttttcagggtttttttgttttttgttttttaagcaagggctctattttcccttgagagttctggaactaagccttggagaaacactactgagtgtatttaggctccctggttttcttgcccaacaacaatctgaagggtagggggtgggggctgtgtcttactcaggggcagcacctagctgtcttgcctacagtgggtgcacgatatataaatggaattgatttttgtcaacactgtcaagagtggcattgactattggagcataccccgtccacatgatgcttgaactatgtaacttcaggggttgagggctcaaggttcaggttaaagaggcactgtcaacttactatacaagcataatttaggtttttcctttttctacttgaaaaggaccagcttaaacacaaacccttatgtaaattaaaaggtttgaatccaaagcagagagaactgcttctggaaaagtgtagtttaattttaactattctaaaagcaatgagcaaaggcccttgtccaaggcgttgacagttttctaaagtggttatgctgtatatctggatgcatgcctttgggctgccactgcttgattcctttcatgtacagataatattacttcagtttagatttcccactttaaaatgcagtgatttgtgttgaatacatcttgattgtgctttacctaaagtattttcttaaaaggctttgtgtaaaatttaaatgtatatattttcctgtagacttccatcatgattttcagagattagccttaaaaaatttggccctaagaaattcattcagtgtttttctagatgacctctgtacatagaggtcattatagtggagaccctttaccagcagcattttaagatttaaattagatagaaagtttcttaggattcaactgaaaattggctagtaaaatatgtcccaggtaataaagcatgctgactttgctaaggcactgcccatttttatttaactaaagtcatggagattttgagtttaaaggatgcagtatagatagtggtttagtgtttaggctctaatgccagtctaaaaggcaagtcatttaaccttgggagcctcagtttcctcactgtaaaacagggataataatagtaactacctcagggttgttgtaaggattaaatgagatgatatttgtaagatacttagctcaagtgcctggcacacaatgagcacactctataaatgttctactactactattattaacacctagtctagggatgcacagcagaatcccctagggttaaaaaacaaaacaaaacaaacaaaaaaaactgacggaatagccccactccagatcagaattcccagtgggctggggtctcggccagtgtattctccagtaatctcgccaggtgtttgaaacacccagtgctatctgaaaactatcagtaccccaaccctttggtttatagattaagaaactagcagaagatggttaaattacttgcctattgtctcagaacggttaattagtggcggagccaaggctagaattcaagtctcttgactttatggttgtggggtctttccaccatacctgctgccatgtgagacactgcaaaaaagtggctcagaccgacaatcagcctgtgtggtgctgcacactttctaaagcacatgctcctgacactttgaccttaaggggcttgaatgtggagtaatgggaacacaagccaagcaagcactcagtagaattcagtcatttaaaaaattcaatggggtcattcttttggacagacctcagcaacacagcaatgtgcactttgtagtaaagaaataccaacttgagtttttaaaaaacctagttagtcctacattcccttttctttaaaaaaactttattgttcacattattttaatgactatgagataatgtatatgacagcactttgagaaaatatcaactgtaatataactataaggttgtagtattgtctgtttaaaagataagacagttgattcaatgtggatggaccctgtggggtacctgaaaatgtagatacgtaagaatcacctctgtcatttatcacatttagaaatatgaaactgcttaacaggtatgagcaggtatagcaagtgtttgctaaagttgtagttcagagctgaattacttcaggaaactagggaccaactttttggtttaattccgatctttaaaaagtaagaatgtgtactcactccagaacacagaagctcttccaaggaccttgactcaagaaggatgaggtcctcttactcttctccatttatccactatatgcttggccatttatcctaaatgtggtgggaacagacttgttatctgttgatgttgacagtgtcttttttaacctatgtcctgcatagttttgttaggtttacagggggaggtggatggccataaaaccagtgcactttgggaattacttttctaggatttcctaccagttataaatgacattgacatttgtcatcttttttttctttttctaaaaagaatagctgaatttaattcacctattataaaatactcaaaagtaaattgccttggtggccacttctgaattatagctacatttcattatgaccccttctgctcccttccattttgctactgatgtcattcttgttatcaggctgtgcccctaccaggagttcatattgggttgacagggttatctatatttttgttcttgatttttgagtttcatcatcttgcattaaattgttccacctggatttggggttcatctctgtgccctaaggatctgctatgaccaatcctctttttgtaggtgggtctctggcttaagtattgataggcttcagcggtttgtgtctctgtcttagcttgtatcaagccagtagtagctcacttcctttgtaaattcctgcttcagtctgggatccgtaggagtatgtgagaacttctgaaacgtctccaactcttaacagtcaagatatctatatcatttggatagagttctggttttccaactactagacttaaagaaattctggccgggtgcggtggctcacgcctgtaatcccagcactttggggggctgaggcgggtggatcacgaggtcaggagattgagaccatcctggctaacacggtgaaaccccacctctactaaaaatacaaaaacttagctgggcgtggtggcgggcgcctgtagtcccagctactggggaggctgaggcaggagaatggcgtgaacccaggaggcggagcttgcagtgagcccagatcgcgccactgcactccagcctgggtgacagtgagactccgtctcaaaaaaaaaaaaaaaaaaaaaaaaaaaaaaaaaaagaaattctaatgcaaagcttgctttttttttcttttttccagcaagccagtagtaatagttattgttacttgctctgttcagcacaactgtagttcacttgaacttcactgtcattccctacgctcctctcttactgagaagcatgggtgggattcagggctgtgggacaagctacagcctactctggagcactcacccccatgactcagtccagcctgtctcttgggaagtttattgcaatgtgcagacggatgaatttctgcttttcatgccacctctctgaggtatgtattctatcttgagtatgtacaagatgataccttttggctgggcacagtggctcgtgcctgtaatcccagcactttgggagaccaagatgggcggatcacttgaggtcaggagtttgagaccagcctggccaacatggtgaaaccccgtctctactaaaaatataaaaattagccgggcgtagtacatgcctgtaatcccagctactcccgaggctgaggcagaattgcttgaacccaggaggcggaggttgcagtgagctgagatcgcgccgctgcactccagcctaagtgacagagtgagacacgttaagaagaaaaaaaaaaaaaaggataccttcatttctgactcaatatcctagatccaaaggacaggaaattagggaaggcttcaccctgtgggatcaagataagaagatcccatacttcttcccaggtaaggaggcctgtggcaggtcatgattcaaagctgacttggaatggcagaaactgctgagaggccacccttggagatttgtgccttcaaagatgggtttcatgagtctcagagaggaaaagacttgtcagctgggttgattttgcatgattattgaactagagctggtagacacgagcttctcagatggcagtggccagatcctccatctgtgagaatccgccacttgaagtggtttcctgagagtgttcacttggcagttgctgcgtttctcaagcccacctggcgaggtctcgccggacccttccctccaagtgcacttacttcttcatccccatgtacatctctaactttgaaattgtttacctctcctacaaaaatcttaccttttgacctgagcagagtagcaaagccctgttcactctgagggagcagctggcgtgttgaaggggaaaggccaggcacagcactgtcctcagaccacaccatatttggagcagaattgtgatacatgtcatctgtgtctattctggaaggttctttgttcatcactgtactcgcatcagcaaattttcagggtcctacctgtcactccaggctactgagctgaaccctcagaagctgaggtctccgagcatgctaagtaaccttttagaaaagctggaggcaaactgtcgaatgctagcaggctttatgaaaggaaacataaggagtttgtgtagtcagaacttgcttaaatttgcttcggaattaggcaccataaactttagttggagaatgggacttaaattttcacatatatgtatacttaattttcagcaattatgacacaataaaaagaatatgcaaatttattgttgtttcagaaggttttgcaggactgggaacgctttagtgtcatcaacagtaaacctcagatactgttctgcacagttcagaagtaccataccaggtattgtgagtggcaagaacgccaggggacagagatgcttctggtagatgagggccagagaaaccagctctcctccattttgacagcaatttctcactgtggccatttggcctccattatgttttgagaggaatttcttgagatcttgagaaatcaccatgattaggccaattgtcaatcagtattcagaaactagaaaggaacaatgagatacttgtttatggttctttagggcatatgtttgaaaaccctctcatctcagatctgtatagctggtgtgtgtttgtgtccataaatacacgtgcattgctgtcgtgcccattaagaaagggggagtaagtaaaagaggaatcgctcagatctttccttggatgaacagcagtggcgtggttggtgtgttgactgtgaacaggctgacttagctgttgatgtatactcagaacctccatctcctcccagaccctgcacttttccttctctgcagtctgattctctaatgactgtcactggacaaaccccagttttatgctcgcttagtaaaaataagtttaaacatttcatggtggttgacagaactttgtccccaaacatgcggattcaattctttaaaactcgttgaacgtttataccaaaggtcccgccccgcaggtgtgtatgtggtgcacagagggtgaggtttggagcatcgggcactgtgtgcattgctaaggggacatagtgagacaatgtgggatttaactaaaaacacatcaattgtgtgtcacattaccagtgttgtcaggtatttgttcttaattgttattgtaatatattttcagttgtttttctaatttaattctctccgtctgttgtctgactgtgaactgctaacagtgttaaacttgatgtaaataaatgaggcccttgaaagggactgctttctctgtcttctcacaaggtttgccaagttgtgttctgttttaaataaaggttgcaatattttattggcaaagta

SEQ ID NO: 103351 - DNA, 3689 bp, Homo sapiens
  Payload ID: 151
  Gene Symbol: ABI1
  Gene Name: abl-interactor 1
  Uniprot ID: Q8IZP0
  ENST ID: ENST00000346832
  CDS Start-End: 225-1715
gagaaataaacgctcgcgagagaacgaggttcaggcggctgcacgaagggggtggaggggggctggagagagtgaggaggaaggggaggaggtgccgtcccacaataccaggcgggagggcgggtaggcggtttgtatccgggctgtgaggtgctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacagagacatggttttgctgtgttgctgtgtctgctctcaaactcctggcctcaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagtggctaaaagccaagcatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacagtggtagcagtagtattggcattcccattgctgtgcctacaccttcgccacccactattggaccagaaaacatttctgtccctcctccttctggagctccaccagcaccacctctggcaccacttctcccagtgagcactgtgatagcagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaattgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaattgagtctccaaggtctccatgtgaaacaagcaaaaagagaattatctgtaatgttgtaatttgtacctaagttttttaatgagtgaaatttgcattataaactttttccattcataaatacataagtgaaccaaaggtttttgtcctttccttcactgatttgctttaaaaaaaataaaagataatgatttattgcagaattatgattctattttctcaatatgttaacttggaaaaaaattttagccttatcttaatctgtcccaacagcaatgtgacggatttttgcagattcaaaatctgcaatggttatttacaagtcaatctactgaattccttttttaaataatcttttgaaactaagaaaatgtgtcaaattgtgtgcattcattctgtaggtaaaattcttaaggattgccatgtcagtccttcagttgtacagtgaactgttgtacactggttcaatgaaaggaagttaaaagtaccttttacatattgtaaaagtggatacagttgatttgtgagtaggcactctttaatccattacctggcactagcaacattagaattttaaaataaaataattgggaaagaaggtgggtcatgtattaatcagtgaacagagatttacctaaccaacagacttggattgtcttttgacataatcaaaatgcaacacatgcactttgtgtgtctcctcttaattgaagggagggctgagggatgttttctcttcttgtcttgtgtataattctctattgcttaggatattaaagtagagcactcaagtgtgggtttctgtgttattgaggatttgtttggaattcaaattacagttatgtactggatgctacagacttataacagcatagtgaatggtaagactagtgcaaaacagttatttctgaaaattaaagaccattattgctaccaaatcaatgtgactatttcatatgcattttgcctttgttaattttaaacaaacaaagtatcattagtgatcagctagctaccttctactttccatttttcaagtggattgttctcttaatttgtatataacctgttgtctaaattttatgtacagtcttttataataaaccattctcctatatgaaattttggatactgttaaaatataactcatgtggacttcaatgcagacttcacatttttctgacctttactcctacggtaaatcaagacaaaccatttgaattttaacattggttatttatttgtgtaatggccttacatgtggatattaacagtgtaaacaataccacatataaccatcaagataccttgattataatttataggactagaatgacagattcaggtggtttattaattacatttaaaaagttttctgaaaaaacttttgcaataaaaaaaaataaattgcccatcaa

SEQ ID NO: 103352 - DNA, 3492 bp, Homo sapiens
  Payload ID: 151
  Gene Symbol: ABI1
  Gene Name: abl-interactor 1
  Uniprot ID: Q8IZP0
  ENST ID: ENST00000359188
  CDS Start-End: 73-1515
gctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagtggctaaaagccaagcatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacagtggtagcagtagtattggcattcccattgctgtgcctacaccttcgccacccactattggaccagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaatttctattgctccaccccctccccctatgcctcagttgactccacagatacctctcacaggcttcgtggccagggtgcaggaaaacattgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaattgagtctccaaggtctccatgtgaaacaagcaaaaagagaattatctgtaatgttgtaatttgtacctaagttttttaatgagtgaaatttgcattataaactttttccattcataaatacataagtgaaccaaaggtttttgtcctttccttcactgatttgctttaaaaaaaataaaagataatgatttattgcagaattatgattctattttctcaatatgttaacttggaaaaaaattttagccttatcttaatctgtcccaacagcaatgtgacggatttttgcagattcaaaatctgcaatggttatttacaagtcaatctactgaattccttttttaaataatcttttgaaactaagaaaatgtgtcaaattgtgtgcattcattctgtaggtaaaattcttaaggattgccatgtcagtccttcagttgtacagtgaactgttgtacactggttcaatgaaaggaagttaaaagtaccttttacatattgtaaaagtggatacagttgatttgtgagtaggcactctttaatccattacctggcactagcaacattagaattttaaaataaaataattgggaaagaaggtgggtcatgtattaatcagtgaacagagatttacctaaccaacagacttggattgtcttttgacataatcaaaatgcaacacatgcactttgtgtgtctcctcttaattgaagggagggctgagggatgttttctcttcttgtcttgtgtataattctctattgcttaggatattaaagtagagcactcaagtgtgggtttctgtgttattgaggatttgtttggaattcaaattacagttatgtactggatgctacagacttataacagcatagtgaatggtaagactagtgcaaaacagttatttctgaaaattaaagaccattattgctaccaaatcaatgtgactatttcatatgcattttgcctttgttaattttaaacaaacaaagtatcattagtgatcagctagctaccttctactttccatttttcaagtggattgttctcttaatttgtatataacctgttgtctaaattttatgtacagtcttttataataaaccattctcctatatgaaattttggatactgttaaaatataactcatgtggacttcaatgcagacttcacatttttctgacctttactcctacggtaaatcaagacaaaccatttgaattttaacattggttatttatttgtgtaatggccttacatgtggatattaacagtgtaaacaataccacatataaccatcaagataccttgattataatttataggactagaatgacagattcaggtggtttattaattacatttaaaaagttttctgaaaaaacttttgcaataaaaaaaaataaattgcccatcaataa

SEQ ID NO: 103353 - DNA, 3467 bp, Homo sapiens
  Payload ID: 151
  Gene Symbol: ABI1
  Gene Name: abl-interactor 1
  Uniprot ID: Q8IZP0
  ENST ID: ENST00000376137
  CDS Start-End: 225-1493
gagaaataaacgctcgcgagagaacgaggttcaggcggctgcacgaagggggtggaggggggctggagagagtgaggaggaaggggaggaggtgccgtcccacaataccaggcgggagggcgggtaggcggtttgtatccgggctgtgaggtgctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagtggctaaaagccaagcatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacagtggtagcagtagtattggcattcccattgctgtgcctacaccttcgccacccactattggaccagtttctattgctccaccccctccccctatgcctcagttgactccacagatacctctcacaggcttcgtggccagggtgcaggaaaacattgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaattgagtctccaaggtctccatgtgaaacaagcaaaaagagaattatctgtaatgttgtaatttgtacctaagttttttaatgagtgaaatttgcattataaactttttccattcataaatacataagtgaaccaaaggtttttgtcctttccttcactgatttgctttaaaaaaaataaaagataatgatttattgcagaattatgattctattttctcaatatgttaacttggaaaaaaattttagccttatcttaatctgtcccaacagcaatgtgacggatttttgcagattcaaaatctgcaatggttatttacaagtcaatctactgaattccttttttaaataatcttttgaaactaagaaaatgtgtcaaattgtgtgcattcattctgtaggtaaaattcttaaggattgccatgtcagtccttcagttgtacagtgaactgttgtacactggttcaatgaaaggaagttaaaagtaccttttacatattgtaaaagtggatacagttgatttgtgagtaggcactctttaatccattacctggcactagcaacattagaattttaaaataaaataattgggaaagaaggtgggtcatgtattaatcagtgaacagagatttacctaaccaacagacttggattgtcttttgacataatcaaaatgcaacacatgcactttgtgtgtctcctcttaattgaagggagggctgagggatgttttctcttcttgtcttgtgtataattctctattgcttaggatattaaagtagagcactcaagtgtgggtttctgtgttattgaggatttgtttggaattcaaattacagttatgtactggatgctacagacttataacagcatagtgaatggtaagactagtgcaaaacagttatttctgaaaattaaagaccattattgctaccaaatcaatgtgactatttcatatgcattttgcctttgttaattttaaacaaacaaagtatcattagtgatcagctagctaccttctactttccatttttcaagtggattgttctcttaatttgtatataacctgttgtctaaattttatgtacagtcttttataataaaccattctcctatatgaaattttggatactgttaaaatataactcatgtggacttcaatgcagacttcacatttttctgacctttactcctacggtaaatcaagacaaaccatttgaattttaacattggttatttatttgtgtaatggccttacatgtggatattaacagtgtaaacaataccacatataaccatcaagataccttgattataatttataggactagaatgacagattcaggtggtttattaattacatttaaaaagttttctgaaaaaacttttgcaataaaaaaaaataaattgcccatcaa

SEQ ID NO: 103354 - DNA, 3503 bp, Homo sapiens
  Payload ID: 151
  Gene Symbol: ABI1
  Gene Name: abl-interactor 1
  Uniprot ID: Q8IZP0
  ENST ID: ENST00000376138
  CDS Start-End: 168-1526
gggggctggagagagtgaggaggaaggggaggaggtgccgtcccacaataccaggcgggagggcgggtaggcggtttgtatccgggctgtgaggtgctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagtggctaaaagccaagcatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacagtggtagcagtagtattggcattcccattgctgtgcctacaccttcgccacccactattggaccagcagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaattgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaattgagtctccaaggtctccatgtgaaacaagcaaaaagagaattatctgtaatgttgtaatttgtacctaagttttttaatgagtgaaatttgcattataaactttttccattcataaatacataagtgaaccaaaggtttttgtcctttccttcactgatttgctttaaaaaaaataaaagataatgatttattgcagaattatgattctattttctcaatatgttaacttggaaaaaaattttagccttatcttaatctgtcccaacagcaatgtgacggatttttgcagattcaaaatctgcaatggttatttacaagtcaatctactgaattccttttttaaataatcttttgaaactaagaaaatgtgtcaaattgtgtgcattcattctgtaggtaaaattcttaaggattgccatgtcagtccttcagttgtacagtgaactgttgtacactggttcaatgaaaggaagttaaaagtaccttttacatattgtaaaagtggatacagttgatttgtgagtaggcactctttaatccattacctggcactagcaacattagaattttaaaataaaataattgggaaagaaggtgggtcatgtattaatcagtgaacagagatttacctaaccaacagacttggattgtcttttgacataatcaaaatgcaacacatgcactttgtgtgtctcctcttaattgaagggagggctgagggatgttttctcttcttgtcttgtgtataattctctattgcttaggatattaaagtagagcactcaagtgtgggtttctgtgttattgaggatttgtttggaattcaaattacagttatgtactggatgctacagacttataacagcatagtgaatggtaagactagtgcaaaacagttatttctgaaaattaaagaccattattgctaccaaatcaatgtgactatttcatatgcattttgcctttgttaattttaaacaaacaaagtatcattagtgatcagctagctaccttctactttccatttttcaagtggattgttctcttaatttgtatataacctgttgtctaaattttatgtacagtcttttataataaaccattctcctatatgaaattttggatactgttaaaatataactcatgtggacttcaatgcagacttcacatttttctgacctttactcctacggtaaatcaagacaaaccatttgaattttaacattggttatttatttgtgtaatggccttacatgtggatattaacagtgtaaacaataccacatataaccatcaagataccttgattataatttataggactagaatgacagattcaggtggtttattaattacatttaaaaagttttctgaaaaaacttttgcaataaaaaaaaataaattgcccatcaataa

SEQ ID NO: 103355 - DNA, 3516 bp, Homo sapiens
  Payload ID: 151
  Gene Symbol: ABI1
  Gene Name: abl-interactor 1
  Uniprot ID: Q8IZP0
  ENST ID: ENST00000376139
  CDS Start-End: 109-1539
agggcgggtaggcggtttgtatccgggctgtgaggtgctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagcatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacagtggtagcagtagtattggcattcccattgctgtgcctacaccttcgccacccactattggaccagcagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaatttctattgctccaccccctccccctatgcctcagttgactccacagatacctctcacaggcttcgtggccagggtgcaggaaaacattgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaattgagtctccaaggtctccatgtgaaacaagcaaaaagagaattatctgtaatgttgtaatttgtacctaagttttttaatgagtgaaatttgcattataaactttttccattcataaatacataagtgaaccaaaggtttttgtcctttccttcactgatttgctttaaaaaaaataaaagataatgatttattgcagaattatgattctattttctcaatatgttaacttggaaaaaaattttagccttatcttaatctgtcccaacagcaatgtgacggatttttgcagattcaaaatctgcaatggttatttacaagtcaatctactgaattccttttttaaataatcttttgaaactaagaaaatgtgtcaaattgtgtgcattcattctgtaggtaaaattcttaaggattgccatgtcagtccttcagttgtacagtgaactgttgtacactggttcaatgaaaggaagttaaaagtaccttttacatattgtaaaagtggatacagttgatttgtgagtaggcactctttaatccattacctggcactagcaacattagaattttaaaataaaataattgggaaagaaggtgggtcatgtattaatcagtgaacagagatttacctaaccaacagacttggattgtcttttgacataatcaaaatgcaacacatgcactttgtgtgtctcctcttaattgaagggagggctgagggatgttttctcttcttgtcttgtgtataattctctattgcttaggatattaaagtagagcactcaagtgtgggtttctgtgttattgaggatttgtttggaattcaaattacagttatgtactggatgctacagacttataacagcatagtgaatggtaagactagtgcaaaacagttatttctgaaaattaaagaccattattgctaccaaatcaatgtgactatttcatatgcattttgcctttgttaattttaaacaaacaaagtatcattagtgatcagctagctaccttctactttccatttttcaagtggattgttctcttaatttgtatataacctgttgtctaaattttatgtacagtcttttataataaaccattctcctatatgaaattttggatactgttaaaatataactcatgtggacttcaatgcagacttcacatttttctgacctttactcctacggtaaatcaagacaaaccatttgaattttaacattggttatttatttgtgtaatggccttacatgtggatattaacagtgtaaacaataccacatataaccatcaagataccttgattataatttataggactagaatgacagattcaggtggtttattaattacatttaaaaagttttctgaaaaaacttttgcaataaaaaaaaataaattgcccatcaataa

SEQ ID NO: 103356 - DNA, 1446 bp, Homo sapiens
  Payload ID: 151
  Gene Symbol: ABI1
  Gene Name: abl-interactor 1
  Uniprot ID: Q8IZP0
  ENST ID: ENST00000376140
  CDS Start-End: 1-1446
atggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagtggctaaaagccaagcatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacagtggtagcagtagtattggcattcccattgctgtgcctacaccttcgccacccactattggaccagcagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaatttctattgctccaccccctccccctatgcctcagttgactccacagatacctctcacaggcttcgtggccagggtgcaggaaaacattgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaa

SEQ ID NO: 103357 - DNA, 3576 bp, Homo sapiens
  Payload ID: 151
  Gene Symbol: ABI1
  Gene Name: abl-interactor 1
  Uniprot ID: Q8IZP0
  ENST ID: ENST00000376142
  CDS Start-End: 73-1599
gctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagtggctaaaagccaagcatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacagtggtagcagtagtattggcattcccattgctgtgcctacaccttcgccacccactattggaccagaaaacatttctgtccctcctccttctggagctccaccagcaccacctctggcaccacttctcccagtgagcactgtgatagcagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaatttctattgctccaccccctccccctatgcctcagttgactccacagatacctctcacaggcttcgtggccagggtgcaggaaaacattgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaattgagtctccaaggtctccatgtgaaacaagcaaaaagagaattatctgtaatgttgtaatttgtacctaagttttttaatgagtgaaatttgcattataaactttttccattcataaatacataagtgaaccaaaggtttttgtcctttccttcactgatttgctttaaaaaaaataaaagataatgatttattgcagaattatgattctattttctcaatatgttaacttggaaaaaaattttagccttatcttaatctgtcccaacagcaatgtgacggatttttgcagattcaaaatctgcaatggttatttacaagtcaatctactgaattccttttttaaataatcttttgaaactaagaaaatgtgtcaaattgtgtgcattcattctgtaggtaaaattcttaaggattgccatgtcagtccttcagttgtacagtgaactgttgtacactggttcaatgaaaggaagttaaaagtaccttttacatattgtaaaagtggatacagttgatttgtgagtaggcactctttaatccattacctggcactagcaacattagaattttaaaataaaataattgggaaagaaggtgggtcatgtattaatcagtgaacagagatttacctaaccaacagacttggattgtcttttgacataatcaaaatgcaacacatgcactttgtgtgtctcctcttaattgaagggagggctgagggatgttttctcttcttgtcttgtgtataattctctattgcttaggatattaaagtagagcactcaagtgtgggtttctgtgttattgaggatttgtttggaattcaaattacagttatgtactggatgctacagacttataacagcatagtgaatggtaagactagtgcaaaacagttatttctgaaaattaaagaccattattgctaccaaatcaatgtgactatttcatatgcattttgcctttgttaattttaaacaaacaaagtatcattagtgatcagctagctaccttctactttccatttttcaagtggattgttctcttaatttgtatataacctgttgtctaaattttatgtacagtcttttataataaaccattctcctatatgaaattttggatactgttaaaatataactcatgtggacttcaatgcagacttcacatttttctgacctttactcctacggtaaatcaagacaaaccatttgaattttaacattggttatttatttgtgtaatggccttacatgtggatattaacagtgtaaacaataccacatataaccatcaagataccttgattataatttataggactagaatgacagattcaggtggtttattaattacatttaaaaagttttctgaaaaaacttttgcaataaaaaaaaataaattgcccatcaataa

SEQ ID NO: 103358 - DNA, 3515 bp, Homo sapiens
  Payload ID: 151
  Gene Symbol: ABI1
  Gene Name: abl-interactor 1
  ENST ID: ENST00000376160
  CDS Start-End: 111-1538
ggagggcgggtaggcggtttgtatccgggctgtgaggtgctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagcatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacagtggtagcagtagtattggcattcccattgctgtgcctacaccttcgccacccactattggaccagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaatttctattgctccaccccctccccctatgcctcagttgactccacagatacctctcacaggcttcgtggccagggtgcaggaaaacattgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaattgagtctccaaggtctccatgtgaaacaagcaaaaagagaattatctgtaatgttgtaatttgtacctaagttttttaatgagtgaaatttgcattataaactttttccattcataaatacataagtgaaccaaaggtttttgtcctttccttcactgatttgctttaaaaaaaataaaagataatgatttattgcagaattatgattctattttctcaatatgttaacttggaaaaaaattttagccttatcttaatctgtcccaacagcaatgtgacggatttttgcagattcaaaatctgcaatggttatttacaagtcaatctactgaattccttttttaaataatcttttgaaactaagaaaatgtgtcaaattgtgtgcattcattctgtaggtaaaattcttaaggattgccatgtcagtccttcagttgtacagtgaactgttgtacactggttcaatgaaaggaagttaaaagtaccttttacatattgtaaaagtggatacagttgatttgtgagtaggcactctttaatccattacctggcactagcaacattagaattttaaaataaaataattgggaaagaaggtgggtcatgtattaatcagtgaacagagatttacctaaccaacagacttggattgtcttttgacataatcaaaatgcaacacatgcactttgtgtgtctcctcttaattgaagggagggctgagggatgttttctcttcttgtcttgtgtataattctctattgcttaggatattaaagtagagcactcaagtgtgggtttctgtgttattgaggatttgtttggaattcaaattacagttatgtactggatgctacagacttataacagcatagtgaatggtaagactagtgcaaaacagttatttctgaaaattaaagaccattattgctaccaaatcaatgtgactatttcatatgcattttgcctttgttaattttaaacaaacaaagtatcattagtgatcagctagctaccttctactttccatttttcaagtggattgttctcttaatttgtatataacctgttgtctaaattttatgtacagtcttttataataaaccattctcctatatgaaattttggatactgttaaaatataactcatgtggacttcaatgcagacttcacatttttctgacctttactcctacggtaaatcaagacaaaccatttgaattttaacattggttatttatttgtgtaatggccttacatgtggatattaacagtgtaaacaataccacatataaccatcaagataccttgattataatttataggactagaatgacagattcaggtggtttattaattacatttaaaaagttttctgaaaaaacttttgcaataaaaaaaaataaattgcccatcaataa

SEQ ID NO: 103359 - DNA, 3441 bp, Homo sapiens
  Payload ID: 151
  Gene Symbol: ABI1
  Gene Name: abl-interactor 1
  Uniprot ID: Q8IZP0
  ENST ID: ENST00000376166
  CDS Start-End: 124-1464
acaataccaggcgggagggcgggtaggcggtttgtatccgggctgtgaggtgctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagcatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacagtggtagcagtagtattggcattcccattgctgtgcctacaccttcgccacccactattggaccagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaattgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaattgagtctccaaggtctccatgtgaaacaagcaaaaagagaattatctgtaatgttgtaatttgtacctaagttttttaatgagtgaaatttgcattataaactttttccattcataaatacataagtgaaccaaaggtttttgtcctttccttcactgatttgctttaaaaaaaataaaagataatgatttattgcagaattatgattctattttctcaatatgttaacttggaaaaaaattttagccttatcttaatctgtcccaacagcaatgtgacggatttttgcagattcaaaatctgcaatggttatttacaagtcaatctactgaattccttttttaaataatcttttgaaactaagaaaatgtgtcaaattgtgtgcattcattctgtaggtaaaattcttaaggattgccatgtcagtccttcagttgtacagtgaactgttgtacactggttcaatgaaaggaagttaaaagtaccttttacatattgtaaaagtggatacagttgatttgtgagtaggcactctttaatccattacctggcactagcaacattagaattttaaaataaaataattgggaaagaaggtgggtcatgtattaatcagtgaacagagatttacctaaccaacagacttggattgtcttttgacataatcaaaatgcaacacatgcactttgtgtgtctcctcttaattgaagggagggctgagggatgttttctcttcttgtcttgtgtataattctctattgcttaggatattaaagtagagcactcaagtgtgggtttctgtgttattgaggatttgtttggaattcaaattacagttatgtactggatgctacagacttataacagcatagtgaatggtaagactagtgcaaaacagttatttctgaaaattaaagaccattattgctaccaaatcaatgtgactatttcatatgcattttgcctttgttaattttaaacaaacaaagtatcattagtgatcagctagctaccttctactttccatttttcaagtggattgttctcttaatttgtatataacctgttgtctaaattttatgtacagtcttttataataaaccattctcctatatgaaattttggatactgttaaaatataactcatgtggacttcaatgcagacttcacatttttctgacctttactcctacggtaaatcaagacaaaccatttgaattttaacattggttatttatttgtgtaatggccttacatgtggatattaacagtgtaaacaataccacatataaccatcaagataccttgattataatttataggactagaatgacagattcaggtggtttattaattacatttaaaaagttttctgaaaaaacttttgcaataaaaaaaaataaattgcccatcaataa

SEQ ID NO: 103360 - DNA, 3362 bp, Homo sapiens
  Payload ID: 151
  Gene Symbol: ABI1
  Gene Name: abl-interactor 1
  Uniprot ID: Q8IZP0
  ENST ID: ENST00000376170
  CDS Start-End: 30-1385
cgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagtggctaaaagccaagcatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacagtggtagcagtagtattggcattcccattgctgtgcctacaccttcgccacccactattggaccagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaattgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaattgagtctccaaggtctccatgtgaaacaagcaaaaagagaattatctgtaatgttgtaatttgtacctaagttttttaatgagtgaaatttgcattataaactttttccattcataaatacataagtgaaccaaaggtttttgtcctttccttcactgatttgctttaaaaaaaataaaagataatgatttattgcagaattatgattctattttctcaatatgttaacttggaaaaaaattttagccttatcttaatctgtcccaacagcaatgtgacggatttttgcagattcaaaatctgcaatggttatttacaagtcaatctactgaattccttttttaaataatcttttgaaactaagaaaatgtgtcaaattgtgtgcattcattctgtaggtaaaattcttaaggattgccatgtcagtccttcagttgtacagtgaactgttgtacactggttcaatgaaaggaagttaaaagtaccttttacatattgtaaaagtggatacagttgatttgtgagtaggcactctttaatccattacctggcactagcaacattagaattttaaaataaaataattgggaaagaaggtgggtcatgtattaatcagtgaacagagatttacctaaccaacagacttggattgtcttttgacataatcaaaatgcaacacatgcactttgtgtgtctcctcttaattgaagggagggctgagggatgttttctcttcttgtcttgtgtataattctctattgcttaggatattaaagtagagcactcaagtgtgggtttctgtgttattgaggatttgtttggaattcaaattacagttatgtactggatgctacagacttataacagcatagtgaatggtaagactagtgcaaaacagttatttctgaaaattaaagaccattattgctaccaaatcaatgtgactatttcatatgcattttgcctttgttaattttaaacaaacaaagtatcattagtgatcagctagctaccttctactttccatttttcaagtggattgttctcttaatttgtatataacctgttgtctaaattttatgtacagtcttttataataaaccattctcctatatgaaattttggatactgttaaaatataactcatgtggacttcaatgcagacttcacatttttctgacctttactcctacggtaaatcaagacaaaccatttgaattttaacattggttatttatttgtgtaatggccttacatgtggatattaacagtgtaaacaataccacatataaccatcaagataccttgattataatttataggactagaatgacagattcaggtggtttattaattacatttaaaaagttttctgaaaaaacttttgcaataaaaaaaaataaattgcccatcaataa

SEQ ID NO: 103361 - DNA, 3380 bp, Homo sapiens
  Payload ID: 151
  Gene Symbol: ABI1
  Gene Name: abl-interactor 1
  ENST ID: ENST00000536334
  CDS Start-End: 225-1406
gagaaataaacgctcgcgagagaacgaggttcaggcggctgcacgaagggggtggaggggggctggagagagtgaggaggaaggggaggaggtgccgtcccacaataccaggcgggagggcgggtaggcggtttgtatccgggctgtgaggtgctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagtggctaaaagccaagcatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacagtggtagcagtagtattggcattcccattgctgtgcctacaccttcgccacccactattggaccagttgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaattgagtctccaaggtctccatgtgaaacaagcaaaaagagaattatctgtaatgttgtaatttgtacctaagttttttaatgagtgaaatttgcattataaactttttccattcataaatacataagtgaaccaaaggtttttgtcctttccttcactgatttgctttaaaaaaaataaaagataatgatttattgcagaattatgattctattttctcaatatgttaacttggaaaaaaattttagccttatcttaatctgtcccaacagcaatgtgacggatttttgcagattcaaaatctgcaatggttatttacaagtcaatctactgaattccttttttaaataatcttttgaaactaagaaaatgtgtcaaattgtgtgcattcattctgtaggtaaaattcttaaggattgccatgtcagtccttcagttgtacagtgaactgttgtacactggttcaatgaaaggaagttaaaagtaccttttacatattgtaaaagtggatacagttgatttgtgagtaggcactctttaatccattacctggcactagcaacattagaattttaaaataaaataattgggaaagaaggtgggtcatgtattaatcagtgaacagagatttacctaaccaacagacttggattgtcttttgacataatcaaaatgcaacacatgcactttgtgtgtctcctcttaattgaagggagggctgagggatgttttctcttcttgtcttgtgtataattctctattgcttaggatattaaagtagagcactcaagtgtgggtttctgtgttattgaggatttgtttggaattcaaattacagttatgtactggatgctacagacttataacagcatagtgaatggtaagactagtgcaaaacagttatttctgaaaattaaagaccattattgctaccaaatcaatgtgactatttcatatgcattttgcctttgttaattttaaacaaacaaagtatcattagtgatcagctagctaccttctactttccatttttcaagtggattgttctcttaatttgtatataacctgttgtctaaattttatgtacagtcttttataataaaccattctcctatatgaaattttggatactgttaaaatataactcatgtggacttcaatgcagacttcacatttttctgacctttactcctacggtaaatcaagacaaaccatttgaattttaacattggttatttatttgtgtaatggccttacatgtggatattaacagtgtaaacaataccacatataaccatcaagataccttgattataatttataggactagaatgacagattcaggtggtttattaattacatttaaaaagttttctgaaaaaacttttgcaataaaaaaaaataaattgcccatcaa

SEQ ID NO: 103362 - DNA, 3188 bp, Homo sapiens
  Payload ID: 151
  Gene Symbol: ABI1
  Gene Name: abl-interactor 1
  Uniprot ID: Q8IZP0
  ENST ID: ENST00000490841
  CDS Start-End: 225-1214
gagaaataaacgctcgcgagagaacgaggttcaggcggctgcacgaagggggtggaggggggctggagagagtgaggaggaaggggaggaggtgccgtcccacaataccaggcgggagggcgggtaggcggtttgtatccgggctgtgaggtgctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagcatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacagtggtagcagtagtattggcattcccattgctgtgcctacaccttcgccacccactattggaccagttgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaattgagtctccaaggtctccatgtgaaacaagcaaaaagagaattatctgtaatgttgtaatttgtacctaagttttttaatgagtgaaatttgcattataaactttttccattcataaatacataagtgaaccaaaggtttttgtcctttccttcactgatttgctttaaaaaaaataaaagataatgatttattgcagaattatgattctattttctcaatatgttaacttggaaaaaaattttagccttatcttaatctgtcccaacagcaatgtgacggatttttgcagattcaaaatctgcaatggttatttacaagtcaatctactgaattccttttttaaataatcttttgaaactaagaaaatgtgtcaaattgtgtgcattcattctgtaggtaaaattcttaaggattgccatgtcagtccttcagttgtacagtgaactgttgtacactggttcaatgaaaggaagttaaaagtaccttttacatattgtaaaagtggatacagttgatttgtgagtaggcactctttaatccattacctggcactagcaacattagaattttaaaataaaataattgggaaagaaggtgggtcatgtattaatcagtgaacagagatttacctaaccaacagacttggattgtcttttgacataatcaaaatgcaacacatgcactttgtgtgtctcctcttaattgaagggagggctgagggatgttttctcttcttgtcttgtgtataattctctattgcttaggatattaaagtagagcactcaagtgtgggtttctgtgttattgaggatttgtttggaattcaaattacagttatgtactggatgctacagacttataacagcatagtgaatggtaagactagtgcaaaacagttatttctgaaaattaaagaccattattgctaccaaatcaatgtgactatttcatatgcattttgcctttgttaattttaaacaaacaaagtatcattagtgatcagctagctaccttctactttccatttttcaagtggattgttctcttaatttgtatataacctgttgtctaaattttatgtacagtcttttataataaaccattctcctatatgaaattttggatactgttaaaatataactcatgtggacttcaatgcagacttcacatttttctgacctttactcctacggtaaatcaagacaaaccatttgaattttaacattggttatttatttgtgtaatggccttacatgtggatattaacagtgtaaacaataccacatataaccatcaagataccttgattataatttataggactagaatgacagattcaggtggtttattaattacatttaaaaagttttctgaaaaaacttttgcaataaaaaaaaataaattgcccatcaa

SEQ ID NO: 103363 - DNA, 6634 bp, Homo sapiens
  Payload ID: 152
  Gene Symbol: ABI2
  Gene Name: abl-interactor 2
  ENST ID: ENST00000261016
  CDS Start-End: 642-1814
gggaatctttttcgggctcccgggggcggagggaagggagcgcgcgtgcgcgcgcccggccggccgtcgccgcggtgaccgtcctcggagtccgtcggctcgcgccccgcccccgtcgccccctcccctgtcgcgcgctggggctgtttctcgctccttccgagttaccgccgccgtcgccgccgctcctcctctcccggtcctgggtttccttggcgctgcggccgccgctccctctgcgacctgtatgaggaggaggaggaggaggatgtgaagatggcggagctgcagatgctgctggaagaggaaatcccggggggccgccgggccctcttcgacagctacacaaatctggaacgggtggccgattactgcgagaacaactacatacagcagataagcagagagccctagaagaaaccaaagcctacaccacccaatccttagcaagtgttgcctatctgataaacaccttggccaacaatgtcctgcagatgctggatatccaggcatcccagctacgaaggatggaatcttcaatcaatcatatttcacaagcaatactgcagttcaaccccgtgtggtagtatgatggcaagaatgcaaattataccgttgttagattacctttattattatagatgttttttaaaagttatttacttaaaatatctatacttaggcaaattagaggcgttgatcttgagtcgacttttgtgaccaaatttggaaacaattgcagtttgagattgaatgagacagttgatattcataaagagaaagttgcaagaagagaaattggtattttgactaccaataaaaacacttcaaggacacataagattattgctccagccaaccttgaacgaccagttcgttatattagaaaacctattgactatacaattctagatgatattggacatggagtaaaggtgagtacccagaacatgaagatgggtgggctgccgcgtacaacacctccaactcagaagccccctagtccccctatgtcagggaaagggacacttgggcggcactccccctatcgcacactggagccagtgcgtcctccagtggtaccaaatgattacgtacctagcccaacccgtaatatggctccctcgcagcagagccctgtgaggacagcttctgtgaatcaaagaaatcgaacttacagcagcagtgggagtagtggagggagccacccaagtagtcggagcagcagtcgagagaacagtggaagtggtagtgtgggggttcctattgctgttcctactccatctcctcccagtgtctttccaggtcatcctgtacagttctacagcatgaataggcctgcctctcgccatactcccccaacaatagggggctcgttgccctatagacgccctccttccattacttcacaaacaagccttcagaatcagatgaatggaggacctttttatagccagaatccagtttcagatacaccacctccaccgccacctgtggaagaaccagtctttgatgagtctcccccacctcctcctcctccagaagattacgaagaggaggaagctgctgtggttgagtatagtgatccttatgctgaagaggacccaccgtgggctccacgttcttacttggaaaaggttgtggcaatttatgactatacaaaagacaaggaagatgagctgtcctttcaggaaggagccattatttatgtcatcaagaagaatgacgatggttggtatgagggagttatgaatggagtgactgggctttttcctgggaattacgttgagtctatcatgcattattctgagtaaagctcagcagggctgtgcttgcctcacaggaatagtcaggtcttcccagattatctgaaggccctggggattccactccagtaaagtagaatgaaggatacaaatgataaaaattacacttttttttttggtttattccccagtattaaaaacaaagcaagctgagtctgaacaaatggatctttctgccatcatttgtacaatgctgagctgtctggattgaaataaaatgaccatttttatgtatgtcaaaggtataacagcataactgtgtagccaaaacaaaatcagattaagactgattcagaaaaatctgggatctttctcaggaatactgtatacccttgggatttctcctcctgcagaatctgtggcattggatgttcttcattgcctgtgctaaggggttaacctcatggcccagtgggtaccctagccccttcttttcttccacttgtatgaagaggagggaaccaacatttaaataccacacttaaccatttttacaattatttcagatggcttttttcctctgtgacactgtaaattctgcattctctcagcacttgagtgcaccaaacgagtgaatgctgaactcacttgcatcccttcatgtttctgtttgtggattataaggatgatgaaatgtgaaagtctcccaacactctgagggtggtgaacgattgccacccgtttgattttaatgtgctgctgcatgagactgcattgttgctaatggccagtgtacccagatgtgaagtgtggtaggctggttcatatgtggaggtgggtgtgtgaagctagacacgaaggtccctaaggttctgaagagacttgaactgtggaaatgctcttagcaggcatcccgaacccctgcttcggtgctgttttgaggagtaggatcttggagttcagaccaactatgactatcatttccttcactatctagaaaaacgctattctactttggaagagaatagtagttattttcaagtctcctgacagtcactgggagtacaaggtttgctaatgtgctctctggacgttattaatggccagtattagttgctgctgtattactgactcgcttagctgtagaaagggtaatactctcctgattttgtatgattggactcttaagtagctgctgttagtcagaattaaaacccatctcagactaagaatataatgaataagattaataggccaaaatatgtatctaatcacattgataaaaattaatataactgacacaataaaacacatttcccccatctgtacaataaatacagcttcaaattcagtggagtctgtagggcagataactttaatcatcactactgtagtcagtataagaaatgctgaaaaaaatccaggagggcttgtctctttgtgggtggtcactgtgatgttgggccagctcctgttcaggtccagagctgctaacgtgggttctactcagtcccagtgacttggccagaatagagctttgccaggtaactgccctgtgctaggtgaaaggggaaaagcagtagctggatatatttcaaatgaggttttgaacaagttcagaaagtggaacttgattgaaaagtgaacaagtgtagtagtgtgtgagaaaattcagatggtgtcggatgcagaagttaatattccacttaatgttatctgagcattaaaaatcatcagcatttaactgagaccccactatagagtttccttatcaagactttttggttttaaagttgtttttaatgcattgcaagttacaatagctattttgcttttagatttttcccagcactttgtatttattagctttcattaacttgcctccagtatacattccacttcgtgcttttcttaggtcatttctacatcccttattccttgttttcctgcagtgtaatggccctgaatgtcctctgagccttcagctccattatggacccaaactagactatacttggataagttaagctcttcttcgtgtactggtctataattagaaaaactgttttaaattagatgttcccattatttatttaaacagctttttgctgagaaagcttagtggattaatgaggcagagggtgttttgaaatccaataaatagttcccacaggctgggtgtggtggcttatgcctgtaatcccagcactttcggaggccgaggtgggtggatcatgaggtcaataaattgagaccatcctggccaacatggtgaaaccccatctctactaaaaacacaaaaattagctgggcgtggtggcgcacacctgtagtcccagctacttgggaggctgaggcaggagaatcactggaacctgggaggcagaggttgcagtgagccgagattgtgccactgcactccagcctggtgacagagcgagactccatcaaaaaaaaaaaaaaaaagttcccacagctcaccactacagaagcagggaagacaactatgcagaaaacagagttagtggcggtcagcaggaatgcagctggtcttttggacccctacgggatgggggcagtgcagaagacactggtgaagtcctttatactgaagacctgtggttgggagcaggggtagtccatgggtctgctgattttttttccctatttagtactaatgtgtgtgtgatctttgttttacaaacagtaccttttgggttttctgcatattttataatttttgtacagttttgaattctatagattgtcttggaaggatactgtgtgatgggtcaggcacacagtaattggagacttttaatgtatgtaatatttcatagattgcatgctattaatcatctgtgagggtagtattttttgttttattgtaagtttccctctttttttataaattaaaagatggttggtattaggaatttcaaatgaatgcagaaaatcttacatgctgtgtactattaatattataacagacgatccaagtccaaaatctgaccaataaagcaaccattttatcaagatagagggattctaatgggagaggggattcttccctcctgaagtttgtgtgtccagtccccttaaaaaaaatgaatagttgtcttttcttgtcatattaatactcgaaagtccatggtggtattaatgaaagtacactttattgttgcctttgaacttacggccaaggcaataaatcagaaacaaaaatagtgccaatgtgtcaaaatcgacatctgagagattcagcctcccatttggaataaatatgaatcttctaagctatcttgtttaatattttccatcatttagctacttcctatctccctcagaggcgcctgctgttcccattttagagttgacagtggcctgctaattttgctatgttcctaaaagttactgggtgtgagacattttcatcccctcctttttcctactgctggtgtttattatccagctagacaatattttatgcatatttaccgtgatgtctggaccgtacctgtgctccttggcagtttatgttgaagataactaaagatttttctctttgggaggcatcaaaatgatggtagtttgcttttatctttttatgttcattttcttttagtaggtgacctttctgcattaagaactgtttttatcttttactaccttttcttttctcctttgtggagacagcatgacatgtcctgaaggtcacctttgcctttgaaaaaggtttgatggaggaattcacaggtgactgacaagtctttgaaaagaatgggatctgctcacttctggtctttttggccgggaactcctgattggtgttaaggtggtaatttcccccatataagatttagaatcactgagtttgagctagatgaaatttttaaaatttctggttgtctcattagactgatgaggtgagttttcttcttcatatgaacagctagttaataacagcagagttctcactcagtgctcagtacttaattttccactgcaccacaactgtcttaactaaatgtgctgtatttttctttaaaagttaagagttctatttggtgttttcaggaatatacgtgaaaagacatgccatgttttggtaaataccatcagagttgtgtaaaggcgtgtactaagtgcaatcttaatttgtggaaataatcttcatttacccctcctaaaactacactcagtataaacactttcccataaggtgtgtgcagtaaaaatgttatattactccaacactggcaggagcacagcacagcagccttattggagagagccttataaaagtgattaaatggaggcattgagctcattacctttaagtttactttgtgctgacctttgttcctgttttgagaatctcatataattattaaaaaaaaaaaacaattaaaacgaaacggcggggcctagctgtgtataaatgatccttgctgaatatcttaaggttttttgtaagaaaaaagaaaaaccaacaaaaaaagcttattttcacattaaaatgaaacctcttttgcaacttaagaattctatggaaaagcagtttttatcatattttgtgtccatgcaccatttttcttaaaatggcttacaaaaaagaatgtaaacaatttgtgatctggccagttgtacttttagctcccagagggagagttggtggtattatgagttgagtaaaaaccatccaggggaacttgagggagcagtctgttgccagtaatgttccttgtgtgccattaaaccacctccagatgagtggaggaacatcactttttaattttttaattgtatttggaattgttgccgtgtactaagaacttgacctaaataaaatcccacaaagtatattc

SEQ ID NO: 103364 - DNA, 6484 bp, Homo sapiens
  Payload ID: 152
  Gene Symbol: ABI2
  Gene Name: abl-interactor 2
  Uniprot ID: Q9NYB9
  ENST ID: ENST00000261017
  CDS Start-End: 236-1663
gcgcgtgcgcgcgcccggccggccgtcgccgcggtgaccgtcctcggagtccgtcggctcgcgccccgcccccgtcgccccctcccctgtcgcgcgctggggctgtttctcgctccttccgagttaccgccgccgtcgccgccgctcctcctctcccggtcctgggtttccttggcgctgcggccgccgctccctctgcgacctgtatgaggaggaggaggaggaggatgtgaagatggcggagctgcagatgctgctggaagaggaaatcccggggggccgccgggccctcttcgacagctacacaaatctggaacgggtggccgattactgcgagaacaactacatacagtcagcagataagcagagagccctagaagaaaccaaagcctacaccacccaatccttagcaagtgttgcctatctgataaacaccttggccaacaatgtcctgcagatgctggatatccaggcatcccagctacgaaggatggaatcttcaatcaatcatatttcacaaacagttgatattcataaagagaaagttgcaagaagagaaattggtattttgactaccaataaaaacacttcaaggacacataagattattgctccagccaaccttgaacgaccagttcgttatattagaaaacctattgactatacaattctagatgatattggacatggagtaaaggtgagtacccagaacatgaagatgggtgggctgccgcgtacaacacctccaactcagaagccccctagtccccctatgtcagggaaagggacacttgggcggcactccccctatcgcacactggagccagtgcgtcctccagtggtaccaaatgattacgtacctagcccaacccgtaatatggctccctcgcagcagagccctgtgaggacagcttctgtgaatcaaagaaatcgaacttacagcagcagtgggagtagtggagggagccacccaagtagtcggagcagcagtcgagagaacagtggaagtggtagtgtgggggttcctattgctgttcctactccatctcctcccagtgtctttccaggtcatcctgtacagttctacagcatgaataggcctgcctctcgccatactcccccaacaatagggggctcgttgccctatagacgccctccttccattacttcacaaacaagccttcagaatcagatgaatggaggacctttttatagccagaatccagtatctcttgctcctcctcctccctccatcctacaggtaactcctcagttacctttaatgggatttgtggccagagtccaagaaaatatttcagatacaccacctccaccgccacctgtggaagaaccagtctttgatgagtctcccccacctcctcctcctccagaagattacgaagaggaggaagctgctgtggttgagtatagtgatccttatgctgaagaggacccaccgtgggctccacgttcttacttggaaaaggttgtggcaatttatgactatacaaaagacaaggaagatgagctgtcctttcaggaaggagccattatttatgtcatcaagaagaatgacgatggttggtatgagggagttatgaatggagtgactgggctttttcctgggaattacgttgagtctatcatgcattattctgagtaaagctcagcagggctgtgcttgcctcacaggaatagtcaggtcttcccagattatctgaaggccctggggattccactccagtaaagtagaatgaaggatacaaatgataaaaattacacttttttttttggtttattccccagtattaaaaacaaagcaagctgagtctgaacaaatggatctttctgccatcatttgtacaatgctgagctgtctggattgaaataaaatgaccatttttatgtatgtcaaaggtataacagcataactgtgtagccaaaacaaaatcagattaagactgattcagaaaaatctgggatctttctcaggaatactgtatacccttgggatttctcctcctgcagaatctgtggcattggatgttcttcattgcctgtgctaaggggttaacctcatggcccagtgggtaccctagccccttcttttcttccacttgtatgaagaggagggaaccaacatttaaataccacacttaaccatttttacaattatttcagatggcttttttcctctgtgacactgtaaattctgcattctctcagcacttgagtgcaccaaacgagtgaatgctgaactcacttgcatcccttcatgtttctgtttgtggattataaggatgatgaaatgtgaaagtctcccaacactctgagggtggtgaacgattgccacccgtttgattttaatgtgctgctgcatgagactgcattgttgctaatggccagtgtacccagatgtgaagtgtggtaggctggttcatatgtggaggtgggtgtgtgaagctagacacgaaggtccctaaggttctgaagagacttgaactgtggaaatgctcttagcaggcatcccgaacccctgcttcggtgctgttttgaggagtaggatcttggagttcagaccaactatgactatcatttccttcactatctagaaaaacgctattctactttggaagagaatagtagttattttcaagtctcctgacagtcactgggagtacaaggtttgctaatgtgctctctggacgttattaatggccagtattagttgctgctgtattactgactcgcttagctgtagaaagggtaatactctcctgattttgtatgattggactcttaagtagctgctgttagtcagaattaaaacccatctcagactaagaatataatgaataagattaataggccaaaatatgtatctaatcacattgataaaaattaatataactgacacaataaaacacatttcccccatctgtacaataaatacagcttcaaattcagtggagtctgtagggcagataactttaatcatcactactgtagtcagtataagaaatgctgaaaaaaatccaggagggcttgtctctttgtgggtggtcactgtgatgttgggccagctcctgttcaggtccagagctgctaacgtgggttctactcagtcccagtgacttggccagaatagagctttgccaggtaactgccctgtgctaggtgaaaggggaaaagcagtagctggatatatttcaaatgaggttttgaacaagttcagaaagtggaacttgattgaaaagtgaacaagtgtagtagtgtgtgagaaaattcagatggtgtcggatgcagaagttaatattccacttaatgttatctgagcattaaaaatcatcagcatttaactgagaccccactatagagtttccttatcaagactttttggttttaaagttgtttttaatgcattgcaagttacaatagctattttgcttttagatttttcccagcactttgtatttattagctttcattaacttgcctccagtatacattccacttcgtgcttttcttaggtcatttctacatcccttattccttgttttcctgcagtgtaatggccctgaatgtcctctgagccttcagctccattatggacccaaactagactatacttggataagttaagctcttcttcgtgtactggtctataattagaaaaactgttttaaattagatgttcccattatttatttaaacagctttttgctgagaaagcttagtggattaatgaggcagagggtgttttgaaatccaataaatagttcccacaggctgggtgtggtggcttatgcctgtaatcccagcactttcggaggccgaggtgggtggatcatgaggtcaataaattgagaccatcctggccaacatggtgaaaccccatctctactaaaaacacaaaaattagctgggcgtggtggcgcacacctgtagtcccagctacttgggaggctgaggcaggagaatcactggaacctgggaggcagaggttgcagtgagccgagattgtgccactgcactccagcctggtgacagagcgagactccatcaaaaaaaaaaaaaaaaagttcccacagctcaccactacagaagcagggaagacaactatgcagaaaacagagttagtggcggtcagcaggaatgcagctggtcttttggacccctacgggatgggggcagtgcagaagacactggtgaagtcctttatactgaagacctgtggttgggagcaggggtagtccatgggtctgctgattttttttccctatttagtactaatgtgtgtgtgatctttgttttacaaacagtaccttttgggttttctgcatattttataatttttgtacagttttgaattctatagattgtcttggaaggatactgtgtgatgggtcaggcacacagtaattggagacttttaatgtatgtaatatttcatagattgcatgctattaatcatctgtgagggtagtattttttgttttattgtaagtttccctctttttttataaattaaaagatggttggtattaggaatttcaaatgaatgcagaaaatcttacatgctgtgtactattaatattataacagacgatccaagtccaaaatctgaccaataaagcaaccattttatcaagatagagggattctaatgggagaggggattcttccctcctgaagtttgtgtgtccagtccccttaaaaaaaatgaatagttgtcttttcttgtcatattaatactcgaaagtccatggtggtattaatgaaagtacactttattgttgcctttgaacttacggccaaggcaataaatcagaaacaaaaatagtgccaatgtgtcaaaatcgacatctgagagattcagcctcccatttggaataaatatgaatcttctaagctatcttgtttaatattttccatcatttagctacttcctatctccctcagaggcgcctgctgttcccattttagagttgacagtggcctgctaattttgctatgttcctaaaagttactgggtgtgagacattttcatcccctcctttttcctactgctggtgtttattatccagctagacaatattttatgcatatttaccgtgatgtctggaccgtacctgtgctccttggcagtttatgttgaagataactaaagatttttctctttgggaggcatcaaaatgatggtagtttgcttttatctttttatgttcattttcttttagtaggtgacctttctgcattaagaactgtttttatcttttactaccttttcttttctcctttgtggagacagcatgacatgtcctgaaggtcacctttgcctttgaaaaaggtttgatggaggaattcacaggtgactgacaagtctttgaaaagaatgggatctgctcacttctggtctttttggccgggaactcctgattggtgttaaggtggtaatttcccccatataagatttagaatcactgagtttgagctagatgaaatttttaaaatttctggttgtctcattagactgatgaggtgagttttcttcttcatatgaacagctagttaataacagcagagttctcactcagtgctcagtacttaattttccactgcaccacaactgtcttaactaaatgtgctgtatttttctttaaaagttaagagttctatttggtgttttcaggaatatacgtgaaaagacatgccatgttttggtaaataccatcagagttgtgtaaaggcgtgtactaagtgcaatcttaatttgtggaaataatcttcatttacccctcctaaaactacactcagtataaacactttcccataaggtgtgtgcagtaaaaatgttatattactccaacactggcaggagcacagcacagcagccttattggagagagccttataaaagtgattaaatggaggcattgagctcattacctttaagtttactttgtgctgacctttgttcctgttttgagaatctcatataattattaaaaaaaaaaaacaattaaaacgaaacggcggggcctagctgtgtataaatgatccttgctgaatatcttaaggttttttgtaagaaaaaagaaaaaccaacaaaaaaagcttattttcacattaaaatgaaacctcttttgcaacttaagaattctatggaaaagcagtttttatcatattttgtgtccatgcaccatttttcttaaaatggcttacaaaaaagaatgtaaacaatttgtgatctggccagttgtacttttagctcccagagggagagttggtggtattatgagttgagtaaaaaccatccaggggaacttgagggagcagtctgttgccagtaatgttccttgtgtgccattaaaccacctccagatgagtggaggaacatcactttttaattttttaattgtatttggaattgttgccgtgtactaagaacttgacctaaataaaatcccacaaagtatattca

SEQ ID NO: 103365 - DNA, 6638 bp, Homo sapiens
  Payload ID: 152
  Gene Symbol: ABI2
  Gene Name: abl-interactor 2
  ENST ID: ENST00000261018
  CDS Start-End: 277-1818
gggaatctttttcgggctcccgggggcggagggaagggagcgcgcgtgcgcgcgcccggccggccgtcgccgcggtgaccgtcctcggagtccgtcggctcgcgccccgcccccgtcgccccctcccctgtcgcgcgctggggctgtttctcgctccttccgagttaccgccgccgtcgccgccgctcctcctctcccggtcctgggtttccttggcgctgcggccgccgctccctctgcgacctgtatgaggaggaggaggaggaggatgtgaagatggcggagctgcagatgctgctggaagaggaaatcccggggggccgccgggccctcttcgacagctacacaaatctggaacgggtggccgattactgcgagaacaactacatacagtcagcagataagcagagagccctagaagaaaccaaagcctacaccacccaatccttagcaagtgttgcctatctgataaacaccttggccaacaatgtcctgcagatgctggatatccaggcatcccagctacgaaggatggaatcttcaatcaatcatatttcacaaacagttgatattcataaagagaaagttgcaagaagagaaattggtattttgactaccaataaaaacacttcaaggacacataagattattgctccagccaaccttgaacgaccagttcgttatattagaaaacctattgactatacaattctagatgatattggacatggagtaaagtggttgcttagatttaaggtgagtacccagaacatgaagatgggtgggctgccgcgtacaacacctccaactcagaagccccctagtccccctatgtcagggaaagggacacttgggcggcactccccctatcgcacactggagccagtgcgtcctccagtggtaccaaatgattacgtacctagcccaacccgtaatatggctccctcgcagcagagccctgtgaggacagcttctgtgaatcaaagaaatcgaacttacagcagcagtgggagtagtggagggagccacccaagtagtcggagcagcagtcgagagaacagtggaagtggtagtgtgggggttcctattgctgttcctactccatctcctcccagtgtctttccagcccctgctggctctgctggcactcctccccttcctgctacttctgcatctgcccctgctcctcttgttcctgctactgtcccttcctccactgccccagacgctgctgctgggggtgcccagacccttgctgatggcttcacttctccaactccccctgttgtttcttccactccccctacaggtcatcctgtacagttctacagcatgaataggcctgcctctcgccatactcccccaacaatagggggctcgttgccctatagacgccctccttccattacttcacaaacaagccttcagaatcagatgaatggaggacctttttatagccagaatccagtttcagatacaccacctccaccgccacctgtggaagaaccagtctttgatgagtctcccccacctcctcctcctccagaagattacgaagaggaggaagctgctgtggttgagtatagtgatccttatgctgaagaggacccaccgtgggctccacgttcttacttggaaaaggttgtggcaatttatgactatacaaaagacaaggaagatgagctgtcctttcaggaaggagccattatttatgtcatcaagaagaatgacgatggttggtatgagggagttatgaatggagtgactgggctttttcctgggaattacgttgagtctatcatgcattattctgagtaaagctcagcagggctgtgcttgcctcacaggaatagtcaggtcttcccagattatctgaaggccctggggattccactccagtaaagtagaatgaaggatacaaatgataaaaattacacttttttttttggtttattccccagtattaaaaacaaagcaagctgagtctgaacaaatggatctttctgccatcatttgtacaatgctgagctgtctggattgaaataaaatgaccatttttatgtatgtcaaaggtataacagcataactgtgtagccaaaacaaaatcagattaagactgattcagaaaaatctgggatctttctcaggaatactgtatacccttgggatttctcctcctgcagaatctgtggcattggatgttcttcattgcctgtgctaaggggttaacctcatggcccagtgggtaccctagccccttcttttcttccacttgtatgaagaggagggaaccaacatttaaataccacacttaaccatttttacaattatttcagatggcttttttcctctgtgacactgtaaattctgcattctctcagcacttgagtgcaccaaacgagtgaatgctgaactcacttgcatcccttcatgtttctgtttgtggattataaggatgatgaaatgtgaaagtctcccaacactctgagggtggtgaacgattgccacccgtttgattttaatgtgctgctgcatgagactgcattgttgctaatggccagtgtacccagatgtgaagtgtggtaggctggttcatatgtggaggtgggtgtgtgaagctagacacgaaggtccctaaggttctgaagagacttgaactgtggaaatgctcttagcaggcatcccgaacccctgcttcggtgctgttttgaggagtaggatcttggagttcagaccaactatgactatcatttccttcactatctagaaaaacgctattctactttggaagagaatagtagttattttcaagtctcctgacagtcactgggagtacaaggtttgctaatgtgctctctggacgttattaatggccagtattagttgctgctgtattactgactcgcttagctgtagaaagggtaatactctcctgattttgtatgattggactcttaagtagctgctgttagtcagaattaaaacccatctcagactaagaatataatgaataagattaataggccaaaatatgtatctaatcacattgataaaaattaatataactgacacaataaaacacatttcccccatctgtacaataaatacagcttcaaattcagtggagtctgtagggcagataactttaatcatcactactgtagtcagtataagaaatgctgaaaaaaatccaggagggcttgtctctttgtgggtggtcactgtgatgttgggccagctcctgttcaggtccagagctgctaacgtgggttctactcagtcccagtgacttggccagaatagagctttgccaggtaactgccctgtgctaggtgaaaggggaaaagcagtagctggatatatttcaaatgaggttttgaacaagttcagaaagtggaacttgattgaaaagtgaacaagtgtagtagtgtgtgagaaaattcagatggtgtcggatgcagaagttaatattccacttaatgttatctgagcattaaaaatcatcagcatttaactgagaccccactatagagtttccttatcaagactttttggttttaaagttgtttttaatgcattgcaagttacaatagctattttgcttttagatttttcccagcactttgtatttattagctttcattaacttgcctccagtatacattccacttcgtgcttttcttaggtcatttctacatcccttattccttgttttcctgcagtgtaatggccctgaatgtcctctgagccttcagctccattatggacccaaactagactatacttggataagttaagctcttcttcgtgtactggtctataattagaaaaactgttttaaattagatgttcccattatttatttaaacagctttttgctgagaaagcttagtggattaatgaggcagagggtgttttgaaatccaataaatagttcccacaggctgggtgtggtggcttatgcctgtaatcccagcactttcggaggccgaggtgggtggatcatgaggtcaataaattgagaccatcctggccaacatggtgaaaccccatctctactaaaaacacaaaaattagctgggcgtggtggcgcacacctgtagtcccagctacttgggaggctgaggcaggagaatcactggaacctgggaggcagaggttgcagtgagccgagattgtgccactgcactccagcctggtgacagagcgagactccatcaaaaaaaaaaaaaaaaagttcccacagctcaccactacagaagcagggaagacaactatgcagaaaacagagttagtggcggtcagcaggaatgcagctggtcttttggacccctacgggatgggggcagtgcagaagacactggtgaagtcctttatactgaagacctgtggttgggagcaggggtagtccatgggtctgctgattttttttccctatttagtactaatgtgtgtgtgatctttgttttacaaacagtaccttttgggttttctgcatattttataatttttgtacagttttgaattctatagattgtcttggaaggatactgtgtgatgggtcaggcacacagtaattggagacttttaatgtatgtaatatttcatagattgcatgctattaatcatctgtgagggtagtattttttgttttattgtaagtttccctctttttttataaattaaaagatggttggtattaggaatttcaaatgaatgcagaaaatcttacatgctgtgtactattaatattataacagacgatccaagtccaaaatctgaccaataaagcaaccattttatcaagatagagggattctaatgggagaggggattcttccctcctgaagtttgtgtgtccagtccccttaaaaaaaatgaatagttgtcttttcttgtcatattaatactcgaaagtccatggtggtattaatgaaagtacactttattgttgcctttgaacttacggccaaggcaataaatcagaaacaaaaatagtgccaatgtgtcaaaatcgacatctgagagattcagcctcccatttggaataaatatgaatcttctaagctatcttgtttaatattttccatcatttagctacttcctatctccctcagaggcgcctgctgttcccattttagagttgacagtggcctgctaattttgctatgttcctaaaagttactgggtgtgagacattttcatcccctcctttttcctactgctggtgtttattatccagctagacaatattttatgcatatttaccgtgatgtctggaccgtacctgtgctccttggcagtttatgttgaagataactaaagatttttctctttgggaggcatcaaaatgatggtagtttgcttttatctttttatgttcattttcttttagtaggtgacctttctgcattaagaactgtttttatcttttactaccttttcttttctcctttgtggagacagcatgacatgtcctgaaggtcacctttgcctttgaaaaaggtttgatggaggaattcacaggtgactgacaagtctttgaaaagaatgggatctgctcacttctggtctttttggccgggaactcctgattggtgttaaggtggtaatttcccccatataagatttagaatcactgagtttgagctagatgaaatttttaaaatttctggttgtctcattagactgatgaggtgagttttcttcttcatatgaacagctagttaataacagcagagttctcactcagtgctcagtacttaattttccactgcaccacaactgtcttaactaaatgtgctgtatttttctttaaaagttaagagttctatttggtgttttcaggaatatacgtgaaaagacatgccatgttttggtaaataccatcagagttgtgtaaaggcgtgtactaagtgcaatcttaatttgtggaaataatcttcatttacccctcctaaaactacactcagtataaacactttcccataaggtgtgtgcagtaaaaatgttatattactccaacactggcaggagcacagcacagcagccttattggagagagccttataaaagtgattaaatggaggcattgagctcattacctttaagtttactttgtgctgacctttgttcctgttttgagaatctcatataattattaaaaaaaaaaaacaattaaaacgaaacggcggggcctagctgtgtataaatgatccttgctgaatatcttaaggttttttgtaagaaaaaagaaaaaccaacaaaaaaagcttattttcacattaaaatgaaacctcttttgcaacttaagaattctatggaaaagcagtttttatcatattttgtgtccatgcaccatttttcttaaaatggcttacaaaaaagaatgtaaacaatttgtgatctggccagttgtacttttagctcccagagggagagttggtggtattatgagttgagtaaaaaccatccaggggaacttgagggagcagtctgttgccagtaatgttccttgtgtgccattaaaccacctccagatgagtggaggaacatcactttttaattttttaattgtatttggaattgttgccgtgtactaagaacttgacctaaataaaatcccacaaagtatattc

SEQ ID NO: 103366 - DNA, 22209 bp, Homo sapiens
  Payload ID: 152
  Gene Symbol: ABI2
  Gene Name: abl-interactor 2
  ENST ID: ENST00000295851
  CDS Start-End: 297-1838
ccggcggcgcgggcgagggtgggaatctttttcgggctcccgggggcggagggaagggagcgcgcgtgcgcgcgcccggccggccgtcgccgcggtgaccgtcctcggagtccgtcggctcgcgccccgcccccgtcgccccctcccctgtcgcgcgctggggctgtttctcgctccttccgagttaccgccgccgtcgccgccgctcctcctctcccggtcctgggtttccttggcgctgcggccgccgctccctctgcgacctgtatgaggaggaggaggaggaggatgtgaagatggcggagctgcagatgctgctggaagaggaaatcccggggggccgccgggccctcttcgacagctacacaaatctggaacgggtggccgattactgcgagaacaactacatacagtcagcagataagcagagagccctagaagaaaccaaagcctacaccacccaatccttagcaagtgttgcctatctgataaacaccttggccaacaatgtcctgcagatgctggatatccaggcatcccagctacgaaggatggaatcttcaatcaatcatatttcacaaacagttgatattcataaagagaaagttgcaagaagagaaattggtattttgactaccaataaaaacacttcaaggacacataagattattgctccagccaaccttgaacgaccagttcgttatattagaaaacctattgactatacaattctagatgatattggacatggagtaaagtggttgcttagatttaaggtgagtacccagaacatgaagatgggtgggctgccgcgtacaacacctccaactcagaagccccctagtccccctatgtcagggaaagggacacttgggcggcactccccctatcgcacactggagccagtgcgtcctccagtggtaccaaatgattacgtacctagcccaacccgtaatatggctccctcgcagcagagccctgtgaggacagcttctgtgaatcaaagaaatcgaacttacagcagcagtgggagtagtggagggagccacccaagtagtcggagcagcagtcgagagaacagtggaagtggtagtgtgggggttcctattgctgttcctactccatctcctcccagtgtctttccagcccctgctggctctgctggcactcctccccttcctgctacttctgcatctgcccctgctcctcttgttcctgctactgtcccttcctccactgccccagacgctgctgctgggggtgcccagacccttgctgatggcttcacttctccaactccccctgttgtttcttccactccccctacaggtcatcctgtacagttctacagcatgaataggcctgcctctcgccatactcccccaacaatagggggctcgttgccctatagacgccctccttccattacttcacaaacaagccttcagaatcagatgaatggaggacctttttatagccagaatccagtttcagatacaccacctccaccgccacctgtggaagaaccagtctttgatgagtctcccccacctcctcctcctccagaagattacgaagaggaggaagctgctgtggttgagtatagtgatccttatgctgaagaggacccaccgtgggctccacgttcttacttggaaaaggttgtggcaatttatgactatacaaaagacaaggaagatgagctgtcctttcaggaaggagccattatttatgtcatcaagaagaatgacgatggttggtatgagggagttatgaatggagtgactgggctttttcctgggaattacgttgagtctatcatgcattattctgagtaaagctcagcagggctgtgcttgcctcacaggaatagtcaggtcttcccagattatctgaaggccctggggattccactccagtaaagtagaatgaaggatacaaatgataaaaattacacttttttttttggtttattccccagtattaaaaacaaagcaagctgagtctgaacaaatggatctttctgccatcatttgtacaatgctgagctgtctggattgaaataaaatgaccatttttatgtatgtcaaaggtataacagcataactgtgtagccaaaacaaaatcagattaagactgattcagaaaaatctgggatctttctcaggaatactgtatacccttgggatttctcctcctgcagaatctgtggcattggatgttcttcattgcctgtgctaaggggttaacctcatggcccagtgggtaccctagccccttcttttcttccacttgtatgaagaggagggaaccaacatttaaataccacacttaaccatttttacaattatttcagatggcttttttcctctgtgacactgtaaattctgcattctctcagcacttgagtgcaccaaacgagtgaatgctgaactcacttgcatcccttcatgtttctgtttgtggattataaggatgatgaaatgtgaaagtctcccaacactctgagggtggtgaacgattgccacccgtttgattttaatgtgctgctgcatgagactgcattgttgctaatggccagtgtacccagatgtgaagtgtggtaggctggttcatatgtggaggtgggtgtgtgaagctagacacgaaggtccctaaggttctgaagagacttgaactgtggaaatgctcttagcaggcatcccgaacccctgcttcggtgctgttttgaggagtaggatcttggagttcagaccaactatgactatcatttccttcactatctagaaaaacgctattctactttggaagagaatagtagttattttcaagtctcctgacagtcactgggagtacaaggtttgctaatgtgctctctggacgttattaatggccagtattagttgctgctgtattactgactcgcttagctgtagaaagggtaatactctcctgattttgtatgattggactcttaagtagctgctgttagtcagaattaaaacccatctcagactaagaatataatgaataagattaataggccaaaatatgtatctaatcacattgataaaaattaatataactgacacaataaaacacatttcccccatctgtacaataaatacagcttcaaattcagtggagtctgtagggcagataactttaatcatcactactgtagtcagtataagaaatgctgaaaaaaatccaggagggcttgtctctttgtgggtggtcactgtgatgttgggccagctcctgttcaggtccagagctgctaacgtgggttctactcagtcccagtgacttggccagaatagagctttgccaggtaactgccctgtgctaggtgaaaggggaaaagcagtagctggatatatttcaaatgaggttttgaacaagttcagaaagtggaacttgattgaaaagtgaacaagtgtagtagtgtgtgagaaaattcagatggtgtcggatgcagaagttaatattccacttaatgttatctgagcattaaaaatcatcagcatttaactgagaccccactatagagtttccttatcaagactttttggttttaaagttgtttttaatgcattgcaagttacaatagctattttgcttttagatttttcccagcactttgtatttattagctttcattaacttgcctccagtatacattccacttcgtgcttttcttaggtcatttctacatcccttattccttgttttcctgcagtgtaatggccctgaatgtcctctgagccttcagctccattatggacccaaactagactatacttggataagttaagctcttcttcgtgtactggtctataattagaaaaactgttttaaattagatgttcccattatttatttaaacagctttttgctgagaaagcttagtggattaatgaggcagagggtgttttgaaatccaataaatagttcccacaggctgggtgtggtggcttatgcctgtaatcccagcactttcggaggccgaggtgggtggatcatgaggtcaataaattgagaccatcctggccaacatggtgaaaccccatctctactaaaaacacaaaaattagctgggcgtggtggcgcacacctgtagtcccagctacttgggaggctgaggcaggagaatcactggaacctgggaggcagaggttgcagtgagccgagattgtgccactgcactccagcctggtgacagagcgagactccatcaaaaaaaaaaaaaaaaagttcccacagctcaccactacagaagcagggaagacaactatgcagaaaacagagttagtggcggtcagcaggaatgcagctggtcttttggacccctacgggatgggggcagtgcagaagacactggtgaagtcctttatactgaagacctgtggttgggagcaggggtagtccatgggtctgctgattttttttccctatttagtactaatgtgtgtgtgatctttgttttacaaacagtaccttttgggttttctgcatattttataatttttgtacagttttgaattctatagattgtcttggaaggatactgtgtgatgggtcaggcacacagtaattggagacttttaatgtatgtaatatttcatagattgcatgctattaatcatctgtgagggtagtattttttgttttattgtaagtttccctctttttttataaattaaaagatggttggtattaggaatttcaaatgaatgcagaaaatcttacatgctgtgtactattaatattataacagacgatccaagtccaaaatctgaccaataaagcaaccattttatcaagatagagggattctaatgggagaggggattcttccctcctgaagtttgtgtgtccagtccccttaaaaaaaatgaatagttgtcttttcttgtcatattaatactcgaaagtccatggtggtattaatgaaagtacactttattgttgcctttgaacttacggccaaggcaataaatcagaaacaaaaatagtgccaatgtgtcaaaatcgacatctgagagattcagcctcccatttggaataaatatgaatcttctaagctatcttgtttaatattttccatcatttagctacttcctatctccctcagaggcgcctgctgttcccattttagagttgacagtggcctgctaattttgctatgttcctaaaagttactgggtgtgagacattttcatcccctcctttttcctactgctggtgtttattatccagctagacaatattttatgcatatttaccgtgatgtctggaccgtacctgtgctccttggcagtttatgttgaagataactaaagatttttctctttgggaggcatcaaaatgatggtagtttgcttttatctttttatgttcattttcttttagtaggtgacctttctgcattaagaactgtttttatcttttactaccttttcttttctcctttgtggagacagcatgacatgtcctgaaggtcacctttgcctttgaaaaaggtttgatggaggaattcacaggtgactgacaagtctttgaaaagaatgggatctgctcacttctggtctttttggccgggaactcctgattggtgttaaggtggtaatttcccccatataagatttagaatcactgagtttgagctagatgaaatttttaaaatttctggttgtctcattagactgatgaggtgagttttcttcttcatatgaacagctagttaataacagcagagttctcactcagtgctcagtacttaattttccactgcaccacaactgtcttaactaaatgtgctgtatttttctttaaaagttaagagttctatttggtgttttcaggaatatacgtgaaaagacatgccatgttttggtaaataccatcagagttgtgtaaaggcgtgtactaagtgcaatcttaatttgtggaaataatcttcatttacccctcctaaaactacactcagtataaacactttcccataaggtgtgtgcagtaaaaatgttatattactccaacactggcaggagcacagcacagcagccttattggagagagccttataaaagtgattaaatggaggcattgagctcattacctttaagtttactttgtgctgacctttgttcctgttttgagaatctcatataattattaaaaaaaaaaaacaattaaaacgaaacggcggggcctagctgtgtataaatgatccttgctgaatatcttaaggttttttgtaagaaaaaagaaaaaccaacaaaaaaagcttattttcacattaaaatgaaacctcttttgcaacttaagaattctatggaaaagcagtttttatcatattttgtgtccatgcaccatttttcttaaaatggcttacaaaaaagaatgtaaacaatttgtgatctggccagttgtacttttagctcccagagggagagttggtggtattatgagttgagtaaaaaccatccaggggaacttgagggagcagtctgttgccagtaatgttccttgtgtgccattaaaccacctccagatgagtggaggaacatcactttttaattttttaattgtatttggaattgttgccgtgtactaagaacttgacctaaataaaatcccacaaagtatattcaggtgtcttgttaacttatttatataaataacctctttttctaaggtggtatcttgagtttacgtgttagggataatctgacttttctgttgctctaaaccagggagctgccttttattactgaagaagtcgtctttttaaattttcaaagatttaaaatgttgagctttaaatttgatctcaagtttcttccctgaagacagctgttctaattaagaactttctaatcctgtttttgctccactcgcacctggggttttcttaccacttttctccaaatctaattctgttaatgtacagtttttttaattcaacagacaaacactgaagatgggtgttgactaaaaaatattgcagactggtcagaagtgaatctaaaagacaaaccactaactagcctgtgctttgttgctatgagagcctagattataaaagaattttctaatgatgtatctgagggtagcaagtaagtttgtcttcacaatacccaaaatgatgtttcagcttttctcacttttcaagcccatcttatttcctctgtacctttattattttggtatcattaggtaaggtgaagaataatgtaggaaacaaatacccagctaaaacatttatgggtttctcgtatttgtgaataggattttaggcgtcagagcagtcttgtcttgtctcaaagatagatagtatccaatcttttgttaataagcctattgcttgacttttttgggttactttggaattacacatttggttgaacggctttgtggatctggggcatatgccaattaaggggcacatgccatgcgttctgttttcctgtcagcctgtgtacactgctgcttctgaaggcataagtacaggtgcagtttccacaaccacgtatgattgacagatggtgaacgaaaggggaaggcttccactttttttgccctagtttggtacataataaagtgattgcaaacacattatacatttatacataccttcacatggcagtccaacacgtaattgtgactccaaagatttgaaacaaacaaaaggcattcctttttgtattactttactttgtacttagttctttgtttaaagaagaaaaatcttttttaccttttttttttttttgagacggagtctcgctctgttgcccaggctggagtgcagtggcacaatttcagctcactgcaagctccacctcctgggttcatgccattctcctgcctcagcttcccgagtagctgggactacaggcgactgccaccactcctggctaatttttttttgtatttttaatagagacggggtttcaccatgttagccgggatggtctcgatctcctgacctcgcgatccacccacctcggcctcccaaagtgctgggattacaggcgtgagccaccgcacccggctgagaagaaaagtctttctttaaaagctgttgtcacttaatcaccaatgtatttaatggccaaatttccctagttggtataaactactcttaaaagttaacaaattgaacatatcaaactagtttatttaccacacttaatttcttctgtgtatggcctatgttttgggtaccctgacatgaaatgcaaaaccagattcttaatggtgccgatccacaaacactcaaagtccccatgtttaaatgaaatctatgaattttttttattaaggatttgataagctgatataatgaaaacatgtaaatgaaaaacatttacactgactgtacgactagtgtgctaagccattacaatagtttactgacataactggcaagagtaacttggaaaataacttaatccagcagaacaaaaacatcctcagaaaaacatcctcagtagtactgaatatatctctctcatatatctatctatctatctatatatatatatatatatatatagctttgcacaatcagggagcaaggcacataatgaaatgagcatacatttatgcagaagaaaataatagcaacaaagctgcgagaaaaattgtaacttcatcttcactgagctgtgcataatcctttgaataataatgtcctctacctggtacattataatgaagttccttgtcttcttcatgctttaaaaaagtatacttctacattgtatctacctatggcaaagctcccacagcctacaagttggtgtgagccttgactcttgttttttaaagaactgagggagggagcaatcccagttaaatataatgtgcaattcccctttaacagtaaacaatgtttttaaaacacttagcacaagctaattttatcttaaatgtacatctctgtaagagttcactagtggctgatagtaaaatgaagcaaaattgtttgaaacattccagttaatgcttattttctagaaggggttattttacaagtagcaaaaaaaaaaaaaaaagtaggaggtggggaaataatatgaaaaacggcagtttttggtattaggttacaataaatttaacgaatggacagtttgcaaaatataagggtttctccccctttagtgctgcagacaagttttactgcctaagacgttgaggctgcaacaatcatgagcttggtattagtagccatccatgataaacataattaattctcaacttaaccatctataaaatatgtagtgttcaccatcaccctgactcaattcacttctctaaatgtctttggtagaaagcagccagaccccacgtgggtagtgatgtctcttgtgagacacttttcatttctgccaaaactagaaataccaccttcctttactttcattagcacctcaaagtttgcttgctggatttctttaaaaatattctgccaaaagagttgaaggcactgggggtttacagcaagtattttctctttaaaacggtttattacttcaacaagcaaagagcaaaccaactggagaaatgtatgttttttctttttatttatcaagttttattctacagctaaatttcagatttcttttacatatagaccttgcaagggcacggtaagaactgagcacttgttttatttgagggataaaggtgtagaaattttctctttgaattttataaggaaaggctgggtacagtggctcatgcctgtaatctcagcattttgggaggctgaggcaggaagatcacttgtggccaggagtttgagaccagcctgggcaacacagtgagacccccatctctaccaaaaaaaaaaaaaaaccttaaaagataataagtatctaattcttttatacttgcatttctctttggatcaaatctcaactttgtgagaggtcatacatttctacagggttaggagtaccctgcataatttatacaaatgtaaagtgtatattaaaaaaaaaaaagtgaaagttacctgcaatctaaagggttttcttcccctagaaacagtcaccctctcgtcaagtgtatgacccaattatacctattttatgaaaagcaaggcatcacattgataaccatacaggatcctatgggtttaactggtctaaacttgagtggattaaatcagttgtaattagttagctctgtaggtatatgaaaaacttttggtaatgtacaaaaataggaatgggttttttacctgtttaaagtcactttgtgtttataacaaaattacttttagctgaggaacaaaggtgacaaagatttctgttggtggctgagagtcaaagcaggccaatccacaccattacctgaaatatttttcaggctaatttataactttatggatttcctcgatacaagtttattagtttattctccatatacaagtttattctcccagaatagcagcaaataaaacttgaattggatgtacagctcctaataaccttgatgtcagagttgtcacttggttggaattattatgatcccccaatttaaattttcttgataaactcagcgttgtttgttttcagtgacaagaaaacatacatggaaaggggacccaagacagttcaccaagatagttcacagccctttgcaggatatgcctttggtgggtgggagcacctagattttagaggactataaaacgccatgtttactttgtttgaaattttctgatgaaaagtcttttgtaacttaacattccacattttcatttaaaaagtcccagaaatataaactatccaatttacaactaaggtgggtatctgtaaaaaccttaagaatagttactcttcccaagagaattacagcgtctaagggggggaaagaaagcatctgagcagtaaaagtcaagctggtaaaatccaatacagaatatctaataaaccataagttattttactgagaatagattctgctgccctacagcattggtgccaaaactctaagcatagagtgattctactttgaaattatccatagtagaaattaggagtgtcactaattaagcaagtcactacctctaataagcacctgtttgcactgccctcagcagcaggatgagttaatccatgctgttcacttttcagtacagccaagtcaactgcacagacttgaagcagccaagctgggtgagagctgcagagcagagggcagtgaaagaaggcacagtactagtgtcgtgcggcagtagatgctttccatgaatacaccagagaaaaagagctacagaaatacagtctaggaaaagctacatcccaacaaaaatccaaattaaagaaaacccactagggagtaaaacagaagtataaagtatcactttagtggttttttaaattcagttcatacatgaggttaaaacatttttaatagccatttctgtctgtggaggaatgtaaagggaaatggcctgttgtcggacaagccactggactggggttaaaatgagtctcctcctctagccttactctcttcctggcatcattagtgttcaaaaggatgtctgctattccaggaaaacagaccagaagcatctgttcaggatggctatcatcaggattgatacaagcaagaaattccaagaaatcctgcactgaaaacataaaggctgttgttttagggctcaaatcatgggtgaaaaaaggttagcgggtacattttttccccctcaagaaaaactgaagtgttgtctaccttctcatgagaaaatcaccaccacaataaaactcaaaacctcagggatgaatactttgataactggattcatattcttactaactctaacccacaaatatgggtgcccctcaaactataaaactgcaggcagaagactatgagaaattcattcatgaatcacagtagcgcttggcaatctactcaaacattacccaaatttctgtgcatgcttaaattaacaatgcagatgtgttaaagatcacttcataaatatcaaacacaaaacttggtgaacaatttgaaagacctaaaaattaatggtatatattcttattgctccataaccacatgaacataaccgaacaatattctggagatgtagcaatggagaggtgctgttcactctctgtttacgatgcggttttcgtggagtgtgggttatgcaagaccttgagtatactgtactaattaagcacttttgctcattctagaattatttaccatctcttcccccactttactggcatcactttttccttgtgggacaatgtcaactgatttctgcagtttgcattggtaatcattaacaataggcacagactttcattacaagatgtgctccccttataagtgctgggatggcccatttttattctcttgtttaggagctgctctgagattgttttattcctaatagtccaatttatcataagttgatgagagtacttatttctctcatgtaccaaggaaaattcacagaaaaaagcatatagaagtatagtgtgtcgttagagcactgactccacgttataccaaactgcacacgcataaaacgtaatgtcagttactggacttggactgtcccactccatcagaacacctagtaacctgaactaatcacaaccaggctgcagtcagcaagggtcctggtagccccagtagctataaatgaaactgtcttccctctccatgtagtcccatacttaatgagctttttgtattacatattataacccatatacaaccagattaatgacacctgtacaggggccagttctgttctctcatcacccttcccttctatagagcaatgctcaaaaaatgcattttagaaaatgattttgtttttcataatgcaccatattggggcacaggatgtgtatatttcatataccaattgtctacagatatgtaataacacctacctaaagcacatattttaagaaggtaactggtgacccaaagacatactgggacagaacattacagagataactgtgttatccatcctcttaaaatcaatcaaagtgaggatcatgaagccaagttgataaagcttcataaaacagtactaaaaaggaactatccagaattatagcactaattatccatgtattgtaggcaaagagcttatctgtcagcacatcctaaatgtgggtggatcactgcagcagtactgcagctagaacagctgagttaattacgccatgtatttactttctatgcacaaccacatacagatgatgtctgtgaacatttccccatcctgcactagttacccgttctatgaagctgagagattttcctgatttaaagtgccccttcatgtatagcaatgaagtgtcagtcaagcaattctaacttcagccaactggggaaaaacaaacacaaaagccttatagatacaccaaacattctggtgatttttctcaaccagaaatagcacattctacatctattccttagttatataatacacaacatgcacgaataggctacacatggacagacacttataaataccttctaaataagtgattagaagtttttggtccaatccacatgatatagaaatcttaagagacaacacacatccccttctatgcctcttccacccaaaatacagaacacccattttcagattaggagagaaaaggaataaatagaataactctcagctctctctctatatacacatacacatacatatatgtatacatatatacacacactgtacagctgtgtgtacatgcacgtgtacacacacacatacacatatagctggacactacctgaataacatcataccaggaggctctgaacacctgaattcacagatgatcaggtgagctgattgtagcagtgattacagatatcatgaaaataaagtcctatggtggctaccagtctctggagagcttggtgttctggtctcttttggggggagcaggagggggtcctctccgcaacgttgcatagcctgatatatgactgcctccgtaaccagccttctgttgatcagacagcagttcagggggtggtggaggcaatgccatatcatccatggtggctgttggttctgctctggacatgcgggaggagagtgagccgtgccgagtgatggactttcgttgcagtgtcctgttgaggtcagccaggaatccaggctggacactaaggctggatttgggagaggtgggcacttgtggcacaactgtggccattgttggctgctcagaaatctcagcttgagtgaggcgggtgctatcattccgtttgggtcgtgtgggtggaggggccttcttcactgacattttagaccattgttgtggttgaggattaacgactgccacttttggagaggtgtttcccgagaaaactgctggaatctcaatggggggcagaggaagctctgtttcaggtggagggggtggaaaatcagaatcggatggaggagaaggaaattccaccacggagtcctttccacgcccactcagaacaggggcttttgctgacacacacccttgttggagaactccaggaaggttgactccagaaagattgagttttccaggcttggggggtgctgcaggaggtggtagggtctccttgctgggagaccctgattctgctggcggtgtaaacttgctgactagactgtccaccgagggtctcttgggctcggggtgctctgcaccactgctggatttaatgctggagttgcgctgtggggttgggggtggtttctttcccccagggctggacgtcttactggtctttttgcctggagatccacttttgtcaggggtaggagaagctgtgggtggaggtggtggtggtggggctgggacaggtgatgggggtggaggaggaaacaccaggctgctttcaggagggggaggagggaagtccggagaagggactgggatggagctgggctgccacttgggctttgcttttactgcaggaggggactgtggagctacatttgctgggacaggctttaagggctgagattccatggcagggggagttggagggggtggaaactggctggctatctgcttcacgaccgagggcaccggtgacagtggagagggagggggttttgcacagaagctctgttgcttgggtaatgttggcgggggtactggaacaggaggggtagggggagagggtggaatgtaagaagcagggaaagctggctgcttttttgctgggggcactggaggagtaggtgtgggtggtgcagcttgagtcacaacaggtgccacagtcttggtgctggttggtgcggggatggtcacaaggggttttgggggagcttggggagggaggggtgcagggataggaggaggtggggggggtgttgggggagccacctgagtaatatgctgaacttgatggatcttcagtggaggaggcggggcactgaactgtggaagggatggggcacacggtgcaggctttagctgggccatggcagagcctggggttgggggtggaggagggggagggggtggtggaacaactccattggggggtaccaggatctgaggcttcactgactgtgactgcatcactgggggtgttggcggcttaaacagggcccctgaatgctgagacgcattctgtagccgtgttattgtgctgtacttgacgaacattggggctgctgagcctgcagaaggtgcagactggctggggagtgggggaggagggggtggtggagggggtggtggaggaggaggtgggggtggcggaggaggtagaggtggtgaaggctgtgaagcagtgtagggggtgactatcttaggttgcggggataaagggggcacaagtgaagtgtagggccgattcatagactccattctggcctaaaaggagtataaaaagggagtgggagagagaaaaacacaacaaacaaaacagttacagaggtaagctttgattgtgtaaaactaaaaagcagggagtctgggacatgcatgaaaaggatgcagaagttggtggtgatcataaagatggacaatgtcaggaaggctaaaatctgattgtgcgggcaagaaggaaacagaaaacttgttttaccccacagtaaaatagctagaccatctaacaatctaggaaaaatgtccggctgcaaaagctgtttgaatggtgacaggatgcatgacttctgaccttggctgtatgactttgacacagcctgccctacatggaaccctctgtggcggtcctctgagcactggacttccaaggggagatgtgatggctccagtttacctttcagtccatgactgcatccacatcaagcagatgctataactgggtttaggagggcttcctggtggaatgaggatggctttttgatgctagtaagctgacacaggagagtatgagaatgttgagcaggcgtgcacagtcacacaggaatgaataagcttgacacacacactcgtgttggtgtgagacaattgcatccaacatgcacagaagtccagcaatgcaggtaaaggggggacattctttacatttgttttactggaaaatacataaagaaatgctttgtaaacattatagcaaaagactgtaaaaatatcatacagaaaaagccagaagaaattaagaggaagctctggaaggctagaataaagaaaatgtatcaagaaatggcagctagcatttgccaacaaccaacccatctgggtagctgaaatgatcacatctggtagtttatttcgtggagctaatcatgcacgatggtggttcaggtactttgaaaagaggaaaggaaggacccttgttttaaaaactttaggtacatcttttaggctctttgaacaaactttgaggatccaagataaaccatttgttttcaattttgaatgacatcgagaatgcatgggttagtgaactagaaggctcattatagggctgaattctaatagccatccggacattcacatgtttcttttaaaattacacaaaaagattagtctgtgagattgggatacaggcgtcaccgaggttaatgtgtttccagagaacaacccctgaccttaacttgaccctgtcttggctgcttcaggggcgcaggccttagctgtgctggccttctcatttggcacctgagactgaggtaacaggagaagaaatacagagtgatcaagccttaaagcattactgctgacagcagggttcctactcttctgaaactctgtgcaataacggactttgctgcttaatcacagaacattttgggtctgtgattttgttttccttggccttacacataactaggttctataacttaaaatgcacacggatctcaccattagtaatttggtaaggcaaaggggtttttctttagccatccgaattctgtaaaccaacttctttagtacatttttaaaatactagctccatccaaattgattaaatgggggaagggagagagaaattatttcttaaaagtttgagtctctaataagggagttaaactcagtgttttgagaatttagatcgttagaaccaattctcaaatgctcatttctgaaggaaagggcttcagccccacatggtgctactaaggccttctcttccctgcgggagcccagttagtgaaccacatatacgaatgaaggaataaaaggaaaaatgtccatttattctcattcgtgaatgtacctgtataagtgattcagaccaaaagcaccccccaccaaaaaattaaataaataaataaaaacaattattagtaaaaataaaatagttgagcccagggtgccactggttcctcaatgatggagtgacctcttgcatattgaaatggtgactacagccaggacacatccttgcctacacaactacagatgatgtctgatagaaggccatgatgtctttcaaatgaactgaagaacctctctattttcctaattatagtcttgcaataactatactcatccttcagtctcactgcacaatatactatgcaaggctcaggaatccaaaacttttaagggaaatgattttaatttagtcttccacataaagtataatttgaaaaaattcatcaatgcccaaagaaatggcaaaagcattaaaaaaaaaaaaggtaaggaatgagtctgaataaattaaccaataaagaaataactggactgaatatggtggctcatgcctgtaatcccaggactttggaaagccgaggcaggaggatcgcttgaggccaggagttcgagaccagcccaggcaaaatagccagaccttgtctctaccaaaaaataaaaaactagccaggcatggtggtgtgcacctgtagtcccaactactcaggcaactactcgggaggctgaggtgagcaagcaggctgaggtgggaggatcatttgagcccaggaggcttaagtgagccctgataacaccactgcattccagcctgggtgacgggaaagggagagggagagggagaggaggggatggggagaaggaaggaaaggaagggaaggaagggagagaaggaaggggagggagggagggaagtgaggggagggaggaaaggagggaaggaaggaagaaaagaataaaaaagaagagaaaaaaagagagagagaggctgggcacggtggctctcgcctgtaatcccagcactctgggaggctgaggcaggtggatctcgaagtcaagaggttgaaaccatcctagacaacagggtgaaaccctgtctctactaaaaatacaaaaattagctgggcgtggtagcatgtgcctataatcccagctactcgggaggctgaggcaggagaatcgtttgaacccgggaggcgaaggctgcagtgagctgagatcacgccactgcactccagcctggcgacagactgacactctgtcaaaaaaaaaaaaaaaaaaaaaggaagaagaaaaaaagacaggaaagaagagagagaactgtaaacagcttctctagaatttagggcatttgcaatagatggtgttttgccatccaaactgcttaaaggtggaaaggaagaaattgttatttcttaaaaatctgagccactgatgaaagaattaaactgccagttttttttgtttttttgagattttaagtcattagagccaatttgtaaaatactcatttccaaggggaagtcaaatcaacaggtctctctgaactgtctttacccactacaattaggaagattgaaaattaataaaggagactgaaataaggccaaataagatccccgataaagacataagagagcaacaatttaaacccaaaagaataccacagaattttcaatgtaaattaaaacgaagctgttaccttgctggactcttccaactgagtgcctcgtttccaggcttcagagaatacggagctcacaatgctctgggaacggacgtgtcctgctggctgggtgtcagaaactccgctatcagactgattggagtggtttgactgagactctgtttaaaatagttttttaaacataggtttaaaagagtcagtattctgacaatattcatatgtatgtctagttagatcttttacacaaggtcaagtgctgtgtacaacagcaccaagttattttactcatttcatcataaacacagccagtattttctactagaaaacttcccttaccttggaattaagaaatctcagattagtgttaaatatttcaccatgagagactgataattataataaatgattcacataacattattggtatcctgacacccagtcttgcatgaaatcaactctaaacaataaaagaattaatgaaccatcagtagaggagtctctcaatcatgtctgcattacattgagaatcagcctttttaatacccctgccttaaggtcacgccagaattgtaacttaggaattcggatctatacacaatgattatttccttttttctagcaatgagcaatacttagaatttgaccctctagtgcgaagtgtgtttcctagggatttaggtattggacccatagggtggcagctgtgctgtatcctggcctgtcagcaaggcacaaaaaagttttgaaaggagtggggcctggtgggaatggctgtgagcatacagtgtctctttgccgcctgagcaaggaggctgaggtgggaggatcatttgagcccaggagagttaagtgagctatgataacaccactgcattccagcctgggtgatgggagaggaaggaaggaaaaggaaggggaaccatgttctggaagggttgttggttggttttttttccccattttaataaatattttcttagaatagttttaagatatctacatattagatatttgaatattagaacagttttagcacagaattcctacatacccggcatccagtttacccatttagcaatatgtttggttttaaagaaattctcctttggggaaaaagtgtcctcttttaattttattcccttttccccattattaacatgttacattactatactacatttgtcacaactaaggaaatgtcctgctactattaactacgctccacactttatttggatttcactagtttttccctcatgtgccttttctgatccaggacaccacgtcacagttagtcatcatgtctcctataacggcttctcagaatttcctgtttttgatgacttagacagttttgaggaatagtggtcaggtatcttgtagactgtctctcagttttggtttgtctgatgctttttctcttgattagtctgtttatggaacttggggaggaagatcatagaggaaaaaagccattctcacacactatgtcaaaggtccctataaccaatgtgacttagatactgaccttgaccacatggttgtggcagtgtttgtcaggtttctccactgtgaagttacccctaatccccgttccataatcactggaagcaagtcactaagcacagtccacacttgaggacttaggtaagctctacttccttcaggacaaagtgtcttcataaatcatttagaaatctacacaggacagttctctcctcttccccatttatttattcaatgatttatttacatcagtataaactcatggatatttatgtccatgggttacaatcctatactatattacttattgtattgctcaaattgttccagctttgacctttggagctctttcagactggctcctctgtgtatccctttgacatattctcatcttgtgttttgtgagacagggtctcgttctgttgcacaagctggagcacagtggtgtgattatagctcactgcagccttgaacttttgggctcaagcaatcctcctgcctcagcctcctgagttgctaggactatgtgtactactaagtctggctaatttaaaaaaaaaaaaaaaaaaaagttgtggagatggggtcttgctgtgctgcccaggctggttttgaactactgggctcacgtgatcccttaacctaggcctcccaaagcattggcattacaggcgtcagccactgtgcctggccctactgtcgttttttaagcattcccttactttctggcattacaagatgctctaggctcatcttgtatatattctctgctgcagccctataatttgccatttctttgagagccttggttttcttttctttcttttttttttttttttttgaagaatggtattagaaaccatgatctatttaagcagcatccttggccaaaatttaataaaacgaaaaaacaaaaagaaacctctatgatctagggactgggtattctcattgttcctggggtatcactgcttctagtcctcagtggacagcactaggaaatgtatgtgtatatacacattctaaatttgtttttacttaatagagatgaaatagagtcatgcagcttttaaatatactactaaagttattatttctttcatcacatccaatgcaaaaatttaaaaattctgcttttagatgacatggatctcattcatgaaacattttgaattgaaagaagatttatgttaagatgtaatcatagcatgcacttgtttaaaggatataggaatctgaaggagtgcagcttcttcatggtttctgagtacaaagattctttccaagtaatgttttatcccaaattatgcattaacagtgtccagcagtatgtatgttttgaataaattttataaatataaataa

SEQ ID NO: 103367 - DNA, 2240 bp, Homo sapiens
  Payload ID: 152
  Gene Symbol: ABI2
  Gene Name: abl-interactor 2
  ENST ID: ENST00000424558
  CDS Start-End: 121-1644
cttccgagttaccgccgccgtcgccgccgctcctcctctcccggtcctgggtttccttggcgctgcggccgccgctccctctgcgacctgtatgaggaggaggaggaggaggatgtgaagatggcggagctgcagatgctgctggaagaggaaatcccggggggccgccgggccctcttcgacagctacacaaatctggaacgggtggccgattactgcgagaacaactacatacagtcagcagataagcagagagccctagaagaaaccaaagcctacaccacccaatccttagcaagtgttgcctatctgataaacaccttggccaacaatgtcctgcagatgctggatatccaggcatcccagctacgaaggatggaatcttcaatcaatcatatttcacaaacagttgatattcataaagagaaagttgcaagaagagaaattggtattttgactaccaataaaaacacttcaaggacacataagattattgctccagccaaccttgaacgaccagttcgttatattagaaaacctattgactatacaattctagatgatattggacatggagtaaaggtgagtacccagaacatgaagatgggtgggctgccgcgtacaacacctccaactcagaagccccctagtccccctatgtcagggaaagggacacttgggcggcactccccctatcgcacactggagccagtgcgtcctccagtggtaccaaatgattacgtacctagcccaacccgtaatatggctccctcgcagcagagccctgtgaggacagcttctgtgaatcaaagaaatcgaacttacagcagcagtgggagtagtggagggagccacccaagtagtcggagcagcagtcgagagaacagtggaagtggtagtgtgggggttcctattgctgttcctactccatctcctcccagtgtctttccagcccctgctggctctgctggcactcctccccttcctgctacttctgcatctgcccctgctcctcttgttcctgctactgtcccttcctccactgccccagacgctgctgctgggggtgcccagacccttgctgatggcttcacttctccaactccccctgttgtttcttccactccccctacaggtcatcctgtacagttctacagcatgaataggcctgcctctcgccatactcccccaacaatagggggctcgttgccctatagacgccctccttccattacttcacaaacaagccttcagaatcagatgaatggaggacctttttatagccagaatccagtttcagatacaccacctccaccgccacctgtggaagaaccagtctttgatgagtctcccccacctcctcctcctccagaagattacgaagaggaggaagctgctgtggttgagtatagtgatccttatgctgaagaggacccaccgtgggctccacgttcttacttggaaaaggttgtggcaatttatgactatacaaaagacaaggaagatgagctgtcctttcaggaaggagccattatttatgtcatcaagaagaatgacgatggttggtatgagggagttatgaatggagtgactgggctttttcctgggaattacgttgagtctatcatgcattattctgagtaaagctcagcagggctgtgcttgcctcacaggaatagtcaggtcttcccagattatctgaaggccctggggattccactccagtaaagtagaatgaaggatacaaatgataaaaattacacttttttttttggtttattccccagtattaaaaacaaagcaagctgagtctgaacaaatggatctttctgccatcatttgtacaatgctgagctgtctggattgaaataaaatgaccatttttatgtatgtcaaaggtataacagcataactgtgtagccaaaacaaaatcagattaagactgattcagaaaaatctgggatctttctcaggaatactgtatacccttgggatttctcctcctgcagaatctgtggcattggatgttcttcattgcctgtgctaaggggttaacctcatggcccagtgggtaccctagccccttcttttcttccacttgtatgaagaggagggaaccaacatttaaataccacacttaaccatttttacaattatttcagatggcttttttcctctgtgacactgtaaattctgcattctctcagcacttgagtgcaccaaacgagtgaatgctgaac

SEQ ID NO: 103368 - DNA, 2718 bp, Homo sapiens
  Payload ID: 152
  Gene Symbol: ABI2
  Gene Name: abl-interactor 2
  ENST ID: ENST00000422511
  CDS Start-End: 32-1474
gtatgaggaggaggaggaggaggatgtgaagatggcggagctgcagatgctgctggaagaggaaatcccggggggccgccgggccctcttcgacagctacacaaatctggaacgggtggccgattactgcgagaacaactacatacagtcagcagataagcagagagccctagaagaaaccaaagcctacaccacccaatccttagcaagtgttgcctatctgataaacaccttggccaacaatgtcctgcagatgctggatatccaggcatcccagctacgaaggatggaatcttcaatcaatcatatttcacaaacagttgatattcataaagagaaagttgcaagaagagaaattggtattttgactaccaataaaaacacttcaaggacacataagattattgctccagccaaccttgaacgaccagttcgttatattagaaaacctattgactatacaattctagatgatattggacatggagtaaagtggttgcttagatttaaggtgagtacccagaacatgaagatgggtgggctgccgcgtacaacacctccaactcagaagccccctagtccccctatgtcagggaaagggacacttgggcggcactccccctatcgcacactggagccagtgcgtcctccagtggtaccaaatgattacgtacctagcccaacccgtaatatggctccctcgcagcagagccctgtgaggacagcttctgtgaatcaaagaaatcgaacttacagcagcagtgggagtagtggagggagccacccaagtagtcggagcagcagtcgagagaacagtggaagtggtagtgtgggggttcctattgctgttcctactccatctcctcccagtgtctttccagacgctgctgctgggggtgcccagacccttgctgatggcttcacttctccaactccccctgttgtttcttccactccccctacaggtcatcctgtacagttctacagcatgaataggcctgcctctcgccatactcccccaacaatagggggctcgttgccctatagacgccctccttccattacttcacaaacaagccttcagaatcagatgaatggaggacctttttatagccagaatccagtttcagatacaccacctccaccgccacctgtggaagaaccagtctttgatgagtctcccccacctcctcctcctccagaagattacgaagaggaggaagctgctgtggttgagtatagtgatccttatgctgaagaggacccaccgtgggctccacgttcttacttggaaaaggttgtggcaatttatgactatacaaaagacaaggaagatgagctgtcctttcaggaaggagccattatttatgtcatcaagaagaatgacgatggttggtatgagggagttatgaatggagtgactgggctttttcctgggaattacgttgagtctatcatgcattattctgagtaaagctcagcagggctgtgcttgcctcacaggaatagtcaggtcttcccagattatctgaaggccctggggattccactccagtaaagtagaatgaaggatacaaatgataaaaattacacttttttttttggtttattccccagtattaaaaacaaagcaagctgagtctgaacaaatggatctttctgccatcatttgtacaatgctgagctgtctggattgaaataaaatgaccatttttatgtatgtcaaaggtataacagcataactgtgtagccaaaacaaaatcagattaagactgattcagaaaaatctgggatctttctcaggaatactgtatacccttgggatttctcctcctgcagaatctgtggcattggatgttcttcattgcctgtgctaaggggttaacctcatggcccagtgggtaccctagccccttcttttcttccacttgtatgaagaggagggaaccaacatttaaataccacacttaaccatttttacaattatttcagatggcttttttcctctgtgacactgtaaattctgcattctctcagcacttgagtgcaccaaacgagtgaatgctgaactcacttgcatcccttcatgtttctgtttgtggattataaggatgatgaaatgtgaaagtctcccaacactctgagggtggtgaacgattgccacccgtttgattttaatgtgctgctgcatgagactgcattgttgctaatggccagtgtacccagatgtgaagtgtggtaggctggttcatatgtggaggtgggtgtgtgaagctagacacgaaggtccctaaggttctgaagagacttgaactgtggaaatgctcttagcaggcatcccgaacccctgcttcggtgctgttttgaggagtaggatcttggagttcagaccaactatgactatcatttccttcactatctagaaaaacgctattctactttggaagagaatagtagttattttcaagtctcctgacagtcactgggagtacaaggtttgctaatgtgctctctggacgttattaatggccagtattagttgctgctgtattactgactcgcttagctgtagaaagggtaatactctcctgattttgtatgattggactcttaagtagctgctgttagtcagaattaaaacccatctcagactaagaatataatgaataagattaataggccaaaatatgtatctaatcacattgataaaaattaata

SEQ ID NO: 103369 - DNA, 741 bp, Homo sapiens
  Payload ID: 152
  Gene Symbol: ABI2
  Gene Name: abl-interactor 2
  ENST ID: ENST00000447762
  CDS Start-End: 234-461
gcgtgcgcgcgcccggccggccgtcgccgcggtgaccgtcctcggagtccgtcggctcgcgccccgcccccgtcgccccctcccctgtcgcgcgctggggctgtttctcgctccttccgagttaccgccgccgtcgccgccgctcctcctctcccggtcctgggtttccttggcgctgcggccgccgctccctctgcgacctgtatgaggaggaggaggaggaggatgtgaagatggcggagctgcagatgctgctggaagaggaaatcccggggggccgccgggccctcttcgacagctacacaaatctggaacgggtggccgattactgcgagaacaactacatacagagatggggtcttggtatgtcatgcaggctggaatgcagtggtgtgatcatagctcactgcagccttgaactcctgtgctcaagtgatcatcctgcctcagtctctcagtagtctgggactacagtcagcagataagcagagagccctagaagaaaccaaagcctacaccacccaatccttagcaagtgttgcctatctgataaacaccttggccaacaatgtcctgcagatgctggatatccaggcatcccagctacgaaggatggaatcttcaatcaatcatatttcacaaacagttgatattcataaagagaaagttgcaagaagagaaattggtattttgactaccaataaaaacacttcaaggacacataagattattgctccagcc

SEQ ID NO: 103370 - DNA, 563 bp, Homo sapiens
  Payload ID: 152
  Gene Symbol: ABI2
  Gene Name: abl-interactor 2
  ENST ID: ENST00000444584
  CDS Start-End: 111-245
accgccgccgtcgccgccgctcctcctctcccggtcctgggtttccttggcgctgcggccgccgctccctctgcgacctgtatgaggaggaggaggaggaggatgtgaagatggcggagctgcagatgctgctggaagaggaaatcccggggggccgccgggccctcttcgacagctacacaaatctggaacgggtggccgattactgcgagaacaactacatacagataagcagagagccctagaagaaaccaaagcctacaccacccaatccttagcaagtgttgcctatctgataaacaccttggccaacaatgtcctgcagatgctggatatccaggcatcccagctacgaaggatggaatcttcaatcaatcatatttcacaaatgttttcccacactgatgggcagctaactgaggcaaattagaggcgttgatcttgagtcgacttttgtgaccaaatttggaaacaattgcagtttgagattgaatgagacagttgatattcataaagagaaagttgcaagaagagaaattggtattttgactaccaataaaaac

SEQ ID NO: 103371 - DNA, 490 bp, Homo sapiens
  Payload ID: 152
  Gene Symbol: ABI2
  Gene Name: abl-interactor 2
  ENST ID: ENST00000425253
  CDS Start-End: 122-301
ccttccgagttaccgccgccgtcgccgccgctcctcctctcccggtcctgggtttccttggcgctgcggccgccgctccctctgcgacctgtatgaggaggaggaggaggaggatgtgaagatggcggagctgcagatgctgctggaagaggaaatcccggggggccgccgggccctcttcgacagctacacaaatctggaacgggtggccgattactgcgagaacaactacatacaggctttccgttttgacagtgcatatcctctggtgcttcctgacaaagaatacatggaaagttaaaaaaagaagactgggtacggtggctcattcctgtaatcctagcactttgggaggtcatggtaagaggattgctggagctcaggtgggaagactagcctgagcaacatgtcagcagataagcagagagccctagaagaaaccaaagcctacaccacccaatccttagcaagtgttgcctatctgataaac

SEQ ID NO: 103372 - DNA, 940 bp, Homo sapiens
  Payload ID: 152
  Gene Symbol: ABI2
  Gene Name: abl-interactor 2
  ENST ID: ENST00000454023
  CDS Start-End: 1-881
aggtgagtacccagaacatgaagatgggtgggctgccgcgtacaacacctccaactcagaagccccctagtccccctatgtcagggaaagggacacttgggcggcactccccctatcgcacactggagccagtgcgtcctccagtggtaccaaatgattacgtacctagcccaacccgtaatatggctccctcgcagcagagccctgtgaggacagcttctgtgaatcaaagaaatcgaacttacagcagcagtgggagtagtggagggagccacccaagtagtcggagcagcagtcgagagaacagtggaagtggtagtgtgggggttcctattgctgttcctactccatctcctcccagtgtctttccaggtcatcctgtacagttctacagcatgaataggcctgcctctcgccatactcccccaacaatagggggctcgttgccctatagacgccctccttccattacttcacaaacaagccttcagaatcagatgaatggaggacctttttatagccagaatccagtttcagatacaccacctccaccgccacctgtggaagaaccagtctttgatgagtctcccccacctcctcctcctccagaagattacgaagaggaggaagctgctgtggttgagtatagtgatccttatgctgaagaggacccaccgtgggctccacgttcttacttggaaaaggttgtggcaatttatgactatacaaaagacaaggaagatgagctgtcctttcaggaaggagccattatttatgtcatcaagaagaatgacgatggttggtatgagggagttatgaatggagtgactgggctttttcctgggaattacgttgagtctatcatgcattattctgagtaaagctcagcagggctgtgcttgcctcacaggaatagtcaggtcttcccagattatctgaa

SEQ ID NO: 103373 - DNA, 515 bp, Homo sapiens
  Payload ID: 152
  Gene Symbol: ABI2
  Gene Name: abl-interactor 2
  ENST ID: ENST00000413635
  CDS Start-End: 121-282
cttccgagttaccgccgccgtcgccgccgctcctcctctcccggtcctgggtttccttggcgctgcggccgccgctccctctgcgacctgtatgaggaggaggaggaggaggatgtgaagatggcggagctgcagatgctgctggaagaggaaatcccggggggccgccgggccctcttcgacagctacacaaatctggaacgggtggccgattactgcgagaacaactacatacagttattgagcatctttccattctgtgaggtcagtgtcagcagataagcagagagccctagaagaaaccaaagcctacaccacccaatccttagcaagtgttgcctatctgataaacaccttggccaacaatgtcctgcagatgctggatatccaggcatcccagctacgaaggatggaatcttcaatcaatcatatttcacaagcaaattagaggcgttgatcttgagtcgacttttgtgaccaaatttggaaacaattgcagtttgagattgaatgag

SEQ ID NO: 103374 - DNA, 1087 bp, Homo sapiens
  Payload ID: 152
  Gene Symbol: ABI2
  Gene Name: abl-interactor 2
  ENST ID: ENST00000416001
  CDS Start-End: 125-388
gctccttccgagttaccgccgccgtcgccgccgctcctcctctcccggtcctgggtttccttggcgctgcggccgccgctccctctgcgacctgtatgaggaggaggaggaggaggatgtgaagatggcggagctgcagatgctgctggaagaggaaatcccggggggccgccgggccctcttcgacagctacacaaatctggaacgggtggccgattactgcgagaacaactacatacagtcagcagataagcagagagccctagaagaaaccaaagcctacaccacccaatccttagcaagtgttgcctatctgataaacaccttggccaacaatgtcctgcagatgctggatatccaggtcatcctgtacagttctacagcatgaataggcctgcctctcgccatactcccccaacaatagggggctcgttgccctatagacgccctccttccattacttcacaaacaagccttcagaatcagatgaatggaggacctttttatagccagaatccagtttcagatacaccacctccaccgccacctgtggaagaaccagtctttgatgagtctcccccacctcctcctcctccagaagattacgaagaggaggaagctgctgtggttgagtatagtgatccttatgctgaagaggacccaccgtgggctccacgttcttacttggaaaaggttgtggcaatttatgactatacaaaagacaaggaagatgagctgtcctttcaggaaggagccattatttatgtcatcaagaagaatgacgatggttggtatgagggagttatgaatggagtgactgggctttttcctgggaattacgttgagtctatcatgcattattctgagtaaagctcagcagggctgtgcttgcctcacaggaatagtcaggtcttcccagattatctgaaggccctggggattccactccagtaaagtagaatgaaggatacaaatgataaaaattacacttttttttttggtttattccccagtattaaaaacaaagcaagctgagtctgaacaaatggatctttctgccatcatttgtacaatgctgagctgtctg

SEQ ID NO: 103375 - DNA, 580 bp, Homo sapiens
  Payload ID: 152
  Gene Symbol: ABI2
  Gene Name: abl-interactor 2
  ENST ID: ENST00000431886
  CDS Start-End: 117-443
cgagttaccgccgccgtcgccgccgctcctcctctcccggtcctgggtttccttggcgctgcggccgccgctccctctgcgacctgtatgaggaggaggaggaggaggatgtgaagatggcggagctgcagatgctgctggaagaggaaatcccggggggccgccgggccctcttcgacagctacacaaatctggaacgggtggccgattactgcgagaacaactacatacagtcagcagataagcagagagccctagaagaaaccaaagcctacaccacccaatccttagcaagtgttgcctatctgataaacaccttggccaacaatgtcctgcagatgctggatatccaggcatcccagctacgaaggatggaatcttcaatcaatcatatttcacaaatgttttcccacactgatgggcagctaactgaggcaaattagaggcgttgatcttgagtcgacttttgtgaccaaatttggaaacaattgcagtttgagattgaatgagacagttgatattcataaagagaaagttgcaagaagagaaattggtattttgactaccaataaaaacactt

SEQ ID NO: 103376 - DNA, 1676 bp, Homo sapiens
  Payload ID: 152
  Gene Symbol: ABI2
  Gene Name: abl-interactor 2
  ENST ID: ENST00000430418
  CDS Start-End: 124-1500
ctccttccgagttaccgccgccgtcgccgccgctcctcctctcccggtcctgggtttccttggcgctgcggccgccgctccctctgcgacctgtatgaggaggaggaggaggaggatgtgaagatggcggagctgcagatgctgctggaagaggaaatcccggggggccgccgggccctcttcgacagctacacaaatctggaacgggtggccgattactgcgagaacaactacatacagtcagcagataagcagagagccctagaagaaaccaaagcctacaccacccaatccttagcaagtgttgcctatctgataaacaccttggccaacaatgtcctgcagatgctggatatccaggcatcccagctacgaaggatggaatcttcaatcaatcatatttcacaaacagttgatattcataaagagaaagttgcaagaagagaaattggtattttgactaccaataaaaacacttcaaggacacataagattattgctccagccaaccttgaacgaccagttcgttatattagaaaacctattgactatacaattctagatgatattggacatggagtaaaggtgagtacccagaacatgaagatgggtgggctgccgcgtacaacacctccaactcagaagccccctagtccccctatgtcagggaaagggacacttggcagcagtgggagtagtggagggagccacccaagtagtcggagcagcagtcgagagaacagtggaagtggtagtgtgggggttcctattgctgttcctactccatctcctcccagtgtctttccagcccctgctggctctgctggcactcctccccttcctgctacttctgcatctgcccctgctcctcttgttcctgctactgtcccttcctccactgccccagacgctgctgctgggggtgcccagacccttgctgatggcttcacttctccaactccccctgttgtttcttccactccccctacaggtcatcctgtacagttctacagcatgaataggcctgcctctcgccatactcccccaacaatagggggctcgttgccctatagacgccctccttccattacttcacaaacaagccttcagaatcagatgaatggaggacctttttatagccagaatccagtttcagatacaccacctccaccgccacctgtggaagaaccagtctttgatgagtctcccccacctcctcctcctccagaagattacgaagaggaggaagctgctgtggttgagtatagtgatccttatgctgaagaggacccaccgtgggctccacgttcttacttggaaaaggttgtggcaatttatgactatacaaaagacaaggaagatgagctgtcctttcaggaaggagccattatttatgtcatcaagaagaatgacgatggttggtatgagggagttatgaatggagtgactgggctttttcctgggaattacgttgagtctatcatgcattattctgagtaaagctcagcagggctgtgcttgcctcacaggaatagtcaggtcttcccagattatctgaaggccctggggattccactccagtaaagtagaatgaaggatacaaatgataaaaattacacttttttttttggtttattccccagtattaaaaacaaagcaagctgagtctgaacaaa

SEQ ID NO: 103377 - DNA, 1430 bp, Homo sapiens
  Payload ID: 152
  Gene Symbol: ABI2
  Gene Name: abl-interactor 2
  ENST ID: ENST00000441061
  CDS Start-End: 1-131
cccaatccttagcaagtgttgcctatctgataaacaccttggccaacaatgtcctgcagatgctggatatccaggcatcccagctacgaaggatggaatcttcaatcaatcatatttcacaagcaaattagaggcgttgatcttgagtcgacttttgtgaccaaatttggaaacaattgcagtttgagattgaatgagacagttgatattcataaagagaaagttgcaagaagagaaattggtattttgactaccaataaaaacacttcaaggacacataagattattgctccagccaaccttgaacgaccagttcgttatattagaaaacctattgactatacaattctagatgatattggacatggagtaaaggtgagtacccagaacatgaagatgggtgggctgccgcgtacaacacctccaactcagaagccccctagtccccctatgtcagggaaagggacacttgggcggcactccccctatcgcacactggagccagtgcgtcctccagtggtaccaaatgattacgtacctagcccaacccgtaatatggctccctcgcagcagagccctgtgaggacagcttctgtgaatcaaagaaatcgaacttacagcagcagtgggagtagtggagggagccacccaagtagtcggagcagcagtcgagagaacagtggaagtggtagtgtgggggttcctattgctgttcctactccatctcctcccagtgtctttccaggtcatcctgtacagttctacagcatgaataggcctgcctctcgccatactcccccaacaatagggggctcgttgccctatagacgccctccttccattacttcacaaacaagccttcagaatcagatgaatggaggacctttttatagccagaatccagtttcagatacaccacctccaccgccacctgtggaagaaccagtctttgatgagtctcccccacctcctcctcctccagaagattacgaagaggaggaagctgctgtggttgagtatagtgatccttatgctgaagaggacccaccgtgggctccacgttcttacttggaaaaggttgtggcaatttatgactatacaaaagacaaggaagatgagctgtcctttcaggaaggagccattatttatgtcatcaagaagaatgacgatggttggtatgagggagttatgaatggagtgactgggctttttcctgggaattacgttgagtctatcatgcattattctgagtaaagctcagcagggctgtgcttgcctcacaggaatagtcaggtcttcccagattatctgaaggccctggggattccactccagtaaagtagaatgaaggatacaaatgataaaaattacacttttttttttggtttattccccagtattaaaaacaaagcaagctgagtctgaacaaa

SEQ ID NO: 103378 - DNA, 603 bp, Homo sapiens
  Payload ID: 152
  Gene Symbol: ABI2
  Gene Name: abl-interactor 2
  ENST ID: ENST00000451591
  CDS Start-End: 1-603
accttgaacgaccagttcgttatattagaaaacctattgactatacaattctagatgatattggacatggagtaaaggtgagtacccagaacatgaagatgggtgggctgccgcgtacaacacctccaactcagaagccccctagtccccctatgtcagggaaagggacacttgggcggcactccccctatcgcacactggagccagtgcgtcctccagtggtaccaaatgattacgtacctagcccaacccgtaatatggctccctcgcagcagagccctgtgaggacagcttctgtgaatcaaagaaatcgaacttacagcagtgggagtagtggagggagccacccaagtagtcggagcagcagtcgagagaacagtggaagtggtagtgtgggggttcctattgctgttcctactccatctcctcccagtgtctttccaggtcatcctgtacagttctacagcatgaataggcctgcctctcgccatactcccccaacaatagggggctcgttgccctatagacgccctccttccattacttcacaaacaagccttcagaatcagatgaatggaggacctttttatagccagaatccag

SEQ ID NO: 103379 - DNA, 1567 bp, Homo sapiens
  Payload ID: 152
  Gene Symbol: ABI2
  Gene Name: abl-interactor 2
  ENST ID: ENST00000417864
  CDS Start-End: 109-1567
cgccgccgtcgccgccgctcctcctctcccggtcctgggtttccttggcgctgcggccgccgctccctctgcgacctgtatgaggaggaggaggaggaggatgtgaagatggcggagctgcagatgctgctggaagaggaaatcccggggggccgccgggccctcttcgacagctacacaaatctggaacgggtggccgattactgcgagaacaactacatacagtcagcagataagcagagagccctagaagaaaccaaagcctacaccacccaatccttagcaagtgttgcctatctgataaacaccttggccaacaatgtcctgcagatgctggatatccaggcatcccagctacgaaggatggaatcttcaatcaatcatatttcacaaacagttgatattcataaagagaaagttgcaagaagagaaattggtattttgactaccaataaaaacacttcaaggacacataagattattgctccagccaaccttgaacgaccagttcgttatattagaaaacctattgactatacaattctagatgatattggacatggagtaaagtggttgcttagatttaaggtgagtacccagaacatgaagatgggtgggctgccgcgtacaacacctccaactcagaagccccctagtccccctatgtcagggaaagggacacttgggcggcactccccctatcgcacactggagccagtgcgtcctccagtggtaccaaatgattacgtacctagcccaacccgtaatatggctccctcgcagcagagccctgtgaggacagcttctgtgaatcaaagaaatcgaacttacagcagcagtgggagtagtggagggagccacccaagtagtcggagcagcagtcgagagaacagtggaagtggtagtgtgggggttcctattgctgttcctactccatctcctcccagtgtctttccagcccctgctggctctgctggcactcctccccttcctgctacttctgcatctgcccctgctcctcttgttcctgctactgtcccttcctccactgccccagacgctgctgctgggggtgcccagacccttgctgatggcttcacttctccaactccccctgttgtttcttccactccccctacaggtcatcctgtacagttctacagcatgaataggcctgcctctcgccatactcccccaacaatagggggctcgttgccctatagacgccctccttccattacttcacaaacaagccttcagaatcagatgaatggaggacctttttatagccagaatccagtttcagatacaccacctccaccgccacctgtggaagaaccagtctttgatgagtctcccccacctcctcctcctccagaagattacgaagaggaggaagctgctgtggttgagtatagtgatccttatgctgaagaggacccaccgtgggctccacgttcttacttggaaaaggttgtggcaatttatgactatacaaaagacaaggaagatgagctgtcctttcaggaaggagccattatttatgtcatcaagaagaatgacgatg

SEQ ID NO: 103380 - DNA, 6132 bp, Homo sapiens
  Payload ID: 153
  Gene Symbol: ASPM
  Gene Name: abnormal spindle microtubule assembly
  Uniprot ID: Q8IZT6
  ENST ID: ENST00000294732
  CDS Start-End: 258-5936
attggtggaggcggcaagtttaaacagagtcaaaacgccatacttgtttggctcctctttttaatttgcgagtttattgggcttgttttctgttttctagggagtaggttagtggaaaagaaaaagggccgaattcactcccacgacctctacagccgcccctgaggggaagcggtcagcgtaagtcccggatccccgctccggagccgcctcgtgggagcggggcaaggagatccaggaggggtctcgaatctgccatggcgaaccggcgagtggggcgaggctgctgggaagtgagcccgaccgagcggaggccgcccgcggggctgcggggccccgcggccgaggaggaggcgtcttccccgccggtcctgtctctcagccacttctgcaggtctcctttcctttgcttcggggacgttctcctgggagcctcacggacgctgtctctggccctagacaaccctaacgaggaggtggcagaagtgaagatctcccacttcccggccgcggacctgggcttcagtgtgtcgcagcgctgtttcgtgttgcagcctaaagagaaaattgttatttctgttaactggacaccactcaaagaaggccgagtaagagagattatgacatttcttgtaaatgatgttctgaaacaccaagctatattactaggaaatgcagaagagcagaaaaagaaaaagaggagtctttgggataccattaaaaagaagaaaatttcagcctctacaagtcacaacagaagggtttcaaatattcagaatgttaataaaacatttagtgtttcccaaaaagttgacagagttaggagcccactacaagcttgtgaaaacttggctatgaatgaaggcggtcccccaacagaaaacaattctttaatacttgaagaaaataaaatacccatatcacctattagccctgctttcaatgaatgccatggtgcaacttgcttgccactctctgtacgtcgatctactacctactcatctcttcatgcatcagaaaatagggaactattaaatgtacacagtgccaacgtttcaaaagtttcttttaatgagaaagctgtaactgaaacttcctttaattccgtaaatgttaatggccaaagaggagagaatagtaaacttagtcttacccccaactgttcttcaactttgaacattacacaaagccaaatacattttctaagtccagattcttttgtaaataatagtcatggagctaataatgaactagaattagtaacatgtctttcatcagatatgtttatgaaagataattcacagcctgtgcatttggaatcaacaattgcacatgaaatttatcagaaaattttaagtccagattctttcataaaagataattatggactaaatcaggatctagaatcagagtcagttaatcctattttatcccctaatcaatttttaaaagataacatggcatatatgtgtacatctcagcaaacatgtaaagtaccattatcaaatgaaaattctcaagtcccacagtctcctgaagattggagaaaaagtgaagtttcgccacgtattcctgaatgtcagggttcaaaatctcccaaagctatttttgaagaactagtagaaatgaagtcaaattactacagttttataaaacaaaataatcctaaattttctgcagttcaggatatttctagtcatagccacaataaacaacctaagagacgtccaatactttctgccactgttactaaaaggaaggccacctgtaccagagaaaaccaaactgagattaataaaccaaaagcaaaaagatgtctcaacagtgcagtgggtgaacatgaaaaagtaataaataatcaaaaggaaaaagaagattttcattcttatcttccaattatagatccaatattaagtaaatctaagagttataaaaacgaggtaacaccctcttcgacaacagcttcagttgctcggaaaagaaagagcgatggaagcatggaagatgcaaatgtgagagttgcaattacagaacatacagaagtgcgagaaatcaaaagaatccatttttctccctcagagcctaaaacatcagctgttaagaaaacaaaaaatgtgacaacacccatctcaaaacgtattagcaacagagagaaattaaacctgaagaagaaaactgatttatcaatattcagaactccaatttctaaaacaaacaaaaggacaaaacccattatcgctgtggcacagtccagtttgaccttcataaaaccattaaaaacagatattcccagacacccgatgccatttgctgcaaaaaacatgttttatgatgaacgctggaaggaaaagcaggaacagggcttcacttggtggttaaattttatattaacccctgatgacttcactgtaaaaacaaatatttctgaagtaaatgctgctactcttcttttgggaatagagaatcaacataaaataagtgttcctagagcacctacaaaagaggaaatgtctctcagagcttatactgctcggtgtaggttaaacagactacgtcgtgcagcatgccgtttgtttacttctgaaaaaatggttaaagctattaaaaagcttgaaattgaaattgaagctaggcggttaattgttcgaaaagatagacacctatggaaagatgtgggagaacgtcagaaagtcctgaattggctgttgtcctacaatcctttgtggcttcgaattggtctagagacaacttatggagaactcatatctttggaagataacagtgatgtcacagggttggctatgtttattctgaatcgcctactttggaatcctgatatagcagctgagtatagacaccccactgttcctcacctgtatagagatggtcatgaagaagctttgtccaagtttacattgaaaaagttattgttgttggtctgttttcttgattatgctaaaatttccagactcattgatcatgatccttgtctcttctgtaaagatgccgaattcaaggctagtaaagaaatccttttggctttttcacgagatttcctaagtggtgaaggtgacctttcccgtcaccttggcttattgggattacctgttaaccatgttcagacaccatttgatgaatttgattttgccgttacaaatcttgccgtagacttgcaatgtggagtgcgccttgtgcgaaccatggaacttctcacacagaactgggacctctcaaagaaactcaggattccggcaataagtcgtcttcaaaagatgcacaatgttgacattgttcttcaagttcttaaatcacgaggaattgaattaagtgatgagcatggaaatacaattctatctaaggatattgtggataggcacagagaaaaaactctcaggttgctttggaaaatagcgtttgcttttcaggtggatatttcccttaacttagatcaattaaaggaagaaattgcctttctaaaacacacaaagagtataaagaaaacaatatctctactatcatgccattctgatgatcttattaataagaaaaaaggcaaaagggatagtggttcctttgaacaatatagtgaaaacataaagttattgatggattgggtaaatgctgtttgtgccttctataataaaaaggtggagaattttacagtgtctttctcagacggccgtgtgttatgttacctgatccaccattaccatccttgctatgtgccatttgacgctatatgtcagcgtactactcaaactgtggaatgtacgcaaactggttcagtggtattaaattcatcatctgaatctgatgacagttctctggatatgtctcttaaagcatttgatcatgaaaatacttcagagctatacaaagagctcctagaaaatgaaaagaaaaattttcacttggttaggtctgcagttagagaccttggtggaatacctgctatgattaatcattcagatatgtcaaatacaattccagatgaaaaggtggttattacctatttgtcatttctttgtgcaaggcttttggatcttcgtaaagaaataagagctgctcgactcatacaaacaacatggagaaaatataaactaaaaacagatctcaaacgccatcaggagagagagaaagctgcaagaattattcaattggctgtaatcaattttctagcaaaacaaagattgagaaaaagagttaatgcagcactcgtcattcagaaatattggcgaagagtcttagcacagagaaaattattaatgttaaaaaaggaaaagctggaaaaagttcaaaataaagcagcatcacttattcaggctatgtggaggagatatagagccaagaaatatttatgtaaagtgaaagctgcctgcaagattcaagcctggtatagatgttggagagcacacaaagaatatctagctatattaaaagctgttaaaattattcaaggttgcttctataccaaactagagagaacacggtttttgaatgtgagagcatcagcaattatcattcagagaaaatggagagctatacttcctgcaaagatagctcatgaacacttcttaatgataaaaagacatcgagctgcttgtttgatccaagcacattatagaggatataaaggaaggcaggtctttcttcggcagaaatctgctgctttgatcatacaaaaatatatacgagccagggaggctggaaagcatgaaaggataaaatatattgaatttaaaaaatctacagttatcctacaagcactggtgcgtggttggctagtacgaaaaagatttttagaacagagagccaaaattcgacttcttcacttcactgcagctgcatattatcacctgaatgctgttagaattcaaagagcctataaactttacctggctgtgaagaatgctaacaagcaggttaattcagtcatctgtattcagagatggtttcgagcaagattacaagaaaagagatttattcagaaatatcatagcatcaaaaagattgagcatgaaggtcaagaatgtctgagccagcgaaatagggctgcatcagtaatacagaaagcagtgcgccattttctcctccgtaaaaagcaggaaaaattcactagtggaatcattaaaattcaggcattatggagaggctattcttggaggaagaaaaatgattgtacaaaaattaaagctatacgactaagtcttcaagttgttaatagggagattcgagaagaaaacaaactctacaaaagaactgcacttgcacttcattaccttttgacatataagcacctttctgccattcttgaggccttaaaacacctagaggtagttactagattgtctccactttgttgtgagaacatggcccagagtggagcaatttctaaaatatttgttttgatccgaagttgtaatcgcagtattccttgtatggaagtcatcagatatgctgtgcaagtcttgcttaatgtatctaagtatgagaaaactacttcagcagtttatgatgtagaaaattgtatagatatactattggagcttttgcagatataccgagaaaagcctggtaataaagttgcagacaaaggcggaagcatttttacaaaaacttgttgtttgttggctattttactgaagacaacaaatagagcctctgatgtacgaagtaggtccaaagttgttgaccgtatttacagtctctacaaacttacagctcataaacataaaatgaatactgaaagaatactttacaagcaaaagaagaattcttctataagcattccttttatcccagaaacacctgtaaggaccagaatagtttcaagacttaagccagattgggttttgagaagagataacatggaagaaatcacaaatcccctgcaagctattcaaatggtgatggatacgcttggcattccttattagtaaatgtaaacattttcagtatgtatagtgtaaagaaatattaaagccaatcatgagtacgtaaagtgatttttgctctccgtgtacaacttttaaaatctgactttgttttaaaaaaacataaactgttcattacattcttcatttttatcatttatagttttatgcatgtaataaactaatatgtcataagatg

SEQ ID NO: 103381 - DNA, 3747 bp, Homo sapiens
  Payload ID: 153
  Gene Symbol: ASPM
  Gene Name: abnormal spindle microtubule assembly
  ENST ID: ENST00000367408
  CDS Start-End: 127-3555
tttatattaacccctgatgacttcactgtaaaaacaaatatttctgaagtaaatgctgctactcttcttttgggaatagagaatcaacataaaataagtgttcctagagcacctacaaaagaggaaatgtctctcagagcttatactgctcggtgtaggttaaacagactacgtcgtgcagcatgccgtttgtttacttctgaaaaaatggttaaagctattaaaaagcttgaaattgaaattgaagctaggcggttaattgttcgaaaagatagacacctatggaaagatgtgggagaacgtcagaaagtcctgaattggctgttgtcctacaatcctttgtggcttcgaattggtctagagacaacttatggagaactcatatctttggaagataacagtgatgtcacagggttggctatgtttattctgaatcgcctactttggaatcctgatatagcagctgagtatagacaccccactgttcctcacctgtatagagatggtcatgaagaagctttgtccaagtttacattgaaaaagttattgttgttggtctgttttcttgattatgctaaaatttccagactcattgatcatgatccttgtctcttctgtaaagatgccgaattcaaggctagtaaagaaatccttttggctttttcacgagatttcctaagtggtgaaggtgacctttcccgtcaccttggcttattgggattacctgttaaccatgttcagacaccatttgatgaatttgattttgccgttacaaatcttgccgtagacttgcaatgtggagtgcgccttgtgcgaaccatggaacttctcacacagaactgggacctctcaaagaaactcaggattccggcaataagtcgtcttcaaaagatgcacaatgttgacattgttcttcaagttcttaaatcacgaggaattgaattaagtgatgagcatggaaatacaattctatctaaggatattgtggataggcacagagaaaaaactctcaggttgctttggaaaatagcgtttgcttttcaggtggatatttcccttaacttagatcaattaaaggaagaaattgcctttctaaaacacacaaagagtataaagaaaacaatatctctactatcatgccattctgatgatcttattaataagaaaaaaggcaaaagggatagtggttcctttgaacaatatagtgaaaacataaagttattgatggattgggtaaatgctgtttgtgccttctataataaaaaggtggagaattttacagtgtctttctcagacggccgtgtgttatgttacctgatccaccattaccatccttgctatgtgccatttgacgctatatgtcagcgtactactcaaactgtggaatgtacgcaaactggttcagtggtattaaattcatcatctgaatctgatgacagttctctggatatgtctcttaaagcatttgatcatgaaaatacttcagagctatacaaagagctcctagaaaatgaaaagaaaaattttcacttggttaggtctgcagttagagaccttggtggaatacctgctatgattaatcattcagatatgtcaaatacaattccagatgaaaaggtggttattacctatttgtcatttctttgtgcaaggcttttggatcttcgtaaagaaataagagctgctcgactcatacaaacaacatggagaaaatataaactaaaaacagatctcaaacgccatcaggagagagagaaagctgcaagaattattcaattggctgtaatcaattttctagcaaaacaaagattgagaaaaagagttaatgcagcactcgtcattcagaaatattggcgaagagtcttagcacagagaaaattattaatgttaaaaaaggaaaagctggaaaaagttcaaaataaagcagcatcacttattcaggctatgtggaggagatatagagccaagaaatatttatgtaaagtgaaagctgcctgcaagattcaagcctggtatagatgttggagagcacacaaagaatatctagctatattaaaagctgttaaaattattcaaggttgcttctataccaaactagagagaacacggtttttgaatgtgagagcatcagcaattatcattcagagaaaatggagagctatacttcctgcaaagatagctcatgaacacttcttaatgataaaaagacatcgagctgcttgtttgatccaagcacattatagaggatataaaggaaggcaggtctttcttcggcagaaatctgctgctttgatcatacaaaaatatatacgagccagggaggctggaaagcatgaaaggataaaatatattgaatttaaaaaatctacagttatcctacaagcactggtgcgtggttggctagtacgaaaaagatttttagaacagagagccaaaattcgacttcttcacttcactgcagctgcatattatcacctgaatgctgttagaattcaaagagcctataaactttacctggctgtgaagaatgctaacaagcaggttaattcagtcatctgtattcagagatggtttcgagcaagattacaagaaaagagatttattcagaaatatcatagcatcaaaaagattgagcatgaaggtcaagaatgtctgagccagcgaaatagggctgcatcagtaatacagaaagcagtgcgccattttctcctccgtaaaaagcaggaaaaattcactagtggaatcattaaaattcaggcattatggagaggctattcttggaggaagaaaaatgattgtacaaaaattaaagctatacgactaagtcttcaagttgttaatagggagattcgagaagaaaacaaactctacaaaagaactgcacttgcacttcattaccttttgacatataagcacctttctgccattcttgaggccttaaaacacctagaggtagttactagattgtctccactttgttgtgagaacatggcccagagtggagcaatttctaaaatatttgttttgatccgaagttgtaatcgcagtattccttgtatggaagtcatcagatatgctgtgcaagtcttgcttaatgtatctaagtatgagaaaactacttcagcagtttatgatgtagaaaattgtatagatatactattggagcttttgcagatataccgagaaaagcctggtaataaagttgcagacaaaggcggaagcatttttacaaaaacttgttgtttgttggctattttactgaagacaacaaatagagcctctgatgtacgaagtaggtccaaagttgttgaccgtatttacagtctctacaaacttacagctcataaacataaaatgaatactgaaagaatactttacaagcaaaagaagaattcttctataagcattccttttatcccagaaacacctgtaaggaccagaatagtttcaagacttaagccagattgggttttgagaagagataacatggaagaaatcacaaatcccctgcaagctattcaaatggtgatggatacgcttggcattccttattagtaaatgtaaacattttcagtatgtatagtgtaaagaaatattaaagccaatcatgagtacgtaaagtgatttttgctctccgtgtacaacttttaaaatctgactttgttttaaaaaaacataaactgttcattacattcttcatttttatcatttatagttttatgcatgtaataaactaatatgtcataa

SEQ ID NO: 103382 - DNA, 10887 bp, Homo sapiens
  Payload ID: 153
  Gene Symbol: ASPM
  Gene Name: abnormal spindle microtubule assembly
  Uniprot ID: Q8IZT6
  ENST ID: ENST00000367409
  CDS Start-End: 258-10691
attggtggaggcggcaagtttaaacagagtcaaaacgccatacttgtttggctcctctttttaatttgcgagtttattgggcttgttttctgttttctagggagtaggttagtggaaaagaaaaagggccgaattcactcccacgacctctacagccgcccctgaggggaagcggtcagcgtaagtcccggatccccgctccggagccgcctcgtgggagcggggcaaggagatccaggaggggtctcgaatctgccatggcgaaccggcgagtggggcgaggctgctgggaagtgagcccgaccgagcggaggccgcccgcggggctgcggggccccgcggccgaggaggaggcgtcttccccgccggtcctgtctctcagccacttctgcaggtctcctttcctttgcttcggggacgttctcctgggagcctcacggacgctgtctctggccctagacaaccctaacgaggaggtggcagaagtgaagatctcccacttcccggccgcggacctgggcttcagtgtgtcgcagcgctgtttcgtgttgcagcctaaagagaaaattgttatttctgttaactggacaccactcaaagaaggccgagtaagagagattatgacatttcttgtaaatgatgttctgaaacaccaagctatattactaggaaatgcagaagagcagaaaaagaaaaagaggagtctttgggataccattaaaaagaagaaaatttcagcctctacaagtcacaacagaagggtttcaaatattcagaatgttaataaaacatttagtgtttcccaaaaagttgacagagttaggagcccactacaagcttgtgaaaacttggctatgaatgaaggcggtcccccaacagaaaacaattctttaatacttgaagaaaataaaatacccatatcacctattagccctgctttcaatgaatgccatggtgcaacttgcttgccactctctgtacgtcgatctactacctactcatctcttcatgcatcagaaaatagggaactattaaatgtacacagtgccaacgtttcaaaagtttcttttaatgagaaagctgtaactgaaacttcctttaattccgtaaatgttaatggccaaagaggagagaatagtaaacttagtcttacccccaactgttcttcaactttgaacattacacaaagccaaatacattttctaagtccagattcttttgtaaataatagtcatggagctaataatgaactagaattagtaacatgtctttcatcagatatgtttatgaaagataattcacagcctgtgcatttggaatcaacaattgcacatgaaatttatcagaaaattttaagtccagattctttcataaaagataattatggactaaatcaggatctagaatcagagtcagttaatcctattttatcccctaatcaatttttaaaagataacatggcatatatgtgtacatctcagcaaacatgtaaagtaccattatcaaatgaaaattctcaagtcccacagtctcctgaagattggagaaaaagtgaagtttcgccacgtattcctgaatgtcagggttcaaaatctcccaaagctatttttgaagaactagtagaaatgaagtcaaattactacagttttataaaacaaaataatcctaaattttctgcagttcaggatatttctagtcatagccacaataaacaacctaagagacgtccaatactttctgccactgttactaaaaggaaggccacctgtaccagagaaaaccaaactgagattaataaaccaaaagcaaaaagatgtctcaacagtgcagtgggtgaacatgaaaaagtaataaataatcaaaaggaaaaagaagattttcattcttatcttccaattatagatccaatattaagtaaatctaagagttataaaaacgaggtaacaccctcttcgacaacagcttcagttgctcggaaaagaaagagcgatggaagcatggaagatgcaaatgtgagagttgcaattacagaacatacagaagtgcgagaaatcaaaagaatccatttttctccctcagagcctaaaacatcagctgttaagaaaacaaaaaatgtgacaacacccatctcaaaacgtattagcaacagagagaaattaaacctgaagaagaaaactgatttatcaatattcagaactccaatttctaaaacaaacaaaaggacaaaacccattatcgctgtggcacagtccagtttgaccttcataaaaccattaaaaacagatattcccagacacccgatgccatttgctgcaaaaaacatgttttatgatgaacgctggaaggaaaagcaggaacagggcttcacttggtggttaaattttatattaacccctgatgacttcactgtaaaaacaaatatttctgaagtaaatgctgctactcttcttttgggaatagagaatcaacataaaataagtgttcctagagcacctacaaaagaggaaatgtctctcagagcttatactgctcggtgtaggttaaacagactacgtcgtgcagcatgccgtttgtttacttctgaaaaaatggttaaagctattaaaaagcttgaaattgaaattgaagctaggcggttaattgttcgaaaagatagacacctatggaaagatgtgggagaacgtcagaaagtcctgaattggctgttgtcctacaatcctttgtggcttcgaattggtctagagacaacttatggagaactcatatctttggaagataacagtgatgtcacagggttggctatgtttattctgaatcgcctactttggaatcctgatatagcagctgagtatagacaccccactgttcctcacctgtatagagatggtcatgaagaagctttgtccaagtttacattgaaaaagttattgttgttggtctgttttcttgattatgctaaaatttccagactcattgatcatgatccttgtctcttctgtaaagatgccgaattcaaggctagtaaagaaatccttttggctttttcacgagatttcctaagtggtgaaggtgacctttcccgtcaccttggcttattgggattacctgttaaccatgttcagacaccatttgatgaatttgattttgccgttacaaatcttgccgtagacttgcaatgtggagtgcgccttgtgcgaaccatggaacttctcacacagaactgggacctctcaaagaaactcaggattccggcaataagtcgtcttcaaaagatgcacaatgttgacattgttcttcaagttcttaaatcacgaggaattgaattaagtgatgagcatggaaatacaattctatctaaggatattgtggataggcacagagaaaaaactctcaggttgctttggaaaatagcgtttgcttttcaggtggatatttcccttaacttagatcaattaaaggaagaaattgcctttctaaaacacacaaagagtataaagaaaacaatatctctactatcatgccattctgatgatcttattaataagaaaaaaggcaaaagggatagtggttcctttgaacaatatagtgaaaacataaagttattgatggattgggtaaatgctgtttgtgccttctataataaaaaggtggagaattttacagtgtctttctcagacggccgtgtgttatgttacctgatccaccattaccatccttgctatgtgccatttgacgctatatgtcagcgtactactcaaactgtggaatgtacgcaaactggttcagtggtattaaattcatcatctgaatctgatgacagttctctggatatgtctcttaaagcatttgatcatgaaaatacttcagagctatacaaagagctcctagaaaatgaaaagaaaaattttcacttggttaggtctgcagttagagaccttggtggaatacctgctatgattaatcattcagatatgtcaaatacaattccagatgaaaaggtggttattacctatttgtcatttctttgtgcaaggcttttggatcttcgtaaagaaataagagctgctcgactcatacaaacaacatggagaaaatataaactaaaaacagatctcaaacgccatcaggagagagagaaagctgcaagaattattcaattggctgtaatcaattttctagcaaaacaaagattgagaaaaagagttaatgcagcactcgtcattcagaaatattggcgaagagtcttagcacagagaaaattattaatgttaaaaaaggaaaagctggaaaaagttcaaaataaagcagcatcacttattcagggatattggagaagatattccactagacaaagatttctgaaattgaaatattattcaatcatcctgcaatctaggataagaatgataattgctgttacatcttataaacgatatctttgggctacagttacaattcagaggcattggcgtgcttatttaagaagaaaacaagatcaacaaagatatgaaatgctaaaatcatcaactcttataatccaatctatgttcagaaaatggaagcaacgtaaaatgcaatcacaagtaaaagctacagtaatattgcaaagagcttttagagaatggcatttaagaaaacaagctaaagaagaaaattctgctattatcatacaatcatggtatagaatgcataaagaattacggaaatatatttatattagatcttgtgttgttatcattcagaaaagatttcggtgctttcaagcccaaaagttatataaaagaagaaaagagtccatactaaccatccagaagtactacaaagcatatctgaaaggaaagattgagcgcaccaactatttgcagaaacgagctgcagccattcaattacaagctgcttttaggagactgaaagctcataatttatgtagacaaattagagctgcttgtgttattcagtcatactggagaatgagacaagacagagttcgatttttaaaccttaagaagactattatcaaatttcaggcacatgtaagaaaacatcaacaacgacagaaatataagaagatgaagaaagcagctgttataattcagactcatttccgagcttatatttttgccatgaaagttctagcatcttaccagaaaacacgctctgctgtcattgtgctgcagtctgcatatagagggatgcaagccaggaaaatgtatattcacatcctcacatctgttataaagattcaatcatattatcgtgcttatgtttctaaaaaggaatttttgagcctaaaaaatgctacaataaaattgcagtcaactgttaagatgaaacaaacacgtaaacaatatttgcatttaagagcagctgcactatttatccagcaatgttaccgttccaaaaaaatagctgcacaaaagagagaagagtatatgcagatgcgggaatcttgtatcaaactgcaagcatttgttagaggataccttgtccgaaagcagatgaggttacaaagaaaagctgttatttcactacagtcttatttcagaatgagaaaggctcggcagtattatctgaaaatgtataaagcaattattgtcattcagaattactatcatgcatacaaagcacaggtcaatcagaggaagaacttcttgcaagtcaaaaaagcagctacttgcttgcaagcagcttacagaggttataaagtacgccagctaatcaaacaacaatctatagctgctcttaaaattcagtctgcttttagaggctataataaaagggtaaaatatcaatctgtgcttcaatctataataaagattcagagatggtacagggcgtacaagactcttcatgatacaagaacacattttttgaagacaaaggcagctgtgatttccctccagtctgcttatcgtggctggaaggttcggaaacagattagaagggaacatcaagctgccttgaagattcagtctgcttttagaatggccaaggcccagaaacagtttagattgtttaaaacagcagcattagtcatccagcaaaatttcagagcatggactgcaggaaggaagcaatgtatggagtatattgaactccgtcatgcggtactggtgcttcaatctatgtggaagggaaaaacactgagaagacagcttcaaaggcaacataaatgtgctatcatcatacagtcatactatagaatgcatgtgcaacaaaagaagtggaaaatcatgaaaaaagctgctcttctgattcaaaagtattatagggcttacagtattggaagagaacagaatcatttatatttgaaaacaaaagcagctgtagtaactttacagtcagcttatcgtggtatgaaagtgagaaaaagaataaaggattgcaacaaagcagcagtcactatacagtctaaatacagagcttacaaaaccaaaaagaaatatgcaacctatagagcttcagctattataattcagagatggtatcgaggtattaaaattacaaaccatcagcataaggagtatcttaatttgaagaagacagcaattaaaatccaatctgtttatagaggtattagagttagaagacatattcaacacatgcacagggcagccacttttattaaagccatgtttaaaatgcatcagtcaagaataagttaccatacaatgagaaaagcagctattgttattcaagtaagatgtagagcatattatcaaggtaaaatgcagcgtgaaaagtacctgacaattttgaaagctgttaaagtccttcaggcaagttttagaggagtaagagttagacggactcttagaaagatgcagactgcagcaacactcattcagtcaaactacagaagatacagacagcaaacatactttaataagttaaagaaaataacaaaaacagtacagcaaagatactgggcaatgaaagaaagaaacatacaatttcaaaggtataacaaactgaggcattctgtaatatacattcaggctatttttaggggaaagaaagctagaagacatttaaaaatgatgcatatagccgcaactctcattcagaggagatttagaactctaatgatgagaagaagattcctctctctcaagaaaactgctattttgattcagagaaaatatcgggcacatctttgtacaaagcatcacttacagttccttcaggtacaaaatgcagttattaaaatccagtcatcatacagaagatggatgataaggaaaaggatgcgagagatgcacagggctgctactttcatccagtctactttcagaatgcacagattacatatgagatatcaggctttgaaacaggcctccgttgtgatccaacagcaataccaagcaaatagagctgcaaaactgcagaggcagcattatctcagacaaagacactctgctgtgatccttcaggctgcattcaggggtatgaaaactagaagacatttgaagagtatgcattcctctgcaacccttattcagagtaggtttagatcattactggtgaggagaagattcatttccctcaaaaaagctactatttttgttcagaggaaatatcgagccaccatttgtgccaaacataaattgtaccaattcttgcacttaagaaaggcagccattacaatacagtcatcttacagaagactgatggtaaagaagaagttacaagaaatgcaaagggctgcagttctcattcaggctactttcaggatgtacagaacatatattacatttcagacttggaaacatgcttcaattctaattcagcaacattatcgaacatatagagctgcaaaattacaaagagaaaattatatcagacaatggcattctgctgtggttattcaggctgcatataaaggaatgaaagcaagacaacttttaagggaaaaacacaaagcttctatcgtaatacaaagcacctacagaatgtataggcagtattgtttctaccaaaagcttcagtgggctacaaaaatcatacaagaaaaatatagagcaaataaaaagaaacagaaagtatttcaacacaatgaacttaagaaagagacttgtgttcaggcaggttttcaggacatgaacataaaaaaacagattcaggaacagcaccaggctgccattattattcagaagcattgtaaagcctttaaaataaggaagcattatctccaccttagagcaacagtagtttctattcaaagaagatacagaaaactaactgcagtgcgtacccaagcagttatttgtatacagtcttattacagaggctttaaagtacgaaaggatattcaaaatatgcaccgggctgccacactaattcagtcattctatcgaatgcacagggccaaagttgattatgaaacaaagaaaactgcaattgtggttatacagaattattataggttgtatgttagagtaaaaacagaaagaaaaaactttttagcagttcagaaatctgtacgaactattcaggctgcttttagaggcatgaaagttagacaaaaattgaaaaatgtatcagaggaaaagatggcagccattgttaaccaatctgcactctgctgttacagaagtaaaactcagtatgaagctgttcaaagtgaaggtgttatgattcaagagtggtataaagcttctggccttgcttgttcacaggaagcagagtatcattctcaaagtagggctgcagtaacaattcaaaaagctttttgtagaatggtcacaagaaaactggaaacacagaaatgtgctgccctacggattcagttcttccttcagatggctgtgtatcggagaagatttgttcagcagaaaagagctgctatcactttacagcattattttaggacgtggcaaaccagaaaacagtttttactatatagaaaagcagcagtggttttacaaaatcactacagagcatttctgtctgcaaaacatcaaagacaagtctatttacagatcagaagcagtgttatcattattcaagctagaagtaaaggatttatacagaaacggaagtttcaggaaattaaaaatagcaccataaaaattcaggctatgtggaggagatatagagccaagaaatatttatgtaaagtgaaagctgcctgcaagattcaagcctggtatagatgttggagagcacacaaagaatatctagctatattaaaagctgttaaaattattcaaggttgcttctataccaaactagagagaacacggtttttgaatgtgagagcatcagcaattatcattcagagaaaatggagagctatacttcctgcaaagatagctcatgaacacttcttaatgataaaaagacatcgagctgcttgtttgatccaagcacattatagaggatataaaggaaggcaggtctttcttcggcagaaatctgctgctttgatcatacaaaaatatatacgagccagggaggctggaaagcatgaaaggataaaatatattgaatttaaaaaatctacagttatcctacaagcactggtgcgtggttggctagtacgaaaaagatttttagaacagagagccaaaattcgacttcttcacttcactgcagctgcatattatcacctgaatgctgttagaattcaaagagcctataaactttacctggctgtgaagaatgctaacaagcaggttaattcagtcatctgtattcagagatggtttcgagcaagattacaagaaaagagatttattcagaaatatcatagcatcaaaaagattgagcatgaaggtcaagaatgtctgagccagcgaaatagggctgcatcagtaatacagaaagcagtgcgccattttctcctccgtaaaaagcaggaaaaattcactagtggaatcattaaaattcaggcattatggagaggctattcttggaggaagaaaaatgattgtacaaaaattaaagctatacgactaagtcttcaagttgttaatagggagattcgagaagaaaacaaactctacaaaagaactgcacttgcacttcattaccttttgacatataagcacctttctgccattcttgaggccttaaaacacctagaggtagttactagattgtctccactttgttgtgagaacatggcccagagtggagcaatttctaaaatatttgttttgatccgaagttgtaatcgcagtattccttgtatggaagtcatcagatatgctgtgcaagtcttgcttaatgtatctaagtatgagaaaactacttcagcagtttatgatgtagaaaattgtatagatatactattggagcttttgcagatataccgagaaaagcctggtaataaagttgcagacaaaggcggaagcatttttacaaaaacttgttgtttgttggctattttactgaagacaacaaatagagcctctgatgtacgaagtaggtccaaagttgttgaccgtatttacagtctctacaaacttacagctcataaacataaaatgaatactgaaagaatactttacaagcaaaagaagaattcttctataagcattccttttatcccagaaacacctgtaaggaccagaatagtttcaagacttaagccagattgggttttgagaagagataacatggaagaaatcacaaatcccctgcaagctattcaaatggtgatggatacgcttggcattccttattagtaaatgtaaacattttcagtatgtatagtgtaaagaaatattaaagccaatcatgagtacgtaaagtgatttttgctctccgtgtacaacttttaaaatctgactttgttttaaaaaaacataaactgttcattacattcttcatttttatcatttatagttttatgcatgtaataaactaatatgtcataagatg

SEQ ID NO: 103383 - DNA, 4427 bp, Homo sapiens
  Payload ID: 153
  Gene Symbol: ASPM
  Gene Name: abnormal spindle microtubule assembly
  ENST ID: ENST00000612785
  CDS Start-End: 258-4427
attggtggaggcggcaagtttaaacagagtcaaaacgccatacttgtttggctcctctttttaatttgcgagtttattgggcttgttttctgttttctagggagtaggttagtggaaaagaaaaagggccgaattcactcccacgacctctacagccgcccctgaggggaagcggtcagcgtaagtcccggatccccgctccggagccgcctcgtgggagcggggcaaggagatccaggaggggtctcgaatctgccatggcgaaccggcgagtggggcgaggctgctgggaagtgagcccgaccgagcggaggccgcccgcggggctgcggggccccgcggccgaggaggaggcgtcttccccgccggtcctgtctctcagccacttctgcaggtctcctttcctttgcttcggggacgttctcctgggagcctcacggacgctgtctctggccctagacaaccctaacgaggaggtggcagaagtgaagatctcccacttcccggccgcggacctgggcttcagtgtgtcgcagcgctgtttcgtgttgcagcctaaagagaaaattgttatttctgttaactggacaccactcaaagaaggccgagtaagagagattatgacatttcttgtaaatgatgttctgaaacaccaagctatattactaggaaatgcagaagagcagaaaaagaaaaagaggagtctttgggataccattaaaaagaagaaaatttcagcctctacaagtcacaacagaagggtttcaaatattcagaatgttaataaaacatttagtgtttcccaaaaagttgacagaagatacagacagcaaacatactttaataagttaaagaaaataacaaaaacagtacagcaaagatactgggcaatgaaagaaagaaacatacaatttcaaaggtataacaaactgaggcattctgtaatatacattcaggctatttttaggggaaagaaagctagaagacatttaaaaatgatgcatatagccgcaactctcattcagaggagatttagaactctaatgatgagaagaagattcctctctctcaagaaaactgctattttgattcagagaaaatatcgggcacatctttgtacaaagcatcacttacagttccttcaggtacaaaatgcagttattaaaatccagtcatcatacagaagatggatgataaggaaaaggatgcgagagatgcacagggctgctactttcatccagtctactttcagaatgcacagattacatatgagatatcaggctttgaaacaggcctccgttgtgatccaacagcaataccaagcaaatagagctgcaaaactgcagaggcagcattatctcagacaaagacactctgctgtgatccttcaggctgcattcaggggtatgaaaactagaagacatttgaagagtatgcattcctctgcaacccttattcagagtaggtttagatcattactggtgaggagaagattcatttccctcaaaaaagctactatttttgttcagaggaaatatcgagccaccatttgtgccaaacataaattgtaccaattcttgcacttaagaaaggcagccattacaatacagtcatcttacagaagactgatggtaaagaagaagttacaagaaatgcaaagggctgcagttctcattcaggctactttcaggatgtacagaacatatattacatttcagacttggaaacatgcttcaattctaattcagcaacattatcgaacatatagagctgcaaaattacaaagagaaaattatatcagacaatggcattctgctgtggttattcaggctgcatataaaggaatgaaagcaagacaacttttaagggaaaaacacaaagcttctatcgtaatacaaagcacctacagaatgtataggcagtattgtttctaccaaaagcttcagtgggctacaaaaatcatacaagaaaaatatagagcaaataaaaagaaacagaaagtatttcaacacaatgaacttaagaaagagacttgtgttcaggcaggttttcaggacatgaacataaaaaaacagattcaggaacagcaccaggctgccattattattcagaagcattgtaaagcctttaaaataaggaagcattatctccaccttagagcaacagtagtttctattcaaagaagatacagaaaactaactgcagtgcgtacccaagcagttatttgtatacagtcttattacagaggctttaaagtacgaaaggatattcaaaatatgcaccgggctgccacactaattcagtcattctatcgaatgcacagggccaaagttgattatgaaacaaagaaaactgcaattgtggttatacagaattattataggttgtatgttagagtaaaaacagaaagaaaaaactttttagcagttcagaaatctgtacgaactattcaggctgcttttagaggcatgaaagttagacaaaaattgaaaaatgtatcagaggaaaagatggcagccattgttaaccaatctgcactctgctgttacagaagtaaaactcagtatgaagctgttcaaagtgaaggtgttatgattcaagagtggtataaagcttctggccttgcttgttcacaggaagcagagtatcattctcaaagtagggctgcagtaacaattcaaaaagctttttgtagaatggtcacaagaaaactggaaacacagaaatgtgctgccctacggattcagttcttccttcagatggctgtgtatcggagaagatttgttcagcagaaaagagctgctatcactttacagcattattttaggacgtggcaaaccagaaaacagtttttactatatagaaaagcagcagtggttttacaaaatcactacagagcatttctgtctgcaaaacatcaaagacaagtctatttacagatcagaagcagtgttatcattattcaagctagaagtaaaggatttatacagaaacggaagtttcaggaaattaaaaatagcaccataaaaattcaggctatgtggaggagatatagagccaagaaatatttatgtaaagtgaaagctgcctgcaagattcaagcctggtatagatgttggagagcacacaaagaatatctagctatattaaaagctgttaaaattattcaaggttgcttctataccaaactagagagaacacggtttttgaatgtgagagcatcagcaattatcattcagagaaaatggagagctatacttcctgcaaagatagctcatgaacacttcttaatgataaaaagacatcgagctgcttgtttgatccaagcacattatagaggatataaaggaaggcaggtctttcttcggcagaaatctgctgctttgatcatacaaaaatatatacgagccagggaggctggaaagcatgaaaggataaaatatattgaatttaaaaaatctacagttatcctacaagcactggtgcgtggttggctagtacgaaaaagatttttagaacagagagccaaaattcgacttcttcacttcactgcagctgcatattatcacctgaatgctgttagaattcaaagagcctataaactttacctggctgtgaagaatgctaacaagcaggttaattcagtcatctgtattcagagatggtttcgagcaagattacaagaaaagagatttattcagaaatatcatagcatcaaaaagattgagcatgaaggtcaagaatgtctgagccagcgaaatagggctgcatcagtaatacagaaagcagtgcgccattttctcctccgtaaaaagcaggaaaaattcactagtggaatcattaaaattcaggcattatggagaggctattcttggaggaagaaaaatgattgtacaaaaattaaagctatacgactaagtcttcaagttgttaatagggagattcgagaagaaaacaaactctacaaaagaactgcacttgcacttcattaccttttgacatataagcacctttctgccattcttgaggccttaaaacacctagaggtagttactagattgtctccactttgttgtgagaacatggcccagagtggagcaatttctaaaatatttgttttgatccgaagttgtaatcgcagtattccttgtatggaagtcatcagatatgctgtgcaagtcttgcttaatgtatctaagtatgagaaaactacttcagcagtttatgatgtagaaaattgtatagatatactattggagcttttgcagatataccgagaaaagcctggtaataaagttgcagacaaaggcggaagcatttttacaaaaacttgttgtttgttggctattttactgaagacaacaaatagagcctctgtaagtattagtcagttgcctttctttaagattatttttctgtggtcttaa

SEQ ID NO: 103384 - DNA, 1147 bp, Homo sapiens
  Payload ID: 154
  Gene Symbol: ABO
  Gene Name: ABO blood group (transferase A, alpha 1-3-N-acetylgalactosaminyltransferase
  transferase B, alpha 1-3-galactosyltransferase)
  ENST ID: ENST00000538324
  CDS Start-End: 26-1147
ggaggccgagaccagacgcggagccatggccgaggtgttgcggacgctggccggaaaaccaaaatgccacgcacttcgacctatgatccttttcctaataatgcttgtcttggtcttgtttggttacggggtcctaagccccagaagtctaatgccaggaagcctggaacgggggttctgcatggctgttagggaacctgaccatctgcagcgcgtctcgttgccaaggatggtctacccccagccaaaggtgctgacaccgtgtaggaaggatgtcctcgtgaccccttggctggctcccattgtctgggagggcacattcaacatcgacatcctcaacgagcagttcaggctccagaacaccaccattgggttaactgtgtttgccatcaagaaatacgtggctttcctgaagctgttcctggagacggcggagaagcacttcatggtgggccaccgtgtccactactatgtcttcaccgaccagccggccgcggtgccccgcgtgacgctggggaccggtcggcagctgtcagtgctggaggtgcgcgcctacaagcgctggcaggacgtgtccatgcgccgcatggagatgatcagtgacttctgcgagcggcgcttcctcagcgaggtggattacctggtgtgcgtggacgtggacatggagttccgcgaccacgtgggcgtggagatcctgactccgctgttcggcaccctgcaccccggcttctacggaagcagccgggaggccttcacctacgagcgccggccccagtcccaggcctacatccccaaggacgagggcgatttctactacctgggggggttcttcggggggtcggtgcaagaggtgcagcggctcaccagggcctgccaccaggccatgatggtcgaccaggccaacggcatcgaggccgtgtggcacgacgagagccacctgaacaagtacctgctgcgccacaaacccaccaaggtgctctcccccgagtacttgtgggaccagcagctgctgggctggcccgccgtcctgaggaagctgaggttcactgcggtgcccaagaaccaccaggcggtccggcgtgagcggctgccaggggctctgggagggctgccggcagccccgtccccctcccgcccttggttttag

SEQ ID NO: 103385 - DNA, 1577 bp, Homo sapiens
  Payload ID: 154
  Gene Symbol: ABO
  Gene Name: ABO blood group (transferase A, alpha 1-3-N-acetylgalactosaminyltransferase
  transferase B, alpha 1-3-galactosyltransferase)
  ENST ID: ENST00000611156
  CDS Start-End: 26-1087
ggaggccgagaccagacgcggagccatggccgaggtgttgcggacgctggccggaaaaccaaaatgccacgcacttcgacctatgatccttttcctaataatgcttgtcttggtcttgtttggttacggggtcctaagccccagaagtctaatgccaggaagcctggaacgggggttctgcatggctgttagggaacctgaccatctgcagcgcgtctcgttgccaaggatggtctacccccagccaaaggtgctgacaccgtgtaggaaggatgtcctcgtgaccccttggctggctcccattgtctgggagggcacattcaacatcgacatcctcaacgagcagttcaggctccagaacaccaccattgggttaactgtgtttgccatcaagaaatacgtggctttcctgaagctgttcctggagacggcggagaagcacttcatggtgggccaccgtgtccactactatgtcttcaccgaccagccggccgcggtgccccgcgtgacgctggggaccggtcggcagctgtcagtgctggaggtgcgcgcctacaagcgctggcaggacgtgtccatgcgccgcatggagatgatcagtgacttctgcgagcggcgcttcctcagcgaggtggattacctggtgtgcgtggacgtggacatggagttccgcgaccacgtgggcgtggagatcctgactccgctgttcggcaccctgcaccccggcttctacggaagcagccgggaggccttcacctacgagcgccggccccagtcccaggcctacatccccaaggacgagggcgatttctactacctgggggggttcttcggggggtcggtgcaagaggtgcagcggctcaccagggcctgccaccaggccatgatggtcgaccaggccaacggcatcgaggccgtgtggcacgacgagagccacctgaacaagtacctgctgcgccacaaacccaccaaggtgctctcccccgagtacttgtgggaccagcagctgctgggctggcccgccgtcctgaggaagctgaggttcactgcggtgcccaagaaccaccaggcggtccggaacccgtgagcggctgccaggggctctgggagggctgccggcagccccgtccccctcccgcccttggttttagcagaacgggtaaactctgtttcctttgtccgtcctgttgtgagtaactgaagcctaggccccgtccccacctcaaatcacacacaccccctccccaccacagagacaccattacatacacagacacacacagaaagacacacacagacacaaaatcacacacacaccctccccgccacagagacaccattacatacacagacacacacagaaagacacagacacaaaatcacacacacaccctccccgccacagagacacaccattacatacacagacacgcaatcgcagatacgcccttccggccacagaaacacaccattacacacacatacacagaaagacacacacagacacacaatcacacgcagcccctccccgccacagagacacaccattacatacacagacacacacagaaagacac

SEQ ID NO: 103386 - DNA, 845 bp, Homo sapiens
  Payload ID: 155
  Gene Symbol: ABRACL
  Gene Name: ABRA C-terminal like
  Uniprot ID: Q9P1F3
  ENST ID: ENST00000367660
  CDS Start-End: 201-446
gggcggcccctttcttgagcgcagaaacacttacttttccccctaccctgctcctcctcctccacagccgtctttctctttgcctcagccacttccttccttggcctcaccctccccagtgcactgaagaaggtaaccgggtccagacccacgcggcgccagttctccggcgggaaggaaaaccgcgcagagaggcagcaatgaatgtggatcacgaggttaacctcttagtggaggaaattcatcgtttgggttcaaaaaatgctgatggaaagttaagcgtgaaatttggggtcctcttccgtgatgataaatgtgccaacctctttgaagcattggtaggaactcttaaagctgcaaaacgaaggaagattgtaacatatccaggagagctgcttctgcaaggtgttcatgatgatgttgacattatattactgcaagattaatgtggtttacatatctttatgtactgccattttttgtttctggtaaactggaatataaagtgaaagaacaaacatttgaacatacttaatgtatttttatagaactttgtaaacgaaaggagattcatgttttagaagtctgtccttttttatatcttgaaagaaaatctatgtatgatgctataaaataaatcctattatttttctcaggaatctggttaggaattgcaggcaatgagattttttgcggggcagggatgggaatgtttgttcataaataattagacattttctatagatatttgacattctgcgaaagcaacaagcaaactgaagaccaactcctatgagaaatattatgatgtttatgtaataaagacatgtaactgtcttaaattt

SEQ ID NO: 103387 - DNA, 456 bp, Homo sapiens
  Payload ID: 155
  Gene Symbol: ABRACL
  Gene Name: ABRA C-terminal like
  ENST ID: ENST00000461027
  CDS Start-End: 41-244
agttctccggcgggaaggaaaaccgcgcagagaggcagcaatgaatgtggatcacgaggttaacctcttagtggaggaaattcatcgtttgggttcaaaaagtaagtatctgacagagatagagtatttctcctggctttaccttggaacaggtgagactggcatgctggagaagcctatgaaggggtcacccagggcttcaggacacaggtctgggagctctgcccacagccccaggttataactgcccttagccaggaattgacatctggagacacggggcttttggggtattgtgattctgatgcagggaatagttgagatatttcattatttttcgatagaaagcaaattaccaagcttcttgtatttgactgcattgaaatttggtaattgaatcatgttcaaatttttacttgtcatactattaaaattcatgttttctgccttgttctg

SEQ ID NO: 103388 - DNA, 7553 bp, Homo sapiens
  Payload ID: 156
  Gene Symbol: AIM1
  Gene Name: absent in melanoma 1
  Uniprot ID: Q9Y4K1
  ENST ID: ENST00000369066
  CDS Start-End: 488-5659
agatgccaccaccactgccaagcagctgcattcctcgccgggaaattcctccaggcaagagaacgcagagacgcccgcccgcagtccgggggaggacgcttcaccaggtgctggccacgaacaggaggctttcctgggtgtgaggggtgcgccagggtcgcccacccaggagcggcccgcgggaggactaggcgaggcccctaacggagcccccagtgtgtgtgccgaagaaggctccctggggccccgcaacgcccgcagccagccccccaagggcgcgtctgatttgccaggtgagcctccggccgagggcgcagcgcacacggccagctccgcgcaggcagactgcacagcccgccccaagggtcacgcccaccctgctaaggtgctaactttggacatctacttgagtaagactgagggggcacaagtggacgagccggtcgtgattactcccagagcggaagattgcggtgactgggacgacatggagaagaggtccagcggccgtaggtcggggaggcggagggggtcgcagaaatccaccgactcccccggcgcggacgccgagctccctgagagcgctgccagggacgacgcggtgttcgacgacgaggtggcgccaaacgcggccagcgataacgcctcggcggaaaagaaagtgaaatctccgcgggcagccctcgacgggggcgttgcctccgctgcgagcccagagtccaagcccagccccggtaccaaagggcagctccgaggggagtcggaccggagcaaacagccacccccggcttcgtcccccacgaagaggaagggcaggagccgtgccctcgaggccgtgcccgccccgcccgccagcggcccccgggctcccgccaaggagtccccacccaagagggtgcccgatcccagcccagtcaccaagggcactgcggccgagagcggggaggaggcggcgcgggccatcccccgcgagctcccggtcaagagcagctcgctgctgccggagatcaagcccgagcacaagaggggcccgctccccaaccacttcaacggccgggcagagggaggtcgaagcagagagctgggcagagcggccggagcgcctggagcttctgacgccgacggcttgaagcccaggaaccatttcggcgtgggcaggtcgacagtgaccactaaagtgaccctccctgccaagcccaaacatgtggaactaaatcttaaaacccctaagaatcttgacagtttgggaaatgagcacaatccatttagccagccagttcacaaaggcaacactgccaccaaaatctccttatttgaaaacaaacggacaaacagtagcccaagacacactgacattcgaggccaaaggaatactcctgcctctagtaaaacgtttgttgggagggcaaagctgaatttagccaaaaaagccaaagaaatggagcaacctgaaaagaaagtaatgccaaacagtccccagaatggtgtgctggttaaggaaactgctatagaaaccaaagttaccgtctcggaagaagagattctgccagcaaccagaggaatgaatggagactcttctgagaatcaagctcttggtcctcagcctaaccaagatgataaagcagatgtacaaacagatgctggctgcctttcagaaccagtggcttctgctctgattcctgtcaaggatcataagctcttagagaaggaggactcagaggctgcagacagcaaaagccttgtacttgaaaatgtaaccgatacagcacaagacatccccaccactgtggataccaaagatttacctccaacggccatgccaaagccacagcatacattttctgactcacagtcccctgctgagtcatctcctgggccttctctttcactgtctgcacccgctcctggggatgttcccaaagacacatgtgttcaatcacccataagcagtttcccatgcactgatctaaaagtgtcagaaaaccataaaggatgtgttttgcctgtgtctcgtcagaacaatgagaaaatgccacttttagaacttggaggagaaacaacccctcctttgtccacagagcgtagtccagaagctgtgggaagtgagtgtccatccagagtcctcgtccaggtcaggtccttcgtgctccccgtggagagcacccaggatgtgagctcccaggtcatcccagagagctctgaagttagagaagtgcagttgccaacttgtcacagtaatgaacctgaagtggtttccgttgcaagttgtgctcccccacaagaggaagtactgggcaatgaacactctcattgcacagcagagctcgcggcaaaatctggcccacaagtcataccgccagcatcagagaaaactctgcctattcaggctcaaagtcagggcagcagaacacccctgatggctgaatccagtcccaccaactctcccagcagcggaaatcacttagccactcctcaaaggccagatcagactgttacaaatggccaggatagccctgccagccttttgaacatttctgctggtagtgatgatagtgtatttgattcttcttctgatatggaaaaattcactgaaattataaaacagatggatagcgcagtttgtatgcccatgaaaagaaagaaggccaggatgccaaactctcctgctcctcactttgccatgcctcctattcacgaagaccatttagaaaaggtgtttgatcccaaagtgtttacctttggtttggggaagaagaaggaaagtcagccagaaatgtcaccggctttacatttgatgcagaaccttgacacaaaatccaaactgagacccaaacgtgcatctgctgaacagagcgtcctcttcaagtccctgcacaccaacactaatgggaacagtgagcctctggtgatgccggaaatcaatgacaaagagaacagggacgtcacaaatggtggcattaagagatcgagactagaaaaaagtgcacttttctcaagcttgttatcttctttaccacaagacaaaatcttttctccttctgtgacatcagtcaacactatgaccacggctttcagtacttctcagaacggttccctatctcagtcttcagtgtcacagcccacgactgagggtgccccgccctgtggtttgaacaaagaacagtcaaatcttctgcccgacaactccttaaaggtcttcaatttcaactcgtcaagtacatcacactccagtttgaaaagtccaagccacatggaaaaatacccgcaaaaagagaaaaccaaagaagatctggattcacgaagcaacctacacttgccagaaactaaattttctgaattgtcaaaactgaagaatgatgatatggaaaaggctaatcatattgaaagtgttattaaatcaaacttgccaaactgtgcaaacagtgacaccgacttcatgggtcttttcaaatcaagccggtatgacccaagcatttctttttctggaatgtcattatcagacacaatgacacttagaggaagtgtccaaaataaactcaatccccgacctggaaaggtagtgatatatagtgaacccgacgtctctgagaagtgcattgaagttttcagtgacattcaggattgcagttcttggagcctctctccagtgatactcataaaagttgttagaggatgttggattttgtatgagcaaccaaattttgaagggcactccatccccttagaagaaggagaattggaactctctggtctctggggtatagaagacattttggaaaggcacgaagaagcagagtctgataagccagtggtgattggttccatcagacatgtggttcaggattacagagttagtcacattgacttatttactgaaccagaagggttaggaatcctaagttcctactttgatgatactgaagaaatgcagggatttggtgtaatgcagaagacttgttccatgaaagtacattggggcacgtggctgatttatgaagaacctggatttcagggtgttcctttcatcctggaacctggtgaataccctgacttgtccttctgggatacagaagaagcgtacattggatccatgcggcctctgaaaatgggtggccgtaaagttgaattccctacagatccaaaggtagttgtttatgaaaagcctttctttgaaggaaaatgtgtggaactagaaacaggaatgtgtagttttgtcatggagggaggtgaaacagaagaggcgactggagacgatcatttgccgtttacgtcagtggggtctatgaaagttctaagaggcatttgggttgcatatgagaaacctggatttaccggtcatcagtatttgctagaagaaggagaatacagggactggaaagcctggggaggttacaatggagagcttcagtctttacgacctatattaggtgatttttcaaatgctcacatgataatgtacagtgaaaaaaactttggatccaaaggttccagtattgatgtattgggaattgttgctaatttaaaggagactggatatggagtgaagacacagtctattaatgtactgagtggagtatgggtagcctatgaaaatcctgacttcacaggagaacagtatatactggataaaggattttataccagttttgaggactggggaggcaaaaattgtaagatctcttctgttcaacctatatgtttggattctttcactggcccaaggagacgaaatcagattcacttgttttcagaaccacagtttcaaggtcacagtcaaagttttgaagaaacaacaagtcaaattgatgattcattttctaccaagtcttgcagagtttcaggaggcagctgggttgtatatgatggagaaaatttcactggtaatcaatacgtgttggaagaaggccattatccttgtctgtctgcaatgggatgcccgcctggagcaactttcaagtctcttcgttttatagatgttgaattttctgaaccaacaattattctctttgaaagagaagacttcaaaggaaaaaagattgaacttaatgcagaaactgtcaatctccgatccctgggattcaacacacaaatacgctctgttcaggttattggtggcatatgggttacttatgaatatggcagttacagagggcgacagttcctattgtcacctgcagaagtacctaattggtatgaattcagtggctgtcgccaaataggttctctacgaccttttgttcagaagcgaatttatttcagacttcgaaacaaagcaacagggttattcatgtcaaccaatggaaacttagaggatctgaagcttctgaggatacaggtcatggaggatgtcggggccgatgatcagatttggatctatcaagaaggatgtatcaaatgcaggatagcagaagactgctgcctgacgattgtgggcagcctggtaacatctggctccaagctaggcctggccctggaccagaatgctgacagccagttctggagcttgaagtccgatggcaggatttacagcaagttgaagccaaatttagttttagacattaaagggggcacacagtatgatcaaaatcacattatcctcaacactgtcagcaaagagaagtttacacaagtgtgggaagccatggtcctatatacctgaacaaagaaggaagaagaatcttctggaggtccttccagccaccttatttcttaaaaaggacaatgctgatggaagaccagactggaaagtggatcgactcctccttcattgattctaaattcaaccttaaatcatgctgccatgactcagagaacttactcatcgtttcaaaagactatcatagctttaaaccaataatttgtcctcctttcatttcttgcctttcatttttggtagctgcttaaacaggttgcctaattagcagcttttgggtgattttgtaaaatgttatatcaagatttcaagactgtgtacattttaaattatttccaaagatagtgacaggagagaactggaacaaatttaccaactttgtggacctacaaagcccttacactttaaagggtaagacaaaggcttaagtttgaaaggtagagaactgtttagcatctgagaagaaatactttattaggcctgtaattttggttcttggccttaaacactttctggaacctttaaatatgctgcatagcacaatgggaaagccttaggtattcacacatttaaggaactctaaacaaaatactattttcctttagttcatattaaaaattaatacattttaaaaatttaatgtcaaagtctggtaacatttgttagtaggatttgagttattattttttgagacaggatctcaggctggagtgcagtggcacaatcacggctcactgcagcctctacctccccaggctcaggtgatcctcccacctcagcctcccaagtagctgggactataggcacacatcaccaagcccagccaaattttgttttttttttgtagagatggggtttcatcacgttgcccaggctgatctcgaacctctgggctcaagcaattcactcgcctcggcctcccaaaatgctgggattacaggcctgagccactgcgcccagccaggatttgaattattttaactcatccatgggctgccctagaatgtcacaaatgagggttgtttaatgcctttcttatagctgctactggaacactattatgacctaatttatgagccatccttactcatctacaagtgctgaagcaatgttacatacttttttgctaaactcagattttttagcctaatttcttgtcctcctatccacctgcatccacacatggcctgcatggggctgccttccctgcagtgttctgcagccatgcttcagggtatagctgttggtggacagcctcaggtcttgggggcactatagccactaaacgaggtgtgaaaggctcaagaggatgaccagcaattaattatccccagaaagtgaaggaaaagagacctttagggatgttgctggtcaagtcttgatttgaccggagtcaaatcaatcttcaagcaatcttggaatcctcaactgcagtaagcatttcaaaatgcaaacaaactgcttaacaactgacaagacaccagcccatacgctgctcttccaacagtgggttctagctttgaacaaaagtgctaaacatttccttgaatatattcttcctctttttgtcctcatcactcaatactggtgctcttgtcacaggtagaacagcttgtttcttttccatctattcaagtgtgtttctaattctaaaatgctgatcttctctggagtctatggtaggcaattatggtcactggaatagtttgtcttgttttaaaatattattggtgcatgtacaacagcatccaacatatctgtcttgttcctagatatatagctctgattttaggccttttgtgcataccattacaatatggtggggtaagacattctacagtagcctgtgctgaactgatctcttaaataaacttgcttctggttaactatgttgatgaaa

SEQ ID NO: 103389 - DNA, 1032 bp, Homo sapiens
  Payload ID: 156
  Gene Symbol: AIM1
  Gene Name: absent in melanoma 1
  ENST ID: ENST00000457437
  CDS Start-End: 85-1032
gagagttaaaccgaagggaatggtagagacggcaaccccgggcctgtgcccagctgaaggatgaactgagggcaggatcgttaaatgcagaagccgaagacagtggcctgggagaatctgggtccagagatgtcagctcttggaactgctttttcaagagaaggtggccgtaaagttgaattccctacagatccaaaggtagttgtttatgaaaagcctttctttgaaggaaaatgtgtggaactagaaacaggaatgtgtagttttgtcatggagggaggtgaaacagaagaggcgactggagacgatcatttgccgtttacgtcagtggggtctatgaaagttctaagaggcatttgggttgcatatgagaaacctggatttaccggtcatcagtatttgctagaagaaggagaatacagggactggaaagcctggggaggttacaatggagagcttcagtctttacgacctatattaggtgatttttcaaatgctcacatgataatgtacagtgaaaaaaactttggatccaaaggttccagtattgatgtattgggaattgttgctaatttaaaggagactggatatggagtgaagacacagtctattaatgtactgagtggagtatgggtagcctatgaaaatcctgacttcacaggagaacagtatatactggataaaggattttataccagttttgaggactggggaggcaaaaattgtaagatctcttctgttcaacctatatgtttggattctttcactggcccaaggagacgaaatcagattcacttgttttcagaaccacagtttcaaggtcacagtcaaagttttgaagaaacaacaagtcaaattgatgattcattttctaccaagtcttgcagagtttcaggaggcagctgggttgtatatgatggagaaaatttcactggtaatcaatacgtgttggaagaaggccattatccttgtctgtctgcaatgggatgcccgcctggagcaactttcaagtctcttcgttttatagatgtt

SEQ ID NO: 103390 - DNA, 9909 bp, Homo sapiens
  Payload ID: 156
  Gene Symbol: AIM1
  Gene Name: absent in melanoma 1
  ENST ID: ENST00000633556
  CDS Start-End: 102-6497
gagaaaggcgggcgagctggcgctcaggtgtgttcttccatagggcccgggcggcagagaggaccgcgtcccggcagtcggagcgggaggaggacaagacgatgccgctgtccccgccagcccagggcgaccccggggagcccagcccgtgcaggccccctaagaagcacaccaccttccacctctggcgctccaaaaagaagcagcagccggcgccgcctgactgtggggtgttcgttccgcacccgctcccggcgcctgccggagaggccagagctttggatgtagtcgatggaaaatatgtggttcgagactcccaggaatttccactgcactgtggggaatcccagttcttccacaccaccagtgaggcgcttggttccttacttctagagtctggaatatttaaaaagtccagagcacaacctccagaagacaacagaaggaagccagttttggggaaacttggcactctattcactgcaggaaggagaagaaacagtagaaacgggttagagagtcccaccagatcaaatgccaaaccactctctcccaaagatgtggtagcctctcctaagctcccagagagagagagtgagaggagcagatctcagagcagccaactgaagcaaacggacacaagcgaggagggctccccgcgggagaatccccgagaggcagagggcgagctccccgagagcggtggccccgcagccccccctgacgccgagctgtcacctcgctggagcagcagtgcagcggctgtggctgtgcagcagtgccatgaaaatgattcaccccaattagaacctctggaggcagagggagagcctttcccagatgccaccaccactgccaagcagctgcattcctcgccgggaaattcctccaggcaagagaacgcagagacgcccgcccgcagtccgggggaggacgcttcaccaggtgctggccacgaacaggaggctttcctgggtgtgaggggtgcgccagggtcgcccacccaggagcggcccgcgggaggactaggcgaggcccctaacggagcccccagtgtgtgtgccgaagaaggctccctggggccccgcaacgcccgcagccagccccccaagggcgcgtctgatttgccaggtgagcctccggccgagggcgcagcgcacacggccagctccgcgcaggcagactgcacagcccgccccaagggtcacgcccaccctgctaaggtgctaactttggacatctacttgagtaagactgagggggcacaagtggacgagccggtcgtgattactcccagagcggaagattgcggtgactgggacgacatggagaagaggtccagcggccgtaggtcggggaggcggagggggtcgcagaaatccaccgactcccccggcgcggacgccgagctccctgagagcgctgccagggacgacgcggtgttcgacgacgaggtggcgccaaacgcggccagcgataacgcctcggcggaaaagaaagtgaaatctccgcgggcagccctcgacgggggcgttgcctccgctgcgagcccagagtccaagcccagccccggtaccaaagggcagctccgaggggagtcggaccggagcaaacagccacccccggcttcgtcccccacgaagaggaagggcaggagccgtgccctcgaggccgtgcccgccccgcccgccagcggcccccgggctcccgccaaggagtccccacccaagagggtgcccgatcccagcccagtcaccaagggcactgcggccgagagcggggaggaggcggcgcgggccatcccccgcgagctcccggtcaagagcagctcgctgctgccggagatcaagcccgagcacaagaggggcccgctccccaaccacttcaacggccgggcagagggaggtcgaagcagagagctgggcagagcggccggagcgcctggagcttctgacgccgacggcttgaagcccaggaaccatttcggcgtgggcaggtcgacagtgaccactaaagtgaccctccctgccaagcccaaacatgtggaactaaatcttaaaacccctaagaatcttgacagtttgggaaatgagcacaatccatttagccagccagttcacaaaggcaacactgccaccaaaatctccttatttgaaaacaaacggacaaacagtagcccaagacacactgacattcgaggccaaaggaatactcctgcctctagtaaaacgtttgttgggagggcaaagctgaatttagccaaaaaagccaaagaaatggagcaacctgaaaagaaagtaatgccaaacagtccccagaatggtgtgctggttaaggaaactgctatagaaaccaaagttaccgtctcggaagaagagattctgccagcaaccagaggaatgaatggagactcttctgagaatcaagctcttggtcctcagcctaaccaagatgataaagcagatgtacaaacagatgctggctgcctttcagaaccagtggcttctgctctgattcctgtcaaggatcataagctcttagagaaggaggactcagaggctgcagacagcaaaagccttgtacttgaaaatgtaaccgatacagcacaagacatccccaccactgtggataccaaagatttacctccaacggccatgccaaagccacagcatacattttctgactcacagtcccctgctgagtcatctcctgggccttctctttcactgtctgcacccgctcctggggatgttcccaaagacacatgtgttcaatcacccataagcagtttcccatgcactgatctaaaagtgtcagaaaaccataaaggatgtgttttgcctgtgtctcgtcagaacaatgagaaaatgccacttttagaacttggaggagaaacaacccctcctttgtccacagagcgtagtccagaagctgtgggaagtgagtgtccatccagagtcctcgtccaggtcaggtccttcgtgctccccgtggagagcacccaggatgtgagctcccaggtcatcccagagagctctgaagttagagaagtgcagttgccaacttgtcacagtaatgaacctgaagtggtttccgttgcaagttgtgctcccccacaagaggaagtactgggcaatgaacactctcattgcacagcagagctcgcggcaaaatctggcccacaagtcataccgccagcatcagagaaaactctgcctattcaggctcaaagtcagggcagcagaacacccctgatggctgaatccagtcccaccaactctcccagcagcggaaatcacttagccactcctcaaaggccagatcagactgttacaaatggccaggatagccctgccagccttttgaacatttctgctggtagtgatgatagtgtatttgattcttcttctgatatggaaaaattcactgaaattataaaacagatggatagcgcagtttgtatgcccatgaaaagaaagaaggccaggatgccaaactctcctgctcctcactttgccatgcctcctattcacgaagaccatttagaaaaggtgtttgatcccaaagtgtttacctttggtttggggaagaagaaggaaagtcagccagaaatgtcaccggctttacatttgatgcagaaccttgacacaaaatccaaactgagacccaaacgtgcatctgctgaacagagcgtcctcttcaagtccctgcacaccaacactaatgggaacagtgagcctctggtgatgccggaaatcaatgacaaagagaacagggacgtcacaaatggtggcattaagagatcgagactagaaaaaagtgcacttttctcaagcttgttatcttctttaccacaagacaaaatcttttctccttctgtgacatcagtcaacactatgaccacggctttcagtacttctcagaacggttccctatctcagtcttcagtgtcacagcccacgactgagggtgccccgccctgtggtttgaacaaagaacagtcaaatcttctgcccgacaactccttaaaggtcttcaatttcaactcgtcaagtacatcacactccagtttgaaaagtccaagccacatggaaaaatacccgcaaaaagagaaaaccaaagaagatctggattcacgaagcaacctacacttgccagaaactaaattttctgaattgtcaaaactgaagaatgatgatatggaaaaggctaatcatattgaaagtgttattaaatcaaacttgccaaactgtgcaaacagtgacaccgacttcatgggtcttttcaaatcaagccggtatgacccaagcatttctttttctggaatgtcattatcagacacaatgacacttagaggaagtgtccaaaataaactcaatccccgacctggaaaggtagtgatatatagtgaacccgacgtctctgagaagtgcattgaagttttcagtgacattcaggattgcagttcttggagcctctctccagtgatactcataaaagttgttagaggatgttggattttgtatgagcaaccaaattttgaagggcactccatccccttagaagaaggagaattggaactctctggtctctggggtatagaagacattttggaaaggcacgaagaagcagagtctgataagccagtggtgattggttccatcagacatgtggttcaggattacagagttagtcacattgacttatttactgaaccagaagggttaggaatcctaagttcctactttgatgatactgaagaaatgcagggatttggtgtaatgcagaagacttgttccatgaaagtacattggggcacgtggctgatttatgaagaacctggatttcagggtgttcctttcatcctggaacctggtgaataccctgacttgtccttctgggatacagaagaagcgtacattggatccatgcggcctctgaaaatgggtggccgtaaagttgaattccctacagatccaaaggtagttgtttatgaaaagcctttctttgaaggaaaatgtgtggaactagaaacaggaatgtgtagttttgtcatggagggaggtgaaacagaagaggcgactggagacgatcatttgccgtttacgtcagtggggtctatgaaagttctaagaggcatttgggttgcatatgagaaacctggatttaccggtcatcagtatttgctagaagaaggagaatacagggactggaaagcctggggaggttacaatggagagcttcagtctttacgacctatattaggtgatttttcaaatgctcacatgataatgtacagtgaaaaaaactttggatccaaaggttccagtattgatgtattgggaattgttgctaatttaaaggagactggatatggagtgaagacacagtctattaatgtactgagtggagtatgggtagcctatgaaaatcctgacttcacaggagaacagtatatactggataaaggattttataccagttttgaggactggggaggcaaaaattgtaagatctcttctgttcaacctatatgtttggattctttcactggcccaaggagacgaaatcagattcacttgttttcagaaccacagtttcaaggtcacagtcaaagttttgaagaaacaacaagtcaaattgatgattcattttctaccaagtcttgcagagtttcaggaggcagctgggttgtatatgatggagaaaatttcactggtaatcaatacgtgttggaagaaggccattatccttgtctgtctgcaatgggatgcccgcctggagcaactttcaagtctcttcgttttatagatgttgaattttctgaaccaacaattattctctttgaaagagaagacttcaaaggaaaaaagattgaacttaatgcagaaactgtcaatctccgatccctgggattcaacacacaaatacgctctgttcaggttattggtggcatatgggttacttatgaatatggcagttacagagggcgacagttcctattgtcacctgcagaagtacctaattggtatgaattcagtggctgtcgccaaataggttctctacgaccttttgttcagaagcgaatttatttcagacttcgaaacaaagcaacagggttattcatgtcaaccaatggaaacttagaggatctgaagcttctgaggatacaggtcatggaggatgtcggggccgatgatcagatttggatctatcaagaaggatgtatcaaatgcaggatagcagaagactgctgcctgacgattgtgggcagcctggtaacatctggctccaagctaggcctggccctggaccagaatgctgacagccagttctggagcttgaagtccgatggcaggatttacagcaagttgaagccaaatttagttttagacattaaagggggcacacagtatgatcaaaatcacattatcctcaacactgtcagcaaagagaagtttacacaagtgtgggaagccatggtcctatatacctgaacaaagaaggaagaagaatcttctggaggtccttccagccaccttatttcttaaaaaggacaatgctgatggaagaccagactggaaagtggatcgactcctccttcattgattctaaattcaaccttaaatcatgctgccatgactcagagaacttactcatcgtttcaaaagactatcatagctttaaaccaataatttgtcctcctttcatttcttgcctttcatttttggtagctgcttaaacaggttgcctaattagcagcttttgggtgattttgtaaaatgttatatcaagatttcaagactgtgtacattttaaattatttccaaagatagtgacaggagagaactggaacaaatttaccaactttgtggacctacaaagcccttacactttaaagggtaagacaaaggcttaagtttgaaaggtagagaactgtttagcatctgagaagaaatactttattaggcctgtaattttggttcttggccttaaacactttctggaacctttaaatatgctgcatagcacaatgggaaagccttaggtattcacacatttaaggaactctaaacaaaatactattttcctttagttcatattaaaaattaatacattttaaaaatttaatgtcaaagtctggtaacatttgttagtaggatttgagttattattttttgagacaggatctcaggctggagtgcagtggcacaatcacggctcactgcagcctctacctccccaggctcaggtgatcctcccacctcagcctcccaagtagctgggactataggcacacatcaccaagcccagccaaattttgttttttttttgtagagatggggtttcatcacgttgcccaggctgatctcgaacctctgggctcaagcaattcactcgcctcggcctcccaaaatgctgggattacaggcctgagccactgcgcccagccaggatttgaattattttaactcatccatgggctgccctagaatgtcacaaatgagggttgtttaatgcctttcttatagctgctactggaacactattatgacctaatttatgagccatccttactcatctacaagtgctgaagcaatgttacatacttttttgctaaactcagattttttagcctaatttcttgtcctcctatccacctgcatccacacatggcctgcatggggctgccttccctgcagtgttctgcagccatgcttcagggtatagctgttggtggacagcctcaggtcttgggggcactatagccactaaacgaggtgtgaaaggctcaagaggatgaccagcaattaattatccccagaaagtgaaggaaaagagacctttagggatgttgctggtcaagtcttgatttgaccggagtcaaatcaatcttcaagcaatcttggaatcctcaactgcagtaagcatttcaaaatgcaaacaaactgcttaacaactgacaagacaccagcccatacgctgctcttccaacagtgggttctagctttgaacaaaagtgctaaacatttccttgaatatattcttcctctttttgtcctcatcactcaatactggtgctcttgtcacaggtagaacagcttgtttcttttccatctattcaagtgtgtttctaattctaaaatgctgatcttctctggagtctatggtaggcaattatggtcactggaatagtttgtcttgttttaaaatattattggtgcatgtacaacagcatccaacatatctgtcttgttcctagatatatagctctgattttaggccttttgtgcataccattacaatatggtggggtaagacattctacagtagcctgtgctgaactgatctcttaaataaacttgcttctggttaactatgttgatgaaatctgagagtccattcagtagccctcatctcacccttcaaagagagtcagctagcagattagaaacaaatgtctgattaggatgaagcaggtttgaggggtgctggtataatagcaagaaagatttgctgaccactctctttccaaactccatagtttctgagtggaaacgaggatgagtgaggtcctggctcaagtattttactcccactaccacctgggagccctccaggaaaagagctgaggctgctccagatggaagtcaagagcagctggtatttacacctggaaaatcagatttttttttcttttgcaataactcggtagtaagaccagaccaacaattttagagaaaagcctacatctaacatacatgctaccaaacgagtgtctaacaggaataaaccaagcagaaatctcaaaacaggtctacatcaaaagttacaagcaagcatatcaggtgcaatactgaggatgagtatattaggaagtaaaaacacttaccgtaaatgaatattcgaagtgcacactgcaatgggttgattggagagatatctaaatgtaaacatttgacatcaaagtggcaagctttgggctccattggaaggctgcaatttccatggaaaagccctcagagaagcatgtttcaattgccgaaacaggcctaatccttatgcaagatgtaagggttttaaaaagttagaaactctgctctcacctttcaatattaagagcataaacaaatgaatcaccaggcagatttttatatatgacactaagagatttagaactttaagagctgtggtgaccacattatggtggaggaacaaaaaaggaaaccttggcagttagaaagctgctcagtgatgaattcaagaaggaaccagctttaaattatctcttcatgccaacatccatctatacactgaaagttttagtattgtacattaagacgatcaggcccagcagggtggttcacgcctgtaatcccagaactttgggagactgacatggtggatcacttaagcccaggagtttgagaccagcctgggcaacatggcaaaactgtctctactaaaaatacaaaaaaactagctgggtgtggtgatgcatacctgtagtcctacctacttgagaggctgaagcaggagaatcgcttaaggtcaaggctgcagtgagctgtgattgtgccactgcactccagcctgggtgacacagcgagaccctgtctctaaaacaaaaaagacaataaagtagtttaagctagtaaaacagaaggtgccacaacaacctgcaaagccagtgtgaaggaacagcttgaaaaaacttcgaatttctactgactacagacaaatccaagtgctgatatttttatatcaattactggccaaaatggtgtgtttattttttaaagcttgtatcatggaatgtataatctaatctggaaaaatgtttgaaagggatggctagaaaaaaatttgggctcacaggcactcaccaaataagaacgtcaacaatca

SEQ ID NO: 103391 - DNA, 5245 bp, Homo sapiens
  Payload ID: 157
  Gene Symbol: AIM1L
  Gene Name: absent in melanoma 1-like
  Uniprot ID: Q8N1P7
  ENST ID: ENST00000308182
  CDS Start-End: 151-5136
agctgagagcccaatcgcatcaggggagcacggcccagcagcaggagctccaggctggctggacacctgggtccccacgcagactgtgagtagagggagctggaccacagtgggacaaggacacctccagacaggttgccagggccccacatggaggaggcaggtgggcccatggcccgggccaaggcccgagtggtaagtgccacattgacatggcggcagcggccccccacccaggaagagatcaaacatggttttcacaaggtgtccctggtgtcaggggcccagatggaagccccgcagaaggagatgtttgagttcagccgtcgagaggaagtggaagtcaatggctttgcaacacaggaagaagagactgtgaattgccagggccctcgggatacagctggctccaagaacttccagagccatggacccatcttttccaagaagtacataccacctcccaaggagaaaaggcctgaggggaggctgaaggaggctgtggaccagagtgatggcagccgccaagctcccaggactgagcccccatgtgtgggagctatggccaggactgagcttttggttcccctgcctgggccccgagagccaagtccccacccaggtgtaggtctcaccagtggtagctcccggagcctcgaggaataccgagtgacacgcactgtgcggaccaccacagtggtgggaggtcatgtggaccggcggatgagcagctctgtgactgtgaggccagtgtcctcaggcgaggccctgccacggggccgtcaggtctcccgcatggtgccgccagtggtggtgggctccccaccaggctcgcccagccgcagccaggccgtgaaagtgctaagtaacctcgtgcctgctgggcacagcccccctgccagtcacctgcccaggcccacggctggcgggccaaggagcacaggtctgggcagcacagtgggggcagccttgaggcagctgcctgagaccgggacagcagagcttaaagacagctctgccctggcctctacaggcatcccagccagtgctcacctgcctaagaatcaggatgcccctgcagcctgtccggacagagaccagggcagagccccggatgccagggcctgtgagctctggcaggtgctgggagcccccagttccactgagctccctctccagacttctcagggtcaagcatcagtcccctcctctcccagactcgagacccatgtcccctctcctggcctaactcaccctgcaaagcagcctgtggtgcccactcaccccggggcccggctcactccccttgttctgccccctaaaaaaaaggacgggcccgtggacccccctgctgccaccgtcctgcccatggtgaggagcgagcatgtgacagtccctggacaacctcctgctccatccactacaagaaggaaggatgtccccagcccaggaggtctttctgctccatcgtccccaaggaataagtttgttcagaactctgaaaatgtccctgtcctcccctttacccagagggaggtcgtgaagggccccggtgctcctgctgcctcatctcccacccggaaggaggtggtgcaggggtccagtgcttctgctgcctcgtcccccacctggaaagaggtcgtgaagggccctggtgctcctgctgcctcatctcccacccagaaggaggtggtgcaggggtccagtgctcctgctgccttgttccccacctggaaagaggtcgtgaagggccccggtgctcctgatgcctcatttcccacctggaaagaggttgtgaagggccctggtgctcctgctgcctcatcccccacccagaaggaggtggtgcaggggtctggtgctcctgctgccttgtccaccaccccaaaagaggttgtgaagggccctggtgctcctgctgcctcatcgcccacccagaaagaggttgtgaagggcccctgtgctcctgctgcctcatctcccacccagaaggaggtggtgcaggggtctggtgctcctgctgccttgtcccccaagtcaactgaggttgtccagggcccaaaaggcagcagtagcatccaaaaagaggctgtccagggtattgcaggcagccttgccccgcccctcaccaaggaagagactgttcaaggcccaattgctcctgccacctcactccccaaacaggataagggggtccaggactctgaagggagccccatctcatctctcacccagaaagaggttgtgcaggaccctgatgctctccctgccccatcttcctcagtggacagggtgtcccccagcccaggaggcacccctgccccagtgccaacaggagcagaggccagcacggagtcccagcttgtctctgatcccaccgagggcaagacgtgcacagagacatcaagggaggaggatgaggtggccctggccgctgacctggagatattcctggatacgctgcggagcatggagccccctgagatcctccgcactcaccggctgccacgagcccctcgctcctcctacctgtccatgtacgccacgctgcctgccattgaggaggaccagctggggccatgggtgctgggccccggaccccaggaggtgccttcactggaagagaaagaggaggaggaggaggaggaaccagagaacccctatctgagtgacgatgagaagctccagcgcaggcaggagaaagctgggcccagcccctccagggacctccaccctgccagacccacccaggtctcctgctctcctctggagatgatgaagaagcatgtagcaggaaccaagggcccccactcagagctgggattggaactgcagggaggcagcaggcccacttcccgtcttggaggcagccttctgttcggcagtctggtgcctaccgccaaggaggcctccaccccggaaccgctgggcacaaaactatctgctctgctgccccatggggcaccggggctcaggaaggtgccaggacagttgcccctgctttgcagtgaaagatcatccccaacggagaagcttgcctgttccctgcccctggaggggtggagcccagccttaaagacccagggcaagctgaacaccaggcctggaaaggtgatcttcttctcagagtctggctgccaaggcagtggcagggaggtctggggagacatcgttgatgcctcaggctgggcccccgtagcctccataagggtagttcgaggctgctgggtgctgtacgaagagccagagttccggggtcagaagctggtcctgcctgaaggagacatggaactcagaaccccagggacaaagtggagtccccaaggcatcggctccctaaggagggttgtctgggactacagcaccccggaaatcagcctcttctctgaggagggcctcaagggggagcaagtgaagctaacagaggccttgaagaattcccagggtctggagaagcccctgcaggtggcatctgccaccgtctctgcaggactgtggctactgtaccccaaaccattattcgaagacactccctacatcctggaacctggagagtaccccacctcagaggcctggggcacatcggaccccagcgtgggctccctgaagcccatgagattgggctgcccaagtgtggagaagccaggggagcccagggctgtggtgtatgaggccccaggctttcagggccgcagctgggaagtgagccgagacatctacaaccttcagcagccagaggacagccagagcccccacctggcctctgtggggtccctgagagttctcggaggctgctgggtgggctacgagaaggagggcttccggggccaccagtatctgctggaggagggggaatacccagactggtcacactggggaggctatgacgagttgctgacctccctccgggtcatccggacggacttcggggacccggccgtcgtgctatttgaggccatggacttcgaggggcacggcgtggaggtgagcaaggcattgccggatgtggagctggtgcaacacggccccagcacacaggccatccacgtgctcagcggcgtgtgggtggcctaccaggaggtgggcttctccggggaacagtacgtgctggagaagggcgtgtatcgtaactgcgaggactggggcgctggcaacagcaccctcgcctcgctgcagccggtcctacaggtcggggagcacgatctgcacttcgtctcaaagattcagcttttctcccgccccgactttctgggcgaccacttctctttcgaagatgaccaggccgctctgcccgcctccttccgacctcagtcctgccgggtccacggcggcagctggatcctgtttgatgagacgaacttcgagggtgaccagcacattctctctgagggcgagttccccactctcacggccatgggctgcctcgcctccacagtcctgggctctctccagaaggtatccctgcacttttcagagccttccattttcctgtatggactcgagtgcttcgaggggaaggagatcgagctcagcagggaggtgcggagcctgcaagccgagggcttcaacaaccatgtgctgtctgtgcggatcaaggggggcatttgggtgctatgtgaacacagtgacttccggggccgccagtggctggtgggaagctgcgagatcaccaactggctgacctacagcggcacccagagggtgggctccctctaccccatcaagcagcgccgggtttatttccgcctctggaatgcagcactggggggattcctggcagtgccggaccatgtggaggacatgaaagcaggccgtgtggtggtcgccgacccccaagctggaggtagctgcatctggtactacgaggatgggctgctgaagaaccagatggcccccaccatgagcctacaggtgattggaccccctagcccaggctccaaggtggtgctgtgggccgagagccgcctgccgcgccagacgtggagcatcagtgaatcgggccacatctgcagccagatgttcgaaggccagatcctggacgtgaagggaggccggggctacgaccgggaccacgtggtgctatgggagccggatgaggacagggcatcccagatctggactatccacgtgctttgaaacttttcccctcaccctccagccctggaggcttttgctgggatgaatgtttttatagggtttttgttgtaacataagctattttctaatatgctgccaggtacccttg

SEQ ID NO: 103392 - DNA, 1353 bp, Homo sapiens
  Payload ID: 157
  Gene Symbol: AIM1L
  Gene Name: absent in melanoma 1-like
  ENST ID: ENST00000374207
  CDS Start-End: 117-1175
ccagcagcaggagctccaggctggctggacacctgggtccccacgcagactgtgagtagagggagctggaccacagtgggacaaggacacctccagacaggttgccagggccccacatggaggaggcaggtgggcccatggcccgggccaaggcccgagtggacgggcccgtggacccccctgctgccaccgtcctgcccatggtgaggagcgagcatgtgacagtccctggacaacctcctgctccatccactacaagaaggaaggatgtccccagcccaggagtggacagggtgtcccccagcccaggaggcacccctgccccagtgccaacaggagcagaggccagcacggagtcccagcttgtctctgatcccaccgagggcaagacgtgcacagagacatcaagggaggaggatgaggtggccctggccgctgacctggagatattcctggatacgctgcggagcatggagccccctgagatcctccgcactcaccggctgccacgagcccctcgctcctcctacctgtccatgtacgccacgctgcctgccattgaggaggaccagctggggccatgggtgctgggccccggaccccaggaggtgccttcactggaagagaaagaggaggaggaggaggaggaaccagagaacccctatctgagtgacgatgagaagctccagcgcaggcaggagaaagctgggcccagcccctccagggacctccaccctgccagacccacccaggtctcctgctctcctctggagatgatgaagaagcatgtagcaggaaccaagggcccccactcagagctgggattggaactgcagggaggcagcaggcccacttcccgtcttggaggcagccttctgttcggcagtctggtgcctaccgccaaggaggcctccaccccggaaccgctgggcacaaaactatctgctctgctgccccatggggcaccggggctcaggaaggtgccaggacagttgcccctgctttgcagtgaaagatcatccccaacggagaagcttgcctgttccctgcccctggaggggtggcccagccttaaagacccagggcaagctgaacaccaggcctggaaaggtgatcttcttctcagagtctggctgccaaggcagtggcagggaggtctggggagacatcgttgatgcctcaggctgggcccccgtagcctccataagggtagttcgaggctgctgggtgctgtacgaagagccagagttccggggtcagaagctggtcctgcctgaaggagacatggaactcagaaccccagggacaaagtggagtccccaaggcatcggctccctaaggagggttgtctgg

SEQ ID NO: 103393 - DNA, 886 bp, Homo sapiens
  Payload ID: 157
  Gene Symbol: AIM1L
  Gene Name: absent in melanoma 1-like
  ENST ID: ENST00000429942
  CDS Start-End: 1-886
ttcccagggtctggagaagcccctgcaggtggcatctgccaccgtctctgcaggactgtggctactgtaccccaaaccattattcgaagacactccctacatcctggaacctggagagtaccccacctcagaggcctggggcacatcggaccccagcgtgggctccctgaagcccatgagattggctgtggtgtatgaggccccaggctttcagggccgcagctgggaagtgagccgagacatctacaaccttcagcagccagaggacagccagagcccccacctggcctctgtggggtccctgagagttctcggaggctgctgggtgggctacgagaaggagggcttccggggccaccagtatctgctggaggagggggaatacccagactggtcacactggggaggctatgacgagttgctgacctccctccgggtcatccggacggacttcggggacccggccgtcgtgctatttgaggccatggacttcgaggggcacggcgtggaggtgagcaaggcattgccggatgtggagctggtgcaacacggccccagcacacaggccatccacgtgctcagcggcgtgtgggtggcctaccaggaggtgggcttctccggggaacagtacgtgctggagaagggcgtgtatcgtaactgcgaggactggggcgctggcaacagcaccctcgcctcgctgcagccggtcctacaggtcggggagcacgatctgcacttcgtctcaaagattcagcttttctcccgccccgactttctgggcgaccacttctctttcgaagatgaccaggccgctctgcccgcctccttccgacctcagtcctgccgggtccacggcggcagctggatcctgtttgatgagacgaac

SEQ ID NO: 103394 - DNA, 1548 bp, Homo sapiens
  Payload ID: 157
  Gene Symbol: AIM1L
  Gene Name: absent in melanoma 1-like
  ENST ID: ENST00000475866
  CDS Start-End: 151-1548
agctgagagcccaatcgcatcaggggagcacggcccagcagcaggagctccaggctggctggacacctgggtccccacgcagactgtgagtagagggagctggaccacagtgggacaaggacacctccagacaggttgccagggccccacatggaggaggcaggtgggcccatggcccgggccaaggcccgagtggtaagtgccacattgacatggcggcagcggccccccacccaggaagagatcaaacatggttttcacaaggtgtccctggtgtcaggggcccagatggaagccccgcagaaggagatgtttgagttcagccgtcgagaggaagtggaagtcaatggctttgcaacacaggaagaagagactgtgaattgccagggccctcgggatacagctggctccaagaacttccagagccatggacccatcttttccaagaagtacataccacctcccaaggagaaaaggcctgaggggaggctgaaggaggctgtggaccagagtgatggcagccgccaagctcccaggactgagcccccatgtgtgggagctatggccaggactgagcttttggttcccctgcctgggccccgagagccaagtccccacccaggtgtaggtctcaccagtggtagctcccggagcctcgaggaataccgagtgacacgcactgtgcggaccaccacagtggtgggaggtcatgtggaccggcggatgagcagctctgtgactgtgaggccagtgtcctcaggcgaggccctgccacggggccgtcaggtctcccgcatggtgccgccagtggtggtgggctccccaccaggctcgcccagccgcagccaggccgtgaaagtgctaagtaacctcgtgcctgctgggcacagcccccctgccagtcacctgcccaggcccacggctggcgggccaaggagcacaggtctgggcagcacagtgggggcagccttgaggcagctgcctgagaccgggacagcagagcttaaagacagctctgccctggcctctacaggcatcccagccagtgctcacctgcctaagaatcaggatgcccctgcagcctgtccggacagagaccagggcagagccccggatgccagggcctgtgagctctggcaggtgctgggagcccccagttccactgagctccctctccagacttctcagggtcaagcatcagtcccctcctctcccagactcgagacccatgtcccctctcctggcctaactcaccctgcaaagcagcctgtggtgcccactcaccccggggcccggctcactccccttgttctgccccctaaaaaaaaggacgggcccgtggacccccctgctgccaccgtcctgcccatggtgaggagcgagcatgtgacagtccctggacaacctcctgctccatccactacaagaaggaaggatgtccccagcccaggaggtctttctgctccatcgtccccaaggaataagtttgttcagaactctgaaaatgtccctgtcctcccctttacccagagggaggtcgtgaagggc

SEQ ID NO: 103395 - DNA, 2523 bp, Homo sapiens
  Payload ID: 157
  Gene Symbol: AIM1L
  Gene Name: absent in melanoma 1-like
  ENST ID: ENST00000527815
  CDS Start-End: 51-2414
gggacctccaccctgccagacccacccaggtctcctgctctcctctggagatgatgaagaagcatgtagcaggaaccaagggcccccactcagagctgggattggaactgcagggaggcagcaggcccacttcccgtcttggaggcagccttctgttcggcagtctggtgcctaccgccaaggaggcctccaccccggaaccgctgggcacaaaactatctgctctgctgccccatggggcaccggggctcaggaaggtgccaggacagttgcccctgctttgcagtgaaagatcatccccaacggagaagcttgcctgttccctgcccctggaggggtggagcccagccttaaagacccagggcaagctgaacaccaggcctggaaaggtgatcttcttctcagagtctggctgccaaggcagtggcagggaggtctggggagacatcgttgatgcctcaggctgggcccccgtagcctccataagggtagttcgaggctgctgggtgctgtacgaagagccagagttccggggtcagaagctggtcctgcctgaaggagacatggaactcagaaccccagggacaaagtggagtccccaaggcatcggctccctaaggagggttgtctgggactacagcaccccggaaatcagcctcttctctgaggagggcctcaagggggagcaagtgaagctaacagaggccttgaagaattcccagggtctggagaagcccctgcaggtggcatctgccaccgtctctgcaggactgtggctactgtaccccaaaccattattcgaagacactccctacatcctggaacctggagagtaccccacctcagaggcctggggcacatcggaccccagcgtgggctccctgaagcccatgagattgggctgcccaagtgtggagaagccaggggagcccagggctgtggtgtatgaggccccaggctttcagggccgcagctgggaagtgagccgagacatctacaaccttcagcagccagaggacagccagagcccccacctggcctctgtggggtccctgagagttctcggaggctgctgggtgggctacgagaaggagggcttccggggccaccagtatctgctggaggagggggaatacccagactggtcacactggggaggctatgacgagttgctgacctccctccgggtcatccggacggacttcggggacccggccgtcgtgctatttgaggccatggacttcgaggggcacggcgtggaggtgagcaaggcattgccggatgtggagctggtgcaacacggccccagcacacaggccatccacgtgctcagcggcgtgtgggtggcctaccaggaggtgggcttctccggggaacagtacgtgctggagaagggcgtgtatcgtaactgcgaggactggggcgctggcaacagcaccctcgcctcgctgcagccggtcctacaggtcggggagcacgatctgcacttcgtctcaaagattcagcttttctcccgccccgactttctgggcgaccacttctctttcgaagatgaccaggccgctctgcccgcctccttccgacctcagtcctgccgggtccacggcggcagctggatcctgtttgatgagacgaacttcgagggtgaccagcacattctctctgagggcgagttccccactctcacggccatgggctgcctcgcctccacagtcctgggctctctccagaaggtatccctgcacttttcagagccttccattttcctgtatggactcgagtgcttcgaggggaaggagatcgagctcagcagggaggtgcggagcctgcaagccgagggcttcaacaaccatgtgctgtctgtgcggatcaaggggggcatttgggtgctatgtgaacacagtgacttccggggccgccagtggctggtgggaagctgcgagatcaccaactggctgacctacagcggcacccagagggtgggctccctctaccccatcaagcagcgccgggtttatttccgcctctggaatgcagcactggggggattcctggcagtgccggaccatgtggaggacatgaaagcaggccgtgtggtggtcgccgacccccaagctggaggtagctgcatctggtactacgaggatgggctgctgaagaaccagatggcccccaccatgagcctacaggtgattggaccccctagcccaggctccaaggtggtgctgtgggccgagagccgcctgccgcgccagacgtggagcatcagtgaatcgggccacatctgcagccagatgttcgaaggccagatcctggacgtgaagggaggccggggctacgaccgggaccacgtggtgctatgggagccggatgaggacagggcatcccagatctggactatccacgtgctttgaaacttttcccctcaccctccagccctggaggcttttgctgggatgaatgtttttatagggtttttgttgtaacataagctattttctaatatgctgccaggtacccttg

SEQ ID NO: 103396 - DNA, 594 bp, Homo sapiens
  Payload ID: 158
  Gene Symbol: AIM2
  Gene Name: absent in melanoma 2
  ENST ID: ENST00000368129
  CDS Start-End: 94-594
tgcacttgcactctaaggaagctgaggtgggggaggcgggaaagtccacagaggagtttaaagcagccatgccaaaagcctgaacagaaacagatggtggcccagcaggaatctatcagagaagggtttcagaagcgctgtttgccagttatggtactgaaagcaaagaagcccttcacgtttgagacccaagaaggcaagcaggagatgtttcatgctacagtggctacagaaaaggaattcttctttgtaaaagtttttaatacactgctgaaagataaattcattccaaagagaataattataatagcaagatattatcggcacagtggtttcttagaggtaaatagcgcctcacgtgtgttagatgctgaatctgaccaaaaggttaatgtcccgctgaacattatcagaaaagctggtgaaaccccgaagatcaacacgcttcaaactcagccccttggaacaattgtgaatggtttgtttgtagtccagaaggtaacagaaaagaagaaaaacatattatttgacctaagtgacaacactgggaaaatggaagtactgggggttagaaacgaggacacaatgaaatgt

SEQ ID NO: 103397 - DNA, 1529 bp, Homo sapiens
  Payload ID: 158
  Gene Symbol: AIM2
  Gene Name: absent in melanoma 2
  Uniprot ID: O14862
  ENST ID: ENST00000368130
  CDS Start-End: 290-1321
atagacattttcttctgtggctgctagtgagaacccaaaccagctcagccaattagagctccagttgtcactcctacccacactgggcctgggggtgaagggaagtgtttattaggggtacatgtgaagccgtccagaagtgtcagagtctttgtagctttgaaagtcacctaggttatttgggcatgctctcctgagtcctctgctagttaagctctctgaaaagaaggtggcagacccggtttgctgatcgccccagggatcaggaggctgatcccaaagttgtcagatggagagtaaatacaaggagatactcttgctaacaggcctggataacatcactgatgaggaactggataggtttaagttctttctttcagacgagtttaatattgccacaggcaaactacatactgcaaacagaatacaagtagctaccttgatgattcaaaatgctggggcggtgtctgcagtgatgaagaccattcgtatttttcagaagttgaattatatgcttttggcaaaacgtcttcaggaggagaaggagaaagttgataagcaatacaaatcggtaacaaaaccaaagccactaagtcaagctgaaatgagtcctgctgcatctgcagccatcagaaatgatgtcgcaaagcaacgtgctgcaccaaaagtctctcctcatgttaagcctgaacagaaacagatggtggcccagcaggaatctatcagagaagggtttcagaagcgctgtttgccagttatggtactgaaagcaaagaagcccttcacgtttgagacccaagaaggcaagcaggagatgtttcatgctacagtggctacagaaaaggaattcttctttgtaaaagtttttaatacactgctgaaagataaattcattccaaagagaataattataatagcaagatattatcggcacagtggtttcttagaggtaaatagcgcctcacgtgtgttagatgctgaatctgaccaaaaggttaatgtcccgctgaacattatcagaaaagctggtgaaaccccgaagatcaacacgcttcaaactcagccccttggaacaattgtgaatggtttgtttgtagtccagaaggtaacagaaaagaagaaaaacatattatttgacctaagtgacaacactgggaaaatggaagtactgggggttagaaacgaggacacaatgaaatgtaaggaaggagataaggttcgacttacattcttcacactgtcaaaaaatggagaaaaactacagctgacatctggagttcatagcaccataaaggttattaaggccaaaaaaaaaacatagagaagtaaaaaggaccaattcaagccaactggtctaagcagcatttaattgaagaatatgtgatacagcctcttcaatcagattgtaagttacctgaaagctgcagttcacaggctcctctctccaccaaattaggatagaataattgctggataaacaaattcagaatatcaacagatgatcacaataaacatctgtttctcattca

SEQ ID NO: 103398 - DNA, 1481 bp, Homo sapiens
  Payload ID: 158
  Gene Symbol: AIM2
  Gene Name: absent in melanoma 2
  ENST ID: ENST00000612470
  CDS Start-End: 244-1311
agccaattagagctccagttgtcactcctacccacactgggcctgggggtgaagggaagtgtttattaggggtacatgtgaagccgtccagaagtgtcagagtctttgtagctttgaaagtcacctaggttatttgggcatgctctcctgagtcctctgctagttaagctctctgaaaagaaggtggcagacccggtttgctgatcgccccagggatcaggaggctgatcccaaagttgtcagatggagagtaaatacaaggagatactcttgctaacaggcctggataacatcactgatgaggaactggataggtttaagttctttctttcagacgagtttaatattgccacaggcaaactacatactgcaaacagaatacaagtagctaccttgatgattcaaaatgctggggcggtgtctgcagtgatgaagaccattcgtatttttcagaagttgaattatatgcttttggcaaaacgtcttcaggaggagaaggagaaagttgataagcaatacaaatcggtaacaaaaccaaagccactaagtcaagctgaaatgagtcctgctgcatctgcagccatcagaaatgatgtcgcaaagcaacgtgctgcaccaaaagtctctcctcatgttaagcctgaacagaaacagatggtggcccagcaggaatctatcagagaagggtttcagaagcgctgtttgccagttatggtactgaaagcaaagaagcccttcacgtttgagacccaagaaggcaagcaggagatgtttcatgctacagtggctacagaaaaggaattcttctttgtaaaagtttttaatacactgctgaaagataaattcattccaaagagaataattataatagcaagatattatcggcacagtggtttcttagaggtaaatagcgcctcacgtgtgttagatgctgaatctgaccaaaaggttaatgtcccgctgaacattatcagaaaagctggtgaaaccccgaagatcaacacgcttcaaactcagccccttggaacaattgtgaatggtttgtttgtagtccagaaggtaacagaaaagaagaaaaacatattatttgacctaagtgacaacactgggaaaatggaagtactgggggttagaaacgaggacacaatgaaatgtaaggaaggagataaggttcgacttacattcttcacactgtcaaaaaatggagaaaaactacagctgacatctggagttcatagcaccataaaggttattaaggccaaaaaaaaacatagagaagtaaaaaggaccaattcaagccaactggtctaagcagcatttaattgaagaatatgtgatacagcctcttcaatcagattgtaagttacctgaaagctgcagttcacaggctcctctctccaccaaattaggatagaataattgctggataaacaaattcagaatatcaacagatgatcacaataaacatctgtttctcattc

SEQ ID NO: 103399 - DNA, 1515 bp, Homo sapiens
  Payload ID: 159
  Gene Symbol:
  Gene Name: AC002310.11
  ENST ID: ENST00000569360
  CDS Start-End: 174-1166
tttgaagacatcgtccagttctgaccatggactcgcagccatcggcccttagtttccatcccctctagtgggccttcgggggctctactgacgtccctccttcccttggtaccgggccggggaagtgttctcgggcgcgggaggttccgcatgcccaggcctggccaggggagatgaccgatccgtcgctggggctgacagtccccatggcgccgcctctggccccgctccctccccgggacccaaacggggcgggatccgagtggagaaagcccggggccgtgagcttcgccgacgtggccgtgtacttctcccgggaggagtggggctgcctgcggcccgcgcagagggccctgtaccgggacgtgatgcgggagacctacggccacctgggcgcgctcggagtcggaggcagcaagccggcgctcatctcctgggtggaggagaaggccgaactgtgggatccggctgcccaggatccggaggtggcgaagtgtccgacagaagcggacccagattccagaaacaaggaagaggaaagacaaagggaagggacgggagccctggagaagcccgaccctgtggccgccgggtctcctgggctgaaggctccccaagccccctttgccgggttggagcagctgtccaaggcccggcgccggagtcgcccccgcttttttgcccacccccctgtcccccgagctgaccagcgtcacggctgctacgtgtgcgggaagagcttcgcctggcgctccacactggtggagcacatttacagccacaggggcgagaagcccttccactgcgcagactgcggcaagggcttcggccacgcttcctccctgagcaaacaccgggccatccatcgtggggagcggccccaccgctgtcccgagtgtggtcgggccttcatgcgccgcacggcgctgacttctcacctgcgcgttcacactggcgagaagccctaccgctgcccgcagtgtggccgctgcttcggcctgaagaccggcatggccaagcaccaatgggtccatcggcccgggggcgaggggcgtaggggccggcgccctggggggctgtctgtgaccctgactcctgtccgcggggacctggacccgcctgtgggcttccagctgtatccagagatattccaggaatgtgggtgacggcctaaaaagtgaccatctagacattgtgggcggcccgagatgggctcaggggcccgaacctctgcagcggcctgcagggaggtcccagaatccaccgcaagagctggcctggggtgcggacagtctgatcttgggctctcagcagcctcttctgccagcaccttgctccccgctgccctgggctctccaaggccccctttgctgaggcagggctgaggcaacatgagtgagaatgaggaagaggaaatttctcagcaagaaggcagtggggactatgaagtcgaagagataccatttgggcttgaaccccagagccctgggtttgagccacaaagcccagagtttg

SEQ ID NO: 103400 - DNA, 377 bp, Homo sapiens
  Payload ID: 160
  Gene Symbol:
  Gene Name: AC002310.13
  ENST ID: ENST00000568114
  CDS Start-End: 98-377
gcccgggccggggaggctttctcgggcgcaggaggttccgcaggcccaggccaggccaggggaggcagccgatccgtcgtcggggttgacagttaccatggcgccgcctctggccccgctccctccccgggacccaaacggggccggacccgagtggagggagccgggggctgtgagcttcgcggacgtggccgtgtacttctgccgggaggagtggggctgcttgcggccagcgcagagggccctgtaccgggacgtgatgcgggagacctacggccacctgagcgctctcggagtcggaggcagcaagccggcgctcatctcctgggtggaggagaaggccgaactgtgggatccggctgcccaggatccggagg

SEQ ID NO: 103401 - DNA, 1037 bp, Homo sapiens
  Payload ID: 161
  Gene Symbol:
  Gene Name: AC002398.9
  ENST ID: ENST00000591613
  CDS Start-End: 120-287
gccggaggaagtgagctctcctggggcgtggttgttcgtgatccttgcatctgttacttagggtcaaggcttgggtcttgccccgcagacccttgggacgacccggccccagcgcagctatgaacctggagcgagtgtccaatgaggagaaattgaacctgtgccggaagtactacctgggggggtttgctttcctgccttttctctggttggtcaacatcttctggttcttccgagaggccttccttgtcccagcctacacagaacagagccaaatcaaaggctagctggagatggccaaagcccggaaccaactggatgctgtcttgcagtgtctgctggagaagagtcacatggacagggagcgtctggatgaggaagctgggaaaacaccctcagacacccacaataaggactgctccatcgcagccactggcaaaaggccatctgcccgcttcccccaccagcggaggaagaagaggagggagatggatgatgggctggctgagggagggccgcagcgatccaacacatatgtgatcaagctgttcgaccggagcgtggacttggcccagttcagcgagaacacgccactgtacccaatctgccgcgcctggatgcgcaacagcccctctgtgcgcgagcgtgaatgctctcccagctcacccctgcccccgctgcctgaggatgaggagggctcagaggtaaccaacagcaagagtcgtgatgtgtacaagctgccgccacccacacccccggggccacccggagatgcctgcagatcccgcatcccatctccactgcagcctgagatgcagggcacccctgacgatgagccctctgagcccgagccctcaccctccacactcatctatcgcaacatgcagcgctggaaacgcatccgccagaggtggaaggaggcctctcatcggaaccagcttcgttactcagaaagcatgaagatcctacgagagatgtacgaacgacagtgatgttcccaggtccccccacaccagtaaacatcccccagctccaca

SEQ ID NO: 103402 - DNA, 685 bp, Homo sapiens
  Payload ID: 162
  Gene Symbol:
  Gene Name: AC002985.3
  ENST ID: ENST00000596918
  CDS Start-End: 1-254
tccaggaagtgaaggaagcagccaggctggccagggagaaatctcaggatggcggggagctcaccagtccagccctggggctcgcctcccaccaggtgcccccgagccctctcgtcagtgccaacggccccggcgaggaaaaactgttccgcagccagagcgctgatgcccccggccccacagagcgcgagcggctaaagaagatgttgtctgaggggtggctgagctggaggctcaggcagcttcagaggtgacccccaccggtgagaaggaggggctgggccagggccagtcgctggaacagctggaagctctggtgcaaaccaaggaccaggagattcagaccctgaagagtcagactggggggccccgcgaggccctggaggctgccgagcgtgaggagactcagcagaaggtgcagctatcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggagggacagcatcgtggccgagctggaccgagagatgagcaggagcgtggacgtgaccaacaccaccttcctgctcatggccgcctccatctatctccacgac

SEQ ID NO: 103403 - DNA, 584 bp, Homo sapiens
  Payload ID: 162
  Gene Symbol:
  Gene Name: AC002985.3
  ENST ID: ENST00000593484
  CDS Start-End: 1-254
tccaggaagtgaaggaagcagccaggctggccagggagaaatctcaggatggcggggagctcaccagtccagccctggggctcgcctcccaccaggtgcccccgagccctctcgtcagtgccaacggccccggcgaggaaaaactgttccgcagccagagcgctgatgcccccggccccacagagcgcgagcggctaaagaagatgttgtctgaggggtggctgagctggaggctcaggcagcttcagaggtgacccccaccggtgagaaggaggggctgggccagggccagtcgctggaacagctggaagctctggtgcaaaccaaggaccaggagattcagaccctgaagagtcagactggggggccccgcgaggccctggaggctgccgagcgtgaggagactcagcagaaggtgcagctatcaagcccagagagagacgtggagagggacgtcttcctgtatagagcgtacctggcgcagggacagcatcgtggccgagctggaccgagagatgagcaggagcgtggacgtgaccaacaccaccttcctgctcatggccgcctccatctatctccacgac

SEQ ID NO: 103404 - DNA, 456 bp, Homo sapiens
  Payload ID: 163
  Gene Symbol:
  Gene Name: AC003002.4
  ENST ID: ENST00000597658
  CDS Start-End: 151-456
agtgacacaggcacaactgacagtggcagaagctcagctgacaaggactggggacggcggtgtccttgtcttgcctttgtcgcccccgcccctctcttccctggctggacttgcggagtccccgccgaagaacccgagggtcccctggcgatggcagaaatgaaccctgcacagggtcatgtggtttttgaagacgtggccatatatttctcccaggaggagtgggggcatctcgatgaggctcagagattgctgtaccgtgatgtgatgctggagaatttggcccttttgtcctcactaggttcttggcatggagctgaggatgaggaggcaccttcacagcaaggtttttctgtaggagtgtcagaggttacagcttcaaagccctgtctgtccagccagaaggtccaccctagtgagacatgtggcccacccttgaaagacattctgtgcctg

SEQ ID NO: 103405 - DNA, 536 bp, Homo sapiens
  Payload ID: 164
  Gene Symbol:
  Gene Name: AC003002.6
  ENST ID: ENST00000596617
  CDS Start-End: 217-536
gttttggttctgtgtggtgtttcaccaacttcggcctatggctctgtctgacgtcaccgaagtgacggaacggaaaagcgcgagaagcggctcggttcccaccacggagaggcgggagtgagtcaactgacaagcgctggggacagtggcgtccttgtcttgcctttgtcgctcccgccccgctcttccctggctgggctggcggaggccttgctgatgaacctgactgagggtcccctggcgatggcagaaatggaccctacacagggccgtgtggtctttgaggacgtggccatatatttctcccaggaggagtgggggcaccttgatgaggctcagagattgctgtaccgtgatgtgatgctggagaatttggcccttttgtcctcactagggttcatagcagtggcagcaatgcttatggatgctggacaggattatatggtttttgaggacgtggccatacatttctcccaggaggagtggggaattcttaatgacgttcagagacacctgcacagcgatgtgatgctgga

SEQ ID NO: 103406 - DNA, 630 bp, Homo sapiens
  Payload ID: 164
  Gene Symbol:
  Gene Name: AC003002.6
  ENST ID: ENST00000596400
  CDS Start-End: 93-630
aactgacaagcgctggggacagtggcgtccttgtcttgcctttgtcgctcccgccccgctcttccctggctgggctggcggaggccttgctgatgaacctgactgagggtcccctggcgatggcagaaatggaccctacacaggattatatggtttttgaggacgtggccatacatttctcccaggaggagtggggaattcttaatgacgttcagagacacctgcacagcgatgtgatgctggagaactttgcacttttgtcctcagtaggttgttggcatggagccaaggatgaggaggcaccttccaagcaatgtgtttctgtaggagtgtcacaggtcacaactttaaagccagctttgtccacccagaaggcccagccctgtgagacatgtagctcacttctgaaggacattctacacctggctgagcatgacggaacacaccccaagcgtacagccaagctttacctgcaccaaaaggagcatcttagagagaagctcaccagaagtgatgaagggaggccttcgtttgtgaatgacagtgttcacctggcaaagaggaacctcacatgcatgcagggtggcaaggattttactggtgattcagatcttcaacaacaggctcttc

SEQ ID NO: 103407 - DNA, 582 bp, Homo sapiens
  Payload ID: 165
  Gene Symbol:
  Gene Name: AC003005.4
  ENST ID: ENST00000601674
  CDS Start-End: 234-413
acgcaatgggcgggacttccggcgtctcgtttggtattcactttcgcgactcaggtgaactaacctgcgagaagctggttgtgcgctgaggcgaccagcgccggaaggcacggtggcgactcacgctgttctcgccgctcagaggcgggtctgaggctcggtggcggcgcccagggtggcccgggccctttcctcggtcattgtctcccctccagctctactcacaggctccgatggcggcggccgccctgagggaccccgctcagggctatgtgacctttgaggatgtggctgtctacttctcccaggaggaatggagattgcttgatgacgctcagaggctcctctaccgcaatgtgatgctggagaactttacacttctggcctctctggcagggctatgtgacctttgaggacgtggctgtctacttctcccaggaggaatggagattgcttgatgacgctcagaggctcctctaccgcaatgtgatgctggagaactttacacttctggcctctctgggacttgcatcttccaagacccatgaaataacccagctggagtcatgggaggagcccttc

SEQ ID NO: 103408 - DNA, 565 bp, Homo sapiens
  Payload ID: 165
  Gene Symbol:
  Gene Name: AC003005.4
  ENST ID: ENST00000599674
  CDS Start-End: 199-375
attcactttcgcgactcaggtgaactaacctgcgagaagctggttgtgcgctgaggcgaccagcgccggaaggcacggtggcgactcacgctgttctcgccgctcagaggcgggtctgaggctcggtggcggcgcccagggtggcccgggccctttcctcggtcattgtctcccctccagctctactcacaggctccgatggcggcggccgccctgagggaccccgctcagggctatgtgacctttgaggatgtggctgtctacttctcccaggaggaatggagattgcttgatgacgctcagaggctcctctaccgcaatgtgatgctggagaactttacacttctggcctctctggggctatgtgacctttgaggacgtggctgtctacttctcccaggaggaatggagattgcttgatgacgctcagaggctcctctaccgcaatgtgatgctggagaactttacacttctggcctctctgggacttgcatcttccaagacccatgaaataacccagctggagtcatgggaggagcccttcatgcctgcttgggaagttgtg

SEQ ID NO: 103409 - DNA, 612 bp, Homo sapiens
  Payload ID: 166
  Gene Symbol:
  Gene Name: AC003006.7
  ENST ID: ENST00000594684
  CDS Start-End: 168-612
ctgcagtggaggtcgcgactgagggacgggacagagaagtcgcgaaagtgggccagaggttctgcgacaccacctcgggtgagctgcgccaggcccgggatagggactgttgtgttcgaatgcccgccccggtcggccgccgctccccgcctagtccacggagctcaatggcggcagtcgcgctgagggactcggctcagggcactgtgacctttgaagatgtggctgtgaacttttcccaggaggaatggagtctccttagtgaggctcagagatgcctttatcatgacgtgatgctggagaacctgacacttatatcttctctaggttgttggtatggagcaaaagacgagacaccttctaagcagaccctttctatacaacaggagtccccactcaggacacattggacaggtgtatgtaccaagaaggtccacctctggggaatgtgtggccctctcctgggagatatcttacaccagggaacacaacacaatcagaaattgaatgggtttggggcatatgaaaaaaaattggatgacgatgcaaaccatcatcaagaccagaagcagcacattggagagaaatcgtacagaagcaatgccaagggaa

SEQ ID NO: 103410 - DNA, 521 bp, Homo sapiens
  Payload ID: 167
  Gene Symbol:
  Gene Name: AC004076.7
  ENST ID: ENST00000597410
  CDS Start-End: 1-218
ctcagggtcccctggcgatggcagaaatggaccctacacagagacaggatctcactctgtcccctaagctggagtacagtggcatgatcatagctcactgccacctggaacccctgggctcaagtgatcctcctgcctcagcctctcaagtagctgggactacaggccgaaagaatgagggtcgtgatcaactcagtatgccactggaggctatatgagtaaacagcaaactgtttctcatgaaagcaggatgttggcaaactgacaaactgcgtctgccacccagaaggaatgctgaaggcagtcacgacccaggcacaagtgtttcttgtgattaggcataattgaagcctgttaacaataatgtgaacttgtgatcaattaagcagctgaccagtcgttacctcctcctccctttcatcctacccaataaatgtggagggctgtggaagctcaggggctgcctttgctcactagaagcagggagctctcttcttccccagttcgccttctttaaaaca

SEQ ID NO: 103411 - DNA, 664 bp, Homo sapiens
  Payload ID: 168
  Gene Symbol:
  Gene Name: AC004076.9
  ENST ID: ENST00000596831
  CDS Start-End: 195-593
gtttccagaacgcaatgtcagacctgaggtgacagaaaagggaaaacgtgagagagtgtcttcttccctgaagagaggtgggcctgaggcttgacagtggcgctgcctgagtgacctagccgctgggctgggccctggacagctgatcccaggttcctgcacttgtcgccacccttccgtagtccacaggcctgatggcggcggctgagccgatgggcccggcacaggttcccatgaactcagaagtaattgtggaccctatacaggggcaggtgaactttgaggacgtgttcgtgtacttctcccaggaggagtgggtgctccttgatgaggctcagaggctcctgtaccgtgatgtgatgctggagaactttgcacttatggcctctctggggatacctcagacaatggcagcttttggattgaaatatttgctgaatgacactggatacacaagcagcaagtccaacacaatcacagcaacagactctcctgcagaccttcccaggaagccagagccacacacaccatcatggtcctggaagaagcaagccatgagtatcaggacagtactgtggcatcctacaggctgagctgtacaaccatctctgccctgtactggagcaaagtaatctgaagctacagcaagtcctaagttcagtgc

SEQ ID NO: 103412 - DNA, 375 bp, Homo sapiens
  Payload ID: 169
  Gene Symbol:
  Gene Name: AC004158.1
  ENST ID: ENST00000623725
  CDS Start-End: 1-375
atgactcttaacgagcatgctgccttcaagcatctgtttaacaaagcacatcttgcacctcccttaatccatttaaccctgagtggacacagcacatgtttcagagagcacagggttggggataaggtcacagatcaacaggatcccaaggcagaagaatttttcttagtacagaacaaaatgaaaagtctcccatgtctacttctatccacacagacccggcaaccatccgatttctcaattttttccccacccttcccgcctttctattccacaaaaccgccattgtcatcatggcccatccccaatgagccgctgggcacgcctcccagacggggtcgtggccgggcagaggggctcctcacttcccagtag

SEQ ID NO: 103413 - DNA, 1732 bp, Homo sapiens
  Payload ID: 170
  Gene Symbol:
  Gene Name: AC004231.7
  ENST ID: ENST00000576522
  CDS Start-End: 158-1342
aaaattagctgaagcattaggaaaggaaactatgctgtatgccaagcccccacccacaattaatggtataaaaggactgcagaggaaggagagactcaaacctgcccacatccacctccagcagcttacctgcttttccattacctgttccagcaccatgtcttacagttgttgcctgcccagcctgggctgccgcaccagctgctcctcccggccctgcgtgccccccagctgccacggctacaccctgcctggggcctgcaacatccccgccaatgtgagcaactgcaactggttctgtgagggctccttcaatggcagcgagaaggagactatgcagttcctgaacgaccgcctggccagctacctggagaaggtgcgtcagctggagcgggacaacgcggagctggagaaactcatccaggagcggtcccagcagcaggagcccttgctgtgccccagctaccagtcgtacttcaagaccattgaggagctccagcagaagattctgtgtgccaaggctgagaatgccaggctggtggtgaacattgacaatgccaagctggcctctgacgacttcagaagcaagtaccagacggagcagtccctgaggctgttggtggagtcggacatcaacagcatacgcaggatcctggatgagctgaccctctgcaagtctgacctggagtcccaggtggagtccctgagggaggagctgatctgcttgaagaagaaccatgaggaggaggttaacaccctgcgctcccagcttggagaccgcctcaacgtggaggtggacactgcccccactgtggacctgaaccaggtcctgaacgagaccaggagtcagtatgaggctctggtggaaactaaccgcagggaagtggagcaatggttcgccacgcagaccgaggagctgaacaagcaggtggtatccagctcagagcagctgcagtcctgccaggcggagatcatcgagctgagacgcacagtcaacgccctggagatcgagctgcaggcccagcacaacctgcgagactctctggaaaacacgctgacggagagcgaggcccactacagctcccagctgtcccaggtgcagagcctgatcaccaacgtggagtctcagctggcagagatccgctgtgacctggagcggcagaaccaggagtaccaggtgctgctggacgtgcgtgcccggctggagtgtgagatcaacacgtaccggagcctcctggagagtgaggactgcaagctcccctgcaacccatgcgccaccaccaatgctagtggcaactcctgtggaccctgtggcacctctcaaaagggttgctgtaattgaaaagcttgtatcctctttgaagacatctacaaagccatttagatcaaccacaggaaggatcctcaagtcctgacttttctggagctcagctgacatcaagaaacctcatcttgcctctatgttatttctagaatgctgaaaagctttcctgacccaagcaaagacacacatcatcaacttccaatgtctggacaactccttcctgttgagggtcgagcctgtttgtttctaaagatgttcagctccctgtaatctgagctccagttactacttaaggtgtttcctgaacgtactactgcatttcctgttttccttttttctttggcattctctggaatgcaaggaggagacttcatttacttcccaataaacttcatttctctggcataa

SEQ ID NO: 103414 - DNA, 740 bp, Homo sapiens
  Payload ID: 171
  Gene Symbol:
  Gene Name: AC004556.1
  ENST ID: ENST00000612848
  CDS Start-End: 92-553
aagcgagggggcgctgtgccaggcggcggccgtgcggggcgggcgcgctgctccttccgcctcgcggaccccggaagcgcgcgtggccgccatggcgcggaatgtggtgtaccccctgtaccggctgggtggcccacaacttcgggtgttccgaaccaacttcttcattcagctggtgcggcccggtgtggcccagcccgaggacaccgtgcagttccggatccccatggaaatgacaagggtggacctcaggaattacctcgagggcatctataacgtgcccgtggctgctgtgcggacacgggtgcagcatggctctaacaagagaagagatcacagaaacgtgaggatcaagaagccggactacaaggtcgcctacgtgcagctggcccatggacagaccttcacgttcccagatctgtttcccgagaaagacgagagccctgaaggcagcactgccgacgacctctacagcatgctcgaggaggagaggcagcagaggcagagcagcgacccgcggcggggcggcgtccccagctggttcgggctgtgacggggtggccagcagggacgcgccccaggtgggcagctgtggcagagcagcgacccgcggcggggcggcatccccagctggttcgggccgtgacggggcggccagcagggacgcgccccaggtgggcagctgtggcagagcagtcccgacacctaaataaaagtcttgctgcaggagaaagagccgg

SEQ ID NO: 103415 - DNA, 2242 bp, Homo sapiens
  Payload ID: 172
  Gene Symbol:
  Gene Name: AC004754.3
  ENST ID: ENST00000600536
  CDS Start-End: 142-1737
aggtccacctgggcttgcgaaggcacagattccccgtccacagctcacgaccagatgcaccagcaggagtccacatcgaggacgtcctccgggcactcccacgaccagtgaccaggagttaaactttgggatgtgcccgtgatgttggaccacaaggacttagaggccgaaatccaccccttgaaaaatgaagaaagaaaatcgcaggaaaatctgggaaatccatcaaaaaatgaggataacgtgaaaagcgcgcctccacagtcccggctctcccggtgccgagcggcggcgttttttctttcattgtttctctgcctttttgtggtgttcgtcgtctcattcgtcatcccgtgtccagaccggccggcgtcacagcgaatgtggaggatagactacagtgccgctgttatctatgactttctggctgtggatgatataaacggggacaggatccaagatgttctttttctttataaaaacaccaacagcagcaacaatttcagccgatcctgtgtggacgaaggcttttcctctccctgcacctttgcagctgctgtgtcgggggccaacggcagcacgctctgggagagacctgtggcccaagacgtggccctcgtggagtgtgctgtgccccagccaagaggcagtgaggcaccttctgcctgcatcctggtgggcagacccagttctttcattgcagtcaacttgttcacaggggaaaccctgtggaaccacagcagcagcttcagcgggaatgcgtccatcctgagccctctgctgcaggtgcctgatgtggacggcgatggggccccagacctgctggttctcacccaggagcgggaggaggttagtggccacctctactccggcagcaccgggcaccagattggcctcagaggcagccttggtgtggacggggaaagtggcttcctccttcacgtcaccaggacaggtgcccactacatcctctttccctgcgcaagctccctctgcggctgctctgtgaagggtctctacgagaaggtgaccgggagcggcggcccgttcaagagtgacccgcactgggagagcatgctcaatgccaccacccgcaggatgctttcccacagctctggagcagtgcgctacctgatgcatgtcccagggaacgccggtgcagatgtgcttcttgtgggctcagaggccttcgtgctgctggacgggcaggagctgacgcctcgctggacacccaaggcagcccatgtcctgagaaaacccatcttcggccgctacaaaccagacaccttggctgtagccgttgaaaacggaactggcaccgacagacagatcctgtttctggaccttggcactggagccgtcctgtgtagcctagccctcccgagcctccctgggggtccactgtccgccagcctgccgaccgcagaccaccgctcagccttcttcttctggggcctccacgagctggggagcaccagcgagacggagaccggggaggcccggcacagcctgtacatgttccaccccaccctgccgcgcgtgctgctggagctggccaatgtctctacccacattgtcgcctttgacggctcacactgggcgacagcggagaggctcttggacggggcagagctcgcgccgagacctgcatgtccgcgtcttgtgacgggtgtgtgggaagccgcccgcctgtgcatcttgcttccgggtattcgctggctgatttactggttttagagatggggatgggcacccagtgctggactgaagaccagagaaggtggagctccctgtggccttggtctcacctctcttcagcgggatcccagcctctgccaggagggccttgtacatgtcagacttcaggaaccttgggtaggagtcctacaagagacagcgtccagcccctgacccttctgcctcctcacctctcagccagctccacccgaaggagcagccaaacattgctggagcctcctccagccacagagtctccggcggacagggtgctggaggcagccgcctcggacctgcccagaccaaggcagacgcagggagacctgggctcccgtctgcctgggccatgtcgcagcaaaaaatggcaagagccctggtggccacgtgtagaggaataaaccgcggcacctcctcagccattagcgggaaccaggaatggctccgtgtgccccacagagtgagggcagggttgtggagtcaaataaaaaaacaaggtaggccacgc

SEQ ID NO: 103416 - DNA, 375 bp, Homo sapiens
  Payload ID: 173
  Gene Symbol:
  Gene Name: AC004813.1
  ENST ID: ENST00000625200
  CDS Start-End: 1-375
atgactcttaaggagcatgctgccttcaagcatctgtttaacaaagcacatcttgcaccgcccttaatccatttaaccctgagtggacacagcacatgtttcagagagcacagggttggggataaggtcacagatcaacaggatcccaaggcagaggaatttttcttagtgcagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctactcacttcccagtag

SEQ ID NO: 103417 - DNA, 189 bp, Homo sapiens
  Payload ID: 174
  Gene Symbol:
  Gene Name: AC004824.2
  ENST ID: ENST00000624583
  CDS Start-End: 1-189
acaggcgctcgccactacgcccagctaatttttgtatttttaatagagatggggtttcaccgtgttggccaggctggtctcaaactcctgacctcaggtgatccacccgcctcggcctcccaaagtgctgggattacaggtgtgagccactgtgcccggccaggccaatttattatattaagatatctt

SEQ ID NO: 103418 - DNA, 189 bp, Homo sapiens; identical to SEQ ID NO: 103417
  Payload ID: 175
  Gene Symbol:
  Gene Name: AC004824.3
  ENST ID: ENST00000627865
  CDS Start-End: 1-189

SEQ ID NO: 103419 - DNA, 954 bp, Homo sapiens
  Payload ID: 176
  Gene Symbol:
  Gene Name: AC004853.1
  ENST ID: ENST00000623829
  CDS Start-End: 1-954
atgggaacagataaccagacttgggtgagtgaatttattctcctcggcctgtccagtgactgggacactcgggtctccctgtttgtcctgttcttggtcatgtatgtggtgaccgtgctggggaactgtctcattgtccttctgatcagactggacagccgactccacactcccatgtatttctttctcaccaacctctcccttgtcgatgtctcctatgccacaagtgtagtccctcagctgctggcacattttcttgcagaacataaagccatcccattccagagctgtgcagcccagttatttttctccctggccttgggtgggattgagtttgttctcctggcggtgatggcctatgaccgctatgtggctgtgtgtgatgccctgcgatactcggccatcatgcatggagggctgtgtgctaggttggccatcacatcctgggtcagtggcttcatcagctctcctgtgcagactgctatcacctttcagctgcccatgtgcagaaacaagtttattgatcacatatcctgtgaactcctagctgtggtcaggctggcttgtgtggacacctcctccaatgaggtcaccatcatggtgtctagcattgttcttctgatgacacccttctgcctggttcttttgtcctacatccagatcatctccaccatcctaaagatccagtccagagaaggaagaaagaaagctttccacacgtgtgcctctcacctcacagtggttgccctgtgctatggtgtggccattttcacttacatccagccccactccagtccctctgtccttcaggagaagttgttctctgtcttttatgccattttaacaccaatgctgaaccccatgatttacagcctaaggaataaagaggtgaagggggcctggcagaaactattatggaaattctctgggttaacatcaaagctggcaacttga

SEQ ID NO: 103420 - DNA, 273 bp, Homo sapiens
  Payload ID: 177
  Gene Symbol:
  Gene Name: AC004953.1
  ENST ID: ENST00000624170
  CDS Start-End: 1-273
atgttgctcaggctaacctcaaactcctgggctcaaacgatcctcccgcctcagcctcccaaagtgctgggattacaggttccaggaaactcatgggacaggggtgaggggagtgtaggagctcaggtacggaggatggtggacagtagggatcagcagagcttctcggacctcaatgctctgtcgcccaggctggagtgcagtggcatgatctcagctcactgcaacctctgcctccagggttcaagcgattctcttgtctcagcctcccaa

SEQ ID NO: 103421 - DNA, 39 bp, Homo sapiens
  Payload ID: 178
  Gene Symbol:
  Gene Name: AC005042.1
  ENST ID: ENST00000626331
  CDS Start-End: 1-39
ctgcctccaccttcacagagccttctcgttgaggaaggg

SEQ ID NO: 103422 - DNA, 1594 bp, Homo sapiens
  Payload ID: 179
  Gene Symbol:
  Gene Name: AC005477.1
  ENST ID: ENST00000624897
  CDS Start-End: 10-258
agagtctaaatgttaatttccaaaatagatgtgcaagtagagtgttacataatttcagaggaggaggccagttctcccagcctcagaggtgagaatgggcttgtggaagagtggtctttgaactcagttttaaaatatgtgcaggattgctttatgtggaaagcagagaggaagaacataccaggtgatgagatgtttcagcaagggcacagagctgaggaaagtaacagcaaccggaactggttagcttggacataggatgcattacaaggagtaaatggagataggattttgggaagagaggctggctggagccagatgttagtgttgaattagacaatttaatcaagaaaaacttctgtgccaagagttgcaagattgagatctctttgggattatgactgttgccccattgtgctgaatggattgttatcaagatagagcggaggctctaggagagagatttctgtgtctgtgtgaaaggtaaggagggaaaggagagacactaatccagcctgtgaaatcaccttcagaattaagagaaactgataagaggaattaaagtctggattaaaaatgacttggaaactgaaggaatataggcggcaagtagagggtcaaagatgacggggtttttgacgttgggtaaatgaaaatcattggtgctattaattcaaattgggatatttggaaaaagaatacattttaaaggaagaaaatggcacataagtttattttagtacatgctgaatttgacataattgcttcttattgtacacctttttgatgtttgcatgtttgtgaaaatttaaactaactctcttgtatgttaataaggaaataagttaatgttcatttcactaactacttgagtttctactcagttctgtgcattctgagaggctctgtgtattacttatatgggcaatgtggaactagatattcctggatgatcaatatggtgaatttttctcttttccttgtaaaaatagagttctcaaattattctggctttgagtgtaagattctgtaattctttgctttgcaagagaatgtctagataacccatctctaagaatcatgcttattaaattgcgataaagaaaaaaataggttaatgggactcagcaattagtgaaacatacagaataatagacattgagtcattgttactttcttaacccacccccaaactgggagaccccgtgccaggctggtaggaacatgggctttggagtgagacttaggttaaaatgccaactttaccactctttagcagtatgactgtaagttagttctttaacttccatgagccacaattttttcatctgtaaaaagaaaaaaaaatgtgggaggaaggtaattgtgaagatcactttagataaatcgaatgaggcatcttatatcctacttagaccacaatgtggtccgtaatgaatatctctttttcttttcatgtttaggtcttgtagagtcagtgacacttggagaggaaataaatgataaaatctctaaatgttggtgctgttaataagttgtctagagcaaatttatacagtgagtttttttttaagacacaggaaaacaataaaaa

SEQ ID NO: 103423 - DNA, 409 bp, Homo sapiens
  Payload ID: 180
  Gene Symbol:
  Gene Name: AC005480.1
  ENST ID: ENST00000624550
  CDS Start-End: 28-105
cgccattttcttggaaacctctgcatcatgagagctaagtggaggaaaaagcgaatgtgcagtctgaagcacaaaagaagaaagatgaggcagaggtccaagtaaaccgctagcttgttgcaccgtggaggccacacaggagcagaaacatggaatgccagatgctggggatgctggtacaagttgtgggactgcatgctattgtgtagagcttgtctcaatggatccagaacttcaccgccctctgatcgctgatcacctctgagacccaccttgctcataaccaaaactgcccatgttggtcctctgccctggacctgggacattctggactatttctgtgtttacttgtggccgagtataacaaccatacgataaatcatctcttctgctgtcttagctgaagaat

SEQ ID NO: 103424 - DNA, 550 bp, Homo sapiens
  Payload ID: 181
  Gene Symbol:
  Gene Name: AC005779.2
  ENST ID: ENST00000593083
  CDS Start-End: 1-84
atcgtggctggctgccgcctgctgccggacatccgcggcgtgccagggaccgagcctgagaaagacccggggccgcgggcctagccatgattctacttcccaacctgactgcaatttggggagcggcttcacagcaggaccacaggagtcattgtggccaacttcgctggaggcttggagatctttggggccattaaggcagagctgcagggcctagagattgagatgctggtgaacaatgtggcatgctgtatgcgcagggacgcttgaggaagctgctcgactgtgagaatgtcgccagagtgaaacagagtcctagcccacctggcacctcttcctccaactctttactgccctctgttggaaaactcgcgtaatatacaaagtcgagacgggatttcaccatgttgcccagactggtctgtaactcctggcctcaagtgattcacccgcctcagcctccctaaatgctggggattacagacgtgaaccactgcacacggcctccattgagtctctctctgtggccaccactgctccaggcccatgg

SEQ ID NO: 103425 - DNA, 1002 bp, Homo sapiens
  Payload ID: 182
  Gene Symbol:
  Gene Name: AC005943.2
  ENST ID: ENST00000585937
  CDS Start-End: 37-207
tggacagggtcatcctgagggtgcgactccgccgcgatggtgacccggttcctgggcccacgctaccgggagctggtcaagaactgggtcccgacggcctacacatggggcgctgtgggcgccgtggggctggtgtgggccaccgattggcggctgatcctggactgggtaccttacatcaatggcaagtttaagaaggataattaattacacaaacccttcacagactgctctgcccgagcgggaagaagttccgcagcaagccgcagctggcgcgctacctgggcggctccatggacctgagcaccttcgacttccgcacgggcaagatgctgatgagcaagatgaacaagagccgccagcgcgtgcgctacgactcctccaaccaggtcaagggcaagcccgacctgaacacggcgctgcccgtgcgccagacggcgtccatcttcaagcagccggtgaccaagattaccaaccaccccagcaacaaggtcaagagcgacccgcagaaggcggtggaccagccgcgccagctcttctgggagaagaagctgagcggcctgaacgccttcgacattgctgaggagctggtcaagaccatggacctccccaagggcctgcagggggtgggacctggctgcacggatgagacgctgctgtcggccatcgccagcgccctgcacactagcaccatgcccatcacgggacagctctcggccgccgtggagaagaaccccggcgtatggctcaacaccacgcagcccctgtgcaaagccttcatggtgaccgacgaggacatcaggaagcaggaagagctggtgcagcaggtgcggaagcggctggaggaggcgctgatggccgacatgctggcgcacgtggaggagctggcccgtgacggggaggcgccgctggacaaggcctgcgctgaggacgacgacgaggaagacgaggaggaggaggaggaggagcccgacccggacccggagatggagcacgtctagg

SEQ ID NO: 103426 - DNA, 375 bp, Homo sapiens
  Payload ID: 183
  Gene Symbol:
  Gene Name: AC006026.2
  ENST ID: ENST00000623135
  CDS Start-End: 1-375
atgactcttaacgagcatgctgccttcaagcatctgtttaacaaagcacatcttgcaccgcccttaatccatttaaccctgagtggacacagcacatgtttcagagagcacagggttggagataaggtcacagatcaacaggatcccaaggcagaagaatttttcttagtacagaacaaaatgaaaagtctcccatgcccacttctatccacacagacccggcaaccatccgatttctcaattttttccccacccttcccgcctttctattccacaaaaccgccattgtcatcatggcccatccccaatgagtcgctaggcacacctcccagacggggtcgtggccgggcagaggggctcctcacttcccagtag

SEQ ID NO: 103427 - DNA, 501 bp, Homo sapiens
  Payload ID: 184
  Gene Symbol:
  Gene Name: AC006328.4
  ENST ID: ENST00000623198
  CDS Start-End: 13-411
agaacggaccagatgggtccaacagtgctgggtcaaggcgaggaggggcagccggaagcgggcgcatgctctggactcctgcagccgccgaaacggccaatcgtgtttaaggagaaactaacaatgaaaacggactcgttgatggaggaaaagttggaatgcagcctctggtgctgtttgagcgatccctctatcccgggtcgctgctgtgttctggaaaggcgcattgtaccctggatgcagcaggaatcctattcatcttcttcaccgataaggtctgtggactctgatgagccaaatctgacatcagttctggaacgtctagaagatactaaggacaacagcagttcggtgaggaaagaaaccaagctattttctctttttctcataaacattatatttagaaattaaatgttaagtgataatattatataaaaacatgattaaaaactataaacttagaggaattaaagtctgggtattttaagtcctccaaatctt

SEQ ID NO: 103428 - DNA, 406 bp, Homo sapiens
  Payload ID: 185
  Gene Symbol:
  Gene Name: AC006386.1
  ENST ID: ENST00000624491
  CDS Start-End: 28-105
cgccattttcttggaaacctctgcgccatgagagccaagtggaggaagaagcgaacgctcaggctgaagcgccaaagaagaaagatgaggcagaagtccaagtaaaccgctagcttgttgcaccgtggaggccacaggagcagaaacatggaacaccagacgctggggatgctggtacaagttgtgggactacatgctactgcctagagcttgtctcaatggatctagaacttcatcgccctctgatcgccgatcacctctgagacccaacttgctcataaacaaaactgcccatgtcggtcctctgccctggacctgtgacattctggactatttctgtgtttatttgtggccgagtgtaacaaccatataataaatcacctcttccgctgttttagctggaaaa

SEQ ID NO: 103429 - DNA, 120 bp, Homo sapiens
  Payload ID: 186
  Gene Symbol:
  Gene Name: AC006445.1
  ENST ID: ENST00000627924
  CDS Start-End: 1-120
ccggcgcccgcacccgcgccgcccgccccgcccgcgccggggccagccccggggcccggcggcggcggcggcggcggcgccggaggaggcggctgcggctgtgggttggtggccatggtg

SEQ ID NO: 103430 - DNA, 366 bp, Homo sapiens
  Payload ID: 187
  Gene Symbol:
  Gene Name: AC006449.1
  ENST ID: ENST00000616654
  CDS Start-End: 1-366
atgagagatgtgggggggaagaggagaagagggctgcacccgttcatacccagcctgggccccgtcttcaaatctaacctaaccgccacagtagtccagtctggggaatgcaagcggcttgggaaagttggagaacagccacttggagatgagaaccccagcctttggtttgggctgagggagggaagaagtgttctgggtggggtgtcttggtttcaatgcacagaatcacttggacctctcactcttcaacatggcaacctcggggtagacttacttctcttcccatccagacaaaagttaagtttcgctctaagtgggccagccttgggcaagggcgtgggtgtgaatgagcaactcttctaa

SEQ ID NO: 103431 - DNA, 366 bp, Homo sapiens; identical to SEQ ID NO: 103430
  Payload ID: 188
  Gene Symbol:
  Gene Name: AC006449.2
  ENST ID: ENST00000623658
  CDS Start-End: 1-366

SEQ ID NO: 103432 - DNA, 634 bp, Homo sapiens
  Payload ID: 189
  Gene Symbol:
  Gene Name: AC006486.9
  ENST ID: ENST00000594664
  CDS Start-End: 134-634
aggggagaggctctgagaggcgaggccgggtgaggcggcgagggcggcccgacgggcgcgggacgggacggggcagcgagggcgccgggagccgcggcccggaatcggggcgcttcgccccgggccccccagcatgaagaccccggcggacacaggtgacagcgggaaggtgaccacagtcgtagccactctaggccaaggcccagagcgctcccaagaagtggcttacacggacatcaaagtgattggcaatggctcatttggggtcgtgtaccaggcacggctggcagagaccagggaactagtcgccatcaagaaggttctccaggacaagaggttcaagaaccgagagctgcagatcatgcgtaagctggaccactgcaatattgtgaggctgagatactttttctactccagtggcgagaagaaagacgagctttacctaaatctggtgctggaatatgtgcccgagacagtgtaccgggtggcccgccacttcaccaaggccaagttgaccatccctatcctctatgtcaaggtgtacatgtaccagctcttccgcagcttggcctacatccactcccagggcgtgtgtcaccgcgacatcaagccccagaacctgctggtggaccct

SEQ ID NO: 103433 - DNA, 543 bp, Homo sapiens
  Payload ID: 190
  Gene Symbol:
  Gene Name: AC006538.4
  ENST ID: ENST00000586572
  CDS Start-End: 227-543
agccgcgccgagcggggcctctccgggccgcgtctgtggggtcgagactgcgcggccgttgggcgtgcagcggcgccagtcggcggacgaggggcccccgggagttgctggactgagacatgagcctccaactgtgtggttgggctcggtagcacatcgtgggacttgggtgtgcgcccacagatggtttggccctgcagtgaccagagcagcccaagccgccaccatggtgaaattgctagtggccaaaatcctgtgcatggtgggcgtgttcttcttcatgctgctcggctccctgctccccgtgaagatcatcgagacagattttgagaaggcccatcgctcgaaaaagatcctctctctctgcaacacctttggaggaggggtgtttctggccacgtgcttcaacgctctgctgcccgctgtgagggaaaaggctcggtctggggttcttgcagctggcaccagccctcccggccccggccgcccacccgccgcggggaagatgccggaacagagtaacgattaccgcgtggtggtgtt

SEQ ID NO: 103434 - DNA, 1285 bp, Homo sapiens
  Payload ID: 191
  Gene Symbol:
  Gene Name: AC006994.3
  ENST ID: ENST00000623861
  CDS Start-End: 598-921
agactctatactctaatttctcatttaaaagaaattggactcttacaaaataaacatgatatgaacccagaatttaacttactattttcttactgttatcccaaagacattacatgatattgaacactttgaggtaattatggtactgggggagcataattgttcctactaatagaaacaaaatactaaggatttttctagaaactcttaagagccatttacctggctaaggatttttctagaaactgtcctttcaagagccatttacctggaataaaagtgatgtgtatgataaacagttggctatacagacccaagatgaaattcaaaatatgacttctgaaaattctgaattcaaaatcaagtttttgatactttaggatcagctagatgatcatcataaatttgtctcctttccacttcaattttttttcatcttcaccaatctacactatattcaagccaacttaccatttcccttactccgttttccctgcaacttccctaagctgttagtgttattgtactactcttctttatgccacttaggcttgaattcttggcccaatttctctcacttctgcatgaagtcaccaaatgccagtgattctgcttctaacatatttcagacatcatttctgtccattcccactaccagaaagaaactctgtgttagtttttcttttacctttattgactttttataatagcatttatggcgtgttgaattgtggccccccaaaaatatgtccaagtcttaaccctggtgcctataaatgtgaccttatttgggaaaagagtctcacagatgaaattaagttaaagatcttaccctggattaaccaggtagatgctaaatcgaataaaaaagtgtctgtacaggaagagaagaggagaatcacagagaagaaagccatgtgaagatggtaacagacactggagtctgtaaccccaagtgtaatgcgacgggttctccaccaggttacttaagggtgtatgtccactgcttgagccctgaagactgggtggtgagccaaggtcatggtgctcagccaaggaacaccatgtgctgtgttccctgagaacacaaacatttgggagagtacctggggacataccaagaaaaacactcatcacacacagagaagaaaagccagaaaattagcttaaaagcagcttgaagatgggtggggtaagggggtgtgtggggcaaatctccagagttgtcctgctaccacctaggaatgccctgtatgttaagtcctaataaactcacctactcatc

SEQ ID NO: 103435 - DNA, 4170 bp, Homo sapiens
  Payload ID: 192
  Gene Symbol:
  Gene Name: AC007040.11
  ENST ID: ENST00000606025
  CDS Start-End: 580-1173
atgatttacattatctgctcaaatttccgacaagaacacacctcgcctttatcacagagcgtggcacatattaggaattcaataattttgtccctatcacctgcgatagcaagagacagacttgtccgcaacctgccgggaggcaggttctggggaggttgctggggcgcggtcgggcggccctgtccggccctggaccacctccaggctggtacgggagtgcacagggagggactggaggctgcactccgagccccagtatgggcgcttggtcgtctccgcccctgggcaccgtcccgcctccctctggctgcagcggtctgcattcattcccctcagtggagcgggggatcctggcggggcagcggcggttggccctcctctccggcgggcggcgctagcgcgagcctggccccgggcagcgctagggccgggctcctctcggcggcggcgcaccgtcgtcctgtcgtccgcggggcggggacgcggcggcggcggcggcggtggcggctgtgtgtcgccggagccgaagcgcgcaggcccgtcccggtggccggggagcgggcgggtgggggcgccatgtggttcatgtacctgctgagctggctgtcgctcttcatccaggtggccttcatcacgctggctgtcgcggctggactctattacctggcagaactgatagaagaatacacagtggccaccagcaggatcataaaatacatgatctggttctccaccgctgtactgattggcctctacgtctttgagcgcttccccaccagcatgattggagtgggcctattcaccaacctcgtctactttggcctcctccagaccttccccttcatcatgctgacctcgcctaacttcatcctgtcgtgtggactagtggtggtgaatcattacctagcatttcagttttttgcagaagaatattatcccttctcagaggtcctggcctatttcactttctgcctgtggataattccgtttgcgttttttgtgtcactttcggccggggagaacgtcctgccctctaccatgcagccaggaggacttggactaggaagatcaactgggcacggtgattcttgcacagatttttataaggatcctccaagtgtaacaaccatttggaaaactccgggccttgaggacagccagagaagataagttcaacttgcactttgccagagcaggggatctccctcagctccctgccttcaaacctaccttacagacctgcctggcctgcacctgagccaccctcttcttccttcctattcccactaaggaggtgtccctgcttccttcatagtgggtccttcccctgcaccgggaaacaggccctagagatgactccatggggtgaaggaccagagcctccttgcctctctctctgtctctctctccctctcttgtcttcccatgaagctctgatgtttccagtacaaaataaacctcgctcagtcccagtccttctccagttcctcccctcacaagcatggccccccactgctggctttccttccccaccttccaccctctccttggccttctccactctggcttcagtggcctccgatggctacactcagagcctgggtgcactgtcctttggaagcttccctctggggccgcctgtcagcctcctctgaagactcacactcctcgctctcagacctttgggtgctggaggacttcgaggtttggcctggctctccacttcttcctctcctttcctctgagatctgccttcttccttccctccctgcttcctttcttcaagcatatctactgcatggatgccttctatgtactaagctaggcaaatgaaagtgacaaatgaaaatgtgaagtgcctacaggctaaaagaaggatacagagcaaataacataattacaaactgcagtgggtgctcctaagggaaagatcaggatgggtgaacgagagtgggagggaagaccagactgggtgcgcttggaggaagcatcttatgggaagggccgtttgagctgagccttcagggtcaaggggtgccagcccccagggagctggggaaagggcacttctggcagaggagagaaaggactcatccagggccttcgtggaacagaaagaggggcagtgggctggcatgcacaggctcgcttcaggtgcagtaagacctgtcacctccaggagggcaagacatcatctgtggtgctcatcgttgtgtcccacttcatggaatagtgctgggaatatggtacacactcaagaaatatttggacagctacagtggctcacacctgtaatcccagcactctgggaggctgaggtgggtggatcacttgagcccaggagttcgagaccagcctgggcaatatggtgaagcctcgtctctacagaaaaatttaaaaattagctgggcatggtggaacgtgcctgtggtcccagctctcaggaggctgaggtgggaggatcacctgagcccagggaggttgaggctgcggtgagctctgatcatgctattattgcactccagcctgggtgacagagtaagatcctgtctcaaaaaaaaaaaaaaaaaagaaaaagaaaaagaaaaaagaaaaaaagaagaaaaagaaatctttgtggatggattatgaaaggtgttaactgaccccatctgctccttctcatacttcccacatcagaaccattgtgtgccccctcccgaccttcccaagcctccaaaccaaatgagagtcccattgaccagcctaaagggttgcacccctagcaccagccatacttcctgagaaggcagagagtagaagagaaagaggatgtactgggctaaggggctgttgggcataggaagactcctcaacgagaaagggtaggagacagaggcttgggcattacccttcccatcaattaaaaaaaactccaaacagccacagcactcccacacccacatggtgtttggatcagattgtctggattgctagtggattgtgcaagcaaagggatgcagggcaggcaggagagaccctcatttttataagcccccgggagagctggcatcttgcatgccacacctgccaaagggctgcgctgggggaagaaagcagtgatgtaaagatgcagggtgggtgggctggatagggaggtgggggtgtgggaggggatggggcccaaggaccagaaaagtccagggaatcatttctaattccactgcctcaggagacaagtctttcaacttcctcccttccttcacagctgctcccccacttcacagcccctgtcatgtagaatccccattagccctgacatccagcaactccacctgggagtgggggcagcagcagagtgggggacagaggattaggggatccacacagcccttccctcaggaggaagggctgggctggaaggggcctagaggcagctgcaaagtgcttgctgcaggtcctctgggagtcagatgccttccccggccaggccgctcgggtgaccggggtgagatatcgaagctcaacatcttagcacatcagcctcagctgtgagttgccttcctgggcttctcgcagcctccaggcctggctctgggtgaacacatcgcttcatggcctggacccatcattgcagataatccacttaggcggctgtttctgttcagcattggactatgcccatccttcaaggccttgcccttgactgactactgcagcccactgggtcctctccccactgctgtcccacggtactacagactgggaccctagagggatgtctctcccgtcagatgtcttagagctctgcctctcccctgttaagccagcctgatcttttcttctaggctgtttggtttggacacagccaaaatgggggctgagcaacagaggtgtccttgactgcaagccggtccttttgtttgtacactgccgcccctacctccgtgtgtcccttgcatggagtggcaaaacgaggcccagaaagtgggctagtttctggcaggacgcaccacagttcaagacggtatcctgcagcgctcagcgattatggcccactctgcaaccctgggatgttcgccttgaccctggagagggaagcgggtgcattgccacaggcagagggctggatcagaagacccaaagggcgctccttccatgggccttccagagactttgcagacactc

SEQ ID NO: 103436 - DNA, 423 bp, Homo sapiens
  Payload ID: 192
  Gene Symbol:
  Gene Name: AC007040.11
  ENST ID: ENST00000453130
  CDS Start-End: 1-148
catgtacctgctgagctggctgtcgctcttcatccaggtggccttcatcacgctggctgtcgcggctggactctattacctggcagaactgatagaagaatacacagtggccaccagcaggatcataaaatacatgatctggtcctagctactcgggaggctgaggcaggaaaatcgcttgaacccgggagaagaaggatgcagtgagcagagatcgtgccattgcacttcagcctggcgacagagcaagactccgtctcaaaaagaaaaaaaaaaagtgatcattttcatgaatgctgcctctaaggtccctcctgctgacaatggccagggcagtgcggaggctcctctttggaaattgtcttcagagctgatgcagactcttttgaaagcagccacagacattggggatggagtctggtg

SEQ ID NO: 103437 - DNA, 375 bp, Homo sapiens
  Payload ID: 193
  Gene Symbol:
  Gene Name: AC007163.2
  ENST ID: ENST00000624970
  CDS Start-End: 1-375
atgactcttaacgagcatgctgccttcaagcatctgtttaacaaagcacatcttgcaccgcccttaatccatttaaccctgagtggacacagcacatgtttcagagagcacagggttggggataaggtcacagatcaacaggatcccaaggcagaagaatttttcttagtacagaacaaaatgaaaagtctcccatgtctacttctatccacacagacccggcaaccatgcgatttctcaattttttccccacccttcccgcctttctattccacaaaaccgccattgtcatcatggcccatccccaatgagccgctgggcacacctcccagacggggtggtggccgggcagaggggctcctcacttcccagtag

SEQ ID NO: 103438 - DNA, 2404 bp, Homo sapiens
  Payload ID: 194
  Gene Symbol:
  Gene Name: AC007325.1
  ENST ID: ENST00000617983
  CDS Start-End: 428-1714
ggcggctggacgaggacgctccgagcccagctctcgagagttcaagcaaccgacggttccccactgctcccaggagcggttacctgggcactctgtgcccctccttcctgttcgggcccaggccgaggacctgccagtagggctcagttgcctggagcccgttcagcccatcccccagttcactttgcctgtgggatctccccgttgctcctgcccgtggactgagtggcaggccatcctacaagcacccggacacttgacatcagtggtgtcaagacaactctaagaaggttttccgtgatcctgcaagccctgcgttccttcctgggatcctgccttcaatttgattgcacaggtaccacagcaagccagtgctgtgtgctccgagttccagggcgtcctccagctcagccactgcactgagaacatggactctctgtggggcccaggagccgggagtcacccctttggggtccacaacacccggctgtccccagacttgtgtccagggaagatagtgttgagggccctcaaggagagcggggcagggatgcctgagcaggacaaggaccctagagtccaagagaatcctggtgatcagagaagggtccccgaggtcaccggggatgcaccgtctgcatttcggcccctgcgggacaatggaggcctctctccctttgtgcccgggcccgggcctctgcagacagacctccatgcccagaggtcagaaatcagatataaccagacatcccagacctcctggacgagctcctgcaccaaccgaaatgccatctccagctcctacagctccacgggaggcttgccggggctaaagcggaggagggggccagcctcatcccactgccagctgaccctcagttcctcaaagacagtgagtgaggacaggcctcaggctgtctcttcaggtcacacccagtgtgaaaaggcagcagatatagcaccagggcagacactcaccctcaggaatgactcctccacatccgaggcctctaggcccagtacacacaagtttcccctgctgccacgcaggcgaggggagcctttgatgctgccacctcccgtagagctggggtaccgggtcactgttgaagaccttgaccgggagaaggaggcggcattccagcgcatcaacagtgcactgcaggttgaggacaaggccatctcggactgcagaccctcacggccttcccacactttgtcctcacttgcaacagggacttctggtctgcctgccgtttctaaagcacccagtatggatgcacagcaggagacacacaagtcccaagactgcctgggcctactggcccccctagcatctgctgcagaggtcccctctacagctcccgtgtctgggaagaagcacagaccaccaggccccctgttctcctcctcagatccccttcctgccacctcttcccactcccgggactcagcccaggtcacctcgctgattcctgcccccttcccagctgcaagcatggatgctggcatgggaagaacaaggcctggcacttctgctcctgcagctgctgcagcagctcctcccccctccacattgaaccccacgttggggtcactactggagtggatggaggcccttcacatttctgggcctcagccacagctgcagcaggtgcccagaggtcagaaccagagatcccagacctcccggaccagctcgtgccccaaacgaaatgccatctcaagcccctaccgctctacgggaggcctcccggaacgaaagcagaggagggggccagcctcatcccactgccagctgaccctcagttcctgaaacacagtgagtgaggacggacctcaggctgtctcttcgggtcacacccagtgtgaaaagatggcagatacagcaccagggcagacactcgcccccaggggtggctcccccagatcccagtcctctaggccctgtagatgcaagtttcccctgctgccacgcaggcaaggggagcctttgatgctgccacctcccttagagctggggtaccgggtcactgctgaagacctggaccaggagaaggaggcggctttccagcgcatcaagagtgcactgcaggttgaggacaaggccatttagtactgcagaccctcacggccttcccacactttgtcctcacttgcaacaggggcttctggtctgcctgccatttctaaagcacccagtatggatgcacagcaggagagacacaagtcccaagactgcctgggcctagtggtcccccagcatctgctgcacaggcctgtagtcccagctactcaggaggctgaggcaggagaaggacataaacccgggaggcagagcttgcagtgagctgagattgcgccactgcactccagcctgggtgacagagcgagactccgtctc

SEQ ID NO: 103439 - DNA, 2405 bp, Homo sapiens
  Payload ID: 195
  Gene Symbol:
  Gene Name: AC007325.2
  ENST ID: ENST00000621424
  CDS Start-End: 205-2007
ggtctcactctgttgctgtcttcacggagagcaggagcagaggctttgagaagccagtgggccttggcctcagccctgccggcagagggtccccaccatgcagctgaagtgccagggtgcttgtgaagtctaagcccttgtctggcatttgtcaggaatataggcgcacacttaagcggcccgggcgggtaccgccgtcccgccatggctctgaggcgcgccctgcccgcgctgcgcccctgcattccccgcttcgtcccgctgtccacggcgccggcctcccgcgagcagcccgcagcgggcccagcggccgtgccaggaggtgggtcggccacggcagtgcggccgccggtgcccgccgtggacttcggcaacgcgcaggaggcgtaccgcagccggcgaacctgggagctggcgcggagcctgctggtgctgcgcttgtgcgcctggcccgcgctgctggcgcgccacgagcagctgctgtatgtttccaggaaacttctaggacagaggctattcaacaagctcatgaagatgaccttctatgggcattttgtagccggggaggaccaggagtccatccagcccctgcttcggcactacagggccttcggtgtcagcgccatcctggactatggagtggaggaggacctgagccccgaggaggcagagcacaaggagatggagtcctgcacctcagctgcggagagggatggcagtggcacgaataagcgggacaagcaataccaggcccactgggccttcggggaccgcaggaatggtgtcatcagtgcccgcacctacttctacgccaatgaggccaagtgcgacagccacatggagacattcttgcgctgcatcgaagcctcaggtagagtcagcgatgacggcttcatagccattaagctcacagcactggggagaccccagtttctgctgcagttctcagaggtgctggccaagtggaggtgcttctttcaccaaatggctgtggagcaagggcaggcgggcctggctgccatggacaccaagctggaggtggcggtgctgcaggaaagtgtcgcaaagttgggcatcgcatccagggctgagattgaggactggttcacggcagagaccctgggagtgtctggcaccatggacctgctggactggagcagcctcatcgacagcaggaccaagctgtccaagcacttggtagtccccaacgcacagacaggacagctggagcccctgctgtcccggttcactgaggaggaggagctacagatgaccaggatgctacagcggatggatgtcctggccaagaaagccacagagatgggcgtgcggctgatggtggatgccgagcagacctacttccagccggccatcagccgcctgacgctggagatgcagcggaagttcaatgtggagaagccgctcatcttcaacacataccagtgctacctcaaggatgcctatgacaatgtgaccctggacgtggagctggctcgccgtgagggctggtgttttggggccaagctggtgcggggcgcatacctggcccaggagcgagcccgtgcggcagagatcggctatgaggaccccatcaaccccacgtacgaggccaccaacgccatgtaccacaggtgcctggactacgtgttggaggagctgaagcacaacgccaaggccaaggtgatggtggcctcccacaatgaggacacagtgcgcttcgcactgcgcaggatggaggagctgggcctgcatcctgctgaccaccaggtgtactttggacagctgctaggcatgtgtgaccagatcagcttcccgctgggccaggccggctaccccgtgtacaagtacgtgccctatggccccgtgatggaggtgctgccctacttgtcccgccgtgccctggagaacagcagcctcatgaagggcacccatcgggagcggcagttgctgtggctggagctcttgaggcggctccgaactggcaacctcttccatcgccctgcctagcacccgccagcacaccctcagcctccagcaccccccgcccccgcccaggccatcaccacagctgcagccaaccccatcctcacacagattcaccttttttcaccccacacttgcagagctgctggaggtgaggtcaggtgcctcccagccctgcccagagtatgggcactcaggtgtgggccgaacctgatacctgcctgggacagccactggaaacttttgggaactctcctcgaatgtgtgggcccaaggcccccacctctgtgacccccatgtccttggacctagaggattgtccaccttctgccaaggccagcccacacagcccgagccccttggggagcagtggccgggctggggaggcctgcctggtcaataaaccactgttcctgcagctg

SEQ ID NO: 103440 - DNA, 1990 bp, Homo sapiens
  Payload ID: 195
  Gene Symbol:
  Gene Name: AC007325.2
  ENST ID: ENST00000615165
  CDS Start-End: 114-1592
gctgaagtgccagggtgcttgtgaagtctaagcccttgtctggcatttgtcaggaatataggctgctgtatgtttccaggaaacttctaggacagaggctattcaacaagctcatgaagatgaccttctatgggcattttgtagccggggaggaccaggagtccatccagcccctgcttcggcactacagggccttcggtgtcagcgccatcctggactatggagtggaggaggacctgagccccgaggaggcagagcacaaggagatggagtcctgcacctcagctgcggagagggatggcagtggcacgaataagcgggacaagcaataccaggcccactgggccttcggggaccgcaggaatggtgtcatcagtgcccgcacctacttctacgccaatgaggccaagtgcgacagccacatggagacattcttgcgctgcatcgaagcctcaggtagagtcagcgatgacggcttcatagccattaagctcacagcactggggagaccccagtttctgctgcagttctcagaggtgctggccaagtggaggtgcttctttcaccaaatggctgtggagcaagggcaggcgggcctggctgccatggacaccaagctggaggtggcggtgctgcaggaaagtgtcgcaaagttgggcatcgcatccagggctgagattgaggactggttcacggcagagaccctgggagtgtctggcaccatggacctgctggactggagcagcctcatcgacagcaggaccaagctgtccaagcacttggtagtccccaacgcacagacaggacagctggagcccctgctgtcccggttcactgaggaggaggagctacagatgaccaggatgctacagcggatggatgtcctggccaagaaagccacagagatgggcgtgcggctgatggtggatgccgagcagacctacttccagccggccatcagccgcctgacgctggagatgcagcggaagttcaatgtggagaagccgctcatcttcaacacataccagtgctacctcaaggatgcctatgacaatgtgaccctggacgtggagctggctcgccgtgagggctggtgttttggggccaagctggtgcggggcgcatacctggcccaggagcgagcccgtgcggcagagatcggctatgaggaccccatcaaccccacgtacgaggccaccaacgccatgtaccacaggtgcctggactacgtgttggaggagctgaagcacaacgccaaggccaaggtgatggtggcctcccacaatgaggacacagtgcgcttcgcactgcgcaggatggaggagctgggcctgcatcctgctgaccaccaggtgtactttggacagctgctaggcatgtgtgaccagatcagcttcccgctgggccaggccggctaccccgtgtacaagtacgtgccctatggccccgtgatggaggtgctgccctacttgtcccgccgtgccctggagaacagcagcctcatgaagggcacccatcgggagcggcagttgctgtggctggagctcttgaggcggctccgaactggcaacctcttccatcgccctgcctagcacccgccagcacaccctcagcctccagcaccccccgcccccgcccaggccatcaccacagctgcagccaaccccatcctcacacagattcaccttttttcaccccacacttgcagagctgctggaggtgaggtcaggtgcctcccagccctgcccagagtatgggcactcaggtgtgggccgaacctgatacctgcctgggacagccactggaaacttttgggaactctcctcgaatgtgtgggcccaaggcccccacctctgtgacccccatgtccttggacctagaggattgtccaccttctgccaaggccagcccacacagcccgagccccttggggagcagtggccgggctggggaggcctgcctggtcaataaaccactgttcctgcagctg

SEQ ID NO: 103441 - DNA, 1213 bp, Homo sapiens
  Payload ID: 196
  Gene Symbol:
  Gene Name: AC007325.4
  ENST ID: ENST00000613204
  CDS Start-End: 153-815
cgcgaggcgcgccgcgatcggggactgtcctaagacgggcggggcgcgctgcgctagggactgtcataaaaggggcgggacgcgccgcggtcgggatgacgtgagctgggggcgctcgtcgctgcagccggcggctagcgggcgtccgcgccatggagcgctacgcgggcgccttggaggaggtggcggacggtgcccggcagcaggagcgacactaccagctgctgtcggcgttacagagcctggtgaaggagttgcccagctcattccagcagcgcttgtcctacaccacgctgagcgacctggccctggcgcttctcgacggcaccgtgttcgaaatcgtgcaggggctactggagatccagcacctcaccgaaaagagcctgtacaaccagcgcctgcgcctacagaacgagcatcgagtgctcaggcaggcgctgcggcagaagcaccaggaagcccagcaggcctgccggccccataacctgcctgtgcttcaggcggctcagcagcgagaactagaggcggtggagcaccggatccgtgaggagcagcgggcgatggaccagaagatcgtcctggagctggaccggaaggtggctgaccagcagagcacactggagaaggcgggggtggctggcttctacgtgaccaccaacccacaggagctgatgctgcagatgaacctgctggaactcatccggaagctgcagcagaggggctgctgggcagggaaggcagccctggggctaggaggtccctggcagttgcctgctgcccagtgtgaccagaaaggcagccctgtcccaccatagccacaggcagcagaagtctgggcagagttcatcttcttgacctttggccactgccttcccagctgcccgcagggggttccccctgctgaggagagaccaggtggaccccagctgcctgtcacccttcatctgggacttgctgtcaaaccctaggatagtctcataaaggggaggctgggccagcctgctgctgtctgcttcagggccaggcagagagtgaggctgggggttctcacaccttactccaccgggcacatcccaacctgcactggggcccactcgagtgcttgttctggtctcagccgctcccttggcagctgcagcccccatgcagaagaggctcccaggcccaagctctgtgtgacccagagaaataaagatgcctcagtgtggcccgc

SEQ ID NO: 103442 - DNA, 228 bp, Homo sapiens
  Payload ID: 197
  Gene Symbol:
  Gene Name: AC007326.1
  ENST ID: ENST00000623496
  CDS Start-End: 1-228
atgaacccatcggagatgcaaagaaaagggcctccgcggagatggtatctgcaggtgtacccaacagctccgaagagacagcgaccatcgagaacgggccatgatgacgatggcggttttgtcgaaaagaaaagggggaaatgtggggaaaagcaagagagatcagattgttactgtgtctgtgtagaaagaagtagacataggagactccattttgttatgtgctaa

SEQ ID NO: 103443 - DNA, 78 bp, Homo sapiens
  Payload ID: 198
  Gene Symbol:
  Gene Name: AC007557.5
  ENST ID: ENST00000623926
  CDS Start-End: 1-78
tctgccaaggagaagctgagatcacagggaataagaagagataaaagtagggctgcatcccagggtgttagaaaaggg

SEQ ID NO: 103444 - DNA, 871 bp, Homo sapiens
  Payload ID: 199
  Gene Symbol:
  Gene Name: AC007906.1
  ENST ID: ENST00000624244
  CDS Start-End: 124-696
tgtcgatttgatcttcttttttgagagtcttgatcttttaatgtatgctgtggcatctgttctgcatcagatatttcatctgaagactcattctttcttttttgtttcttacccaatgtaataatgagtttgccaatttttgtcttctcttttaacttagaacatgtttttgtttttttgctgtctttgtcctttggcttggatttcatccttctacctttcttttcctcttttccttcaactgaagcagtaggaaagttttcagggctcattactcgtggaatattgcgttccccacgctcctttgcttttgctatggcctctgatattatacgattagccttttcttgcttgctttctgattccaccttttttctctgcttcttctcagacatgaccctcacctgggtattctgcaacttagtatatgtcccagaaccatcgctcttcttggaagatggaggccttcctcttggcctcttcactgaagacatttttggcgtcagacaaaggcttgccctctgctttttcaccaccccaggcagtgctcaagaaaaaagcattgaaagaagattcctaaatggcctatttagcaagctgcaaccaagagatgcacaaccctccacaaatacacattttgatttatcaacacatttctgccttggcaagtttatatctactgttcatcctatttaggtatgaaaaaggctgtaaacactcctaaaaagctgagtttcctcaatagctgtaagcagatagccagattccaacaaagcacagaaagaaatgaatgcacaaagcatcaaaatgcatcagcatgaatattagagatgtcgttaaaaatactgactccttctgcggaagtaggcca

SEQ ID NO: 103445 - DNA, 1622 bp, Homo sapiens
  Payload ID: 200
  Gene Symbol:
  Gene Name: AC008074.1
  ENST ID: ENST00000623932
  CDS Start-End: 577-987
ttttttttttttttttttaattagagcaggtatgcttttgatggtagggaagggatggaaaaaaggaaaagcaatagaaactgtccaattcacatcagttatccgtctgctttttcttgagagcttgtggaaggtgttaacgtggctgggaacatcaacaccttggcatgcatgaatgttaagtcaggaaggccagcgatcaccttgatagcttcttcacttaggtgctcttctcttttcggtttcctactggtagatgtgcttgtcttctctactgtagacatgagtcttgcaaatgcatcagtcactttgaggcttgaggtggagatttccagcttagaagttgttaactcatacaactccggatccacaccttggattgtggtgctgctgctagagctactgtcatccacgggcccaaagaaatcaaggttcagaagagtggaacctccactagcttctaaagggttagtaaggccactgctactccagtcaaactggacgggtggtagagactcctggaactgatcagatgtacatgtgttcatatctggtgacatggtggctgtctgaccgatggaagctattttttctgcagcagaaagtggtttcagtggttccttggtgggctctaacatacccaatcctgctgcatacatgggcactataacaggctgcttcttattgcccgtgaagagaatgtttcgggtgtctattcccaaggaggacaaaagcttcttgttgctatgggagccgccccactggtatctcaagccatgtgcatcatggatatcctgtagctcagtccacacatctagcaattccccactttcaggtaaggcctctctcgtttttattggcaaagtgcttgtttccagcaagtgcttcagggaagtaacttcctcttcagcatcagggacaagtatggaaggaaaacatgcttcgaaaattcgctccaggcggtttaaaaaattagtaaatacctgaactgaagtggctgattcctgtaaatggccactagcaactgctcctttggaagttgctgaaggtacactgtgcgttttgggggttcctggagtatcaatattttcatctgtcctatgtgactgccaggcttcctttcgatgatgagattcagtagcctgctggtctccaaaagcagcccaagaacaactatctttttgttcatcctcaaaagcattccaatctacaacttggctaggaccagctgaactgaagtctgcaaaatcatcagagtcttgaaaaccattgcagtcatcctgaatatttggcacagaatcaaaatgtccaatctcaccttcttgcccatttttaagttttgcaacaggttcagtgcctgttccactagattttcttgccaattgacattcttctgataaattatcagaagtctgttttaggtctgactttgttaatattgtctcctcttggcaagaaacagcatttatatccccaaattctccaaagtcatcacctggttcactaaaatgtggaaagtgctctgaagactcttcaaaagtggcatcactcattgaatcttgagtaccagtaacaaaaggtggagttgagccactggcagagccaaagtcaccaaaatcacc

SEQ ID NO: 103446 - DNA, 2904 bp, Homo sapiens
  Payload ID: 201
  Gene Symbol:
  Gene Name: AC008522.1
  ENST ID: ENST00000624710
  CDS Start-End: 2251-2772
ttttcctcgcttgtactactcaattataaaacaaattattaacgatagcttctgaatttggtacatggcatcataggtgaacaaaaaaagccacagttcagagctgatggtcagtccgtctctagtccagcttctataaaaggaaggcgggtttaggtttcaactctctatagttgaatctccatgagtaagaaggagatgccttccttattttcccagactgcccaagattattctctcatcaacacaaggtagaggtttgccacctctacatgaattcacaactccactctgtgactgggtggcacatcagttcgctaagaagttaaactttacaaaatgacgtcctcttcctcttgccggtatgggcctctggcagtgtcactgatcaataggacatggcaaaagtaactacctggagaactaaaactaagcataatcttggcctgaactactacggtaaagatagtatcttttatttctgtttatgtaaacttatcaacaaattattaaagcagaaactctatcacttcttggaactaaagatttacatctagctataacaatagaaacctacctatcctggagttaactttctcagattactgctcctgacttttgctgttcttttccttttgcaagggggtgccaacaatggatggaagaggcaaggagatcttactttataggaatttctccaagttacaacgagcaactgaccaaatcatattcaactacaggtgttgagagagagagtacctgacttcagaccacctgggaagcacaatgcttagttaacaagaatatctggattaagcagtgccgaagtggccgcacaccgagtcaggccaaggaagctcttctgtcattgccgcccaactctgttccactttgcatgcagacatatcaaagactgtgatgaagatcatggtggacaaggaagaatgaaaaactttgtgatgggatctgggcctctacattagagaaagaacctaacaaaccccagttctttggattcgtaaggtgaggctgaggagggcttactggagttggagacagggagagctgtgtttctgggctcaaagccaagaaacggttaagaagaggggcttgcatcagtcatatagattaaaaagagcaaggcatgataattactaaatttatagtttcatgttttaacacagaagagtcagagggaaaactgacaatttaaaacggggcatgggatgagaaaaagtctaggagttactgagatgcctggtacttatctacaaaacttccatcactagacccttttgacctacgagaatagcagtttctatggttcaacctaatacactgtatgggctcaaatatataacaattagaattgagagtaatcagaataccaataatacccccccttctgaaaaagtaacagctcttagatgaagagagcttcttaagatcagcgtttaagagtcaaagcacctgtaagggagagttaacgaccctttcaaatcaagtgagggcagaagggtgagggcatagttcaaaggaacgaggcagctccaccggaaggtggcgagtaaaagctgcacaccgtggcaaatcagtagcaatgggaaagggcaggaaggtacagccaagaatagctacaaacaactggtcaccttcaaaggaaacgctgcatatggatgtctgtgtatatgtactatacatatcaaccaagcacacacataaatatttaatatataaaaaataaagtgctttctaacaggtccctgggcagggacattataaaacatttcacagaactgcaaaacaaaattgatacaatcaaagaacactacatccaacatatgtgaaaacagccaaacacagtatgtacaatctggtgggtgtcccaggacaaacatcctgtcatatacatggtatatacatatatactcttttactcaatatattatgacaatatatattttaaaattttgttatagacaaaaaataaaaaaccaaaacaaaagacaacccctacaaaaacacgataaggatcaagcaggtgagtcctagactgacagacaaatcactgcctccacggggagtcccattgccactgctggggaaaatgtgccagcgttccttccttgggtgcagggcctccacatcctccaaggcactgtgggctgcggcagtaaagttggcatcaccagtggtgagcaggtcgaagacacaggactggaaatagatgtccttcactggcatcttctcatggcattgagtgttggcagtctccagtgtgtagccaggccaggcctgcaccaaggaggtgcgaggcaggctgtgtcccaggatggcagacacctggccctgcccgtcatcgatgcgttcactcagggggcagccgttcacgcacagctgcaggtcctggctctcctcgtaggacatggccaggtcttcaggcatacggatggcaagggtcaggtagcgacccacctgccgcacaaacactgtggtccctatatagcgggcgtgcatctccacatagtggccactctccctttccacgatacgcaggctcttggcatcgctgtccccaccactggtggtgccatccacaaaggcggccggcaggtcatctgtcacagcttggtagactttctgatctgtacactcatggtgggctttgaagataatagtgatctgtgggaaggagcatgtacaaggtttaacagaatgggaaggaagcagaacggggtaaccctctgtagcaagagctccccgccattttgaagctgaatggcttaaggcggaatctccaaaatggacccaactgcttgcacctcaaaaatggatatcactttcagaaaatattttttaaagtcctatatatttagaactaaagtttaaataaatctgtgcatc

SEQ ID NO: 103447 - DNA, 48 bp, Homo sapiens
  Payload ID: 202
  Gene Symbol:
  Gene Name: AC008622.1
  ENST ID: ENST00000624320
  CDS Start-End: 1-48
gagagtaggggtggcccagttagaatagctgggattacaggcgtgtgc

SEQ ID NO: 103448 - DNA, 69 bp, Homo sapiens
  Payload ID: 203
  Gene Symbol:
  Gene Name: AC008641.1
  ENST ID: ENST00000624359
  CDS Start-End: 1-69
atgagtaggcttgtcagagggagctcactacttacctacttggtagtagcccttgttttgcaatcgaga

SEQ ID NO: 103449 - DNA, 384 bp, Homo sapiens
  Payload ID: 204
  Gene Symbol:
  Gene Name: AC008686.1
  ENST ID: ENST00000624302
  CDS Start-End: 1-384
tggctcacacctgtaatcccagcacttggggaagctgaagtgggaggattgcttgagtccaggagttcaagacgaagctgtgccatgattgcgccactgcactccagtctgggcgacagagccagacctcgtctcaaaaaaaaaaaaaaaaaaaaaaagaggaaaaaaaggagtttgattttgagaccatgtctcactctgtcacccaggctgacatgcaatggcaccatcttggctcactgcaacctccgcctcccaggttcaagtgattctcctgcctcagcctcccaagtggctgggattacaggcactcaccaccatacccggctaatttttgtatttttagtagagtcaccctgttggtcagctattgtgagcagtgct

SEQ ID NO: 103450 - DNA, 93 bp, Homo sapiens
  Payload ID: 205
  Gene Symbol:
  Gene Name: AC008759.1
  ENST ID: ENST00000624191
  CDS Start-End: 1-93
aaaaaaattctaggccgggcgcagtggctcatgcctgtaatcccagcactttgggaggctgagggtcttgctctgtcgcccaggctggagtgc

SEQ ID NO: 103451 - DNA, 375 bp, Homo sapiens
  Payload ID: 206
  Gene Symbol:
  Gene Name: AC008810.1
  ENST ID: ENST00000624753
  CDS Start-End: 1-375
atgactcttaacgagcatgctgccttcaagcatctgtttaacaaagcacatcttgcaccgcccttaatccatttaaccctgagtggacacagcacatgtttcagagagcacagggttggggataaggtcacagatcaacaggatcccaaggcagaagaatttttcttagtacagaacaaaatgaaaagtctcccatgtctacttctatccacacagacccggcaaccatccgatttctcaattttttccccacccttcccgcctttctattccacaaaaccgccattgtcatcatggcccatccccaatgagccgctgggcacacctcccagacggggtcgtggccgggcagaggggctcctcacttcccagtag

SEQ ID NO: 103452 - DNA, 72 bp, Homo sapiens
  Payload ID: 207
  Gene Symbol:
  Gene Name: AC008914.1
  ENST ID: ENST00000624860
  CDS Start-End: 1-72
cgttgtgcctgggcaacaagagcaaaactccatctcaaaaaaaaaaaaaaaaaaacccaaaaaacaaacaaa

SEQ ID NO: 103453 - DNA, 375 bp, Homo sapiens
  Payload ID: 208
  Gene Symbol:
  Gene Name: AC009022.1
  ENST ID: ENST00000624290
  CDS Start-End: 1-375
atgactcttaacgagcacgctgccttcaagcatctgtttaacaaagcacatcttgcaccgcccttaatccatttaaccctgagtggacacagcacatgtttcagagagcacagggttggggataaggtcacagatcaacaggatcccaaggcagaagaatttttcttagtacagaacaaaatgaaaagtctcccatgtctacttctatccacacagacccggcaaccatccgatttctcaattttttccccacccttcccgcctttctattccacaaaaccgccattgtcatcatggcccatccccaatgagccgctgggcacacctcccagacggggtcgtggccgggcagaggggctcctcacttcccagtag

SEQ ID NO: 103454 - DNA, 381 bp, Homo sapiens
  Payload ID: 209
  Gene Symbol:
  Gene Name: AC009060.2
  ENST ID: ENST00000624108
  CDS Start-End: 1-381
ttggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtgcagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccaggcaggggggctcctcacttcccagtag

SEQ ID NO: 103455 - DNA, 381 bp, Homo sapiens
  Payload ID: 210
  Gene Symbol:
  Gene Name: AC009060.3
  ENST ID: ENST00000625001
  CDS Start-End: 1-381
atggtgatgactcttaacgagcatgctgccttcaagcatctgtttaacaaagcacatcttgcaccgcccttaatccatttaaccctgagtggacacagcacatgtttcagagagcacagggttggggataaggtcatagatcaacaggatcccaaggcagaagaatttttcttagtacagaacaaaatgaaaagtctcccatgtctacttctttctacacagacacggcaaccatccgatttctcaatcttttccccacctttcccccttttctattccacaaaaccgccattgtcatcatggcccgttctcaatgagctgttgggtacacctcccagacggggtggtggccgggcagaggggctcctcacttcccagtag

SEQ ID NO: 103456 - DNA, 537 bp, Homo sapiens
  Payload ID: 211
  Gene Symbol:
  Gene Name: AC009065.4
  ENST ID: ENST00000623013
  CDS Start-End: 1-537
gagctttctagccagaaaaccggagggaatcttgacaggcacacagcatccaaaccaacagcacttctgcagccggggcccggctggcagaggggtgctgcctgctgcctgcaaatcctgccagagtcaagggtttgctttcctactggtcttcctttggctagaaaagtgacaaaactgagctgggtggggtataagttacaggggcgagagcttcagtggcctgtttatcgggaggagttggagctggagcggctcctgtggcggcggcggcccggggaccgtgatctccggcgcacgggggacctgcgcctcggggagcgggaccttctcctcatccgtgggggagacctgcgccacataggcggtggtggcaacattctcctgggagggctgaatctcctggggggtggcctaggccagggggccagcacggcggtggcagtgatctcctggccatcaatttgtcctcctccatccatgtgcttcagcgccttctcggcttcatctggattctcaaactctacgtacgcatag

SEQ ID NO: 103457 - DNA, 78 bp, Homo sapiens
  Payload ID: 212
  Gene Symbol:
  Gene Name: AC009121.2
  ENST ID: ENST00000629750
  CDS Start-End: 1-78
agctgctccgccagcaccttgagtggcggcgacctcggaagccgcacccccgcggggccgcctgagaacgagtccgca

SEQ ID NO: 103458 - DNA, 610 bp, Homo sapiens
  Payload ID: 213
  Gene Symbol:
  Gene Name: AC009133.22
  ENST ID: ENST00000449759
  CDS Start-End: 117-610
gacctggccccagtgctgcgtccttatcagccgagccgtcccacccccagcctggggcctctgggagccttggtcctgagcagccaacacaccagcccagacagctgcaagtcaccatggacgctgaaggcctggcgctgctgctgccgcccgtcaccctggcagccctggtggacagctggctccgagaggactgcccagggctcaactacgcagccttggtcagcggggcaggcccctcgcaggcggcgctgtgggccaaatcccctggggtactggcagggcagcctttcttcgatgccatatttacccaactcaactgccaagtctcctggttcctccccgagggatcgaagctggtgccggtggccagagtggccgaggtccggggccctgcccactgcctgctgctgggggaacgggtggccctcaacacgctggcccgctgcagtggcattgccagtgctgccgccgctgcagtggaggccgccaggggggccggctggactgggcacgtggcaggcacgaggaagaccacgccaggcttccggctggtggagaagtatgggctcctggtgggcggggccgcctcgcaccgctacgacctggg

SEQ ID NO: 103459 - DNA, 2252 bp, Homo sapiens
  Payload ID: 214
  Gene Symbol:
  Gene Name: AC009133.23
  ENST ID: ENST00000609618
  CDS Start-End: 129-1208
cgggctgcggctgctgcaaaagccagcagcggcagcgggagctgtccggaggccggcgtcgagggtttgccgctgtctctgctattccatcctccccataggggctctctcccctctcccatctcaagatggcagccagcagctctgagatctctgagatgaagggggttgaggagagtcccaaggttccaggcgaagggcctggccattctgaagctgaaactggccctccccaggtcctagcaggggtaccagaccagccagaggccccgcagccaggtccaaacaccactgcggcccctgtggactcagggcccaaggctgggctggctccagaaaccacagagaccccggctggggcctcagaaacagcccaggccacagacctcagcttaagcccaggaggggaatcaaaggccaactgcagccccgaagacccatgccaagaaacagtgtccaaaccagaagtgagcaaagaggccactgcagaccaggggtccaggctggagtctgcagccccacctgaaccagccccagagcctgctccccaaccagacccccggccagattcccagcctacccccaagccagcccttcaaccagagctccctacccaggaggaccccacccctgagattctgtctgagagtgtaggggaaaagcaagagaatggggcagtggtgcccctgcaggctggtgatggggaagagggcccagcccctgagcctcactcaccaccctcaaaaaaatcccccccagccaatggggcccccccccgagtgctgcagcagctggttgaggaggatcgaatgagaagggcacacagtgggcatccaggatctccccgaggtagcctgagccgccaccccagctcccagttggcaggtcctggggtggaggggggtgaaggcacccagaaacctcgggactacatcatccttgccatcctgtcctgcttctgccccatgtggcctgtcaacatcgtggccttcgcttatgctgtcatgcctgcagcagggggacgtggacggggcccagcgtctgggccgggtagccaagctcttaagcatcgtggcgctggtggggggagtcctcatcatcatcgcctcctgcgtcatcaacttaggcgggtccctgccctagtggcctatgtcccttgctcggggccatggagacactgcggccagtacggcggcgcctctgtctgaagaaggggaagtgacctccggcctccaggctctggccgtggaggataccggaggcccctctgcctcggccggtaaggccgaggacgagggggaaggaggccgagaggagaccgagcgtgaggggtccgggggcgaggaggcgcagggagaagtccccagcgctgggggagaagagcctgccgaggaggactccgaggactggtgcgtgccctgcagcgacgaggaggtggagctgcctgcggatgggcagccctggatgcccccgccctccgaaatccagcggctctatgaactgctggctgcccacggtactctggagctgcaagccgagatcctgccccgccggcctcccacgccggaggcccagagcgaagaggagagatccgatgaggagccggaggccaaagaagaggaagaggaaaaaccacacatgcccacggaatttgattttgatgatgagccagtgacaccaaaggactccctgattgaccggagacgcaccccaggaagctcagcccggagccagaaacgggaggcccgcctggacaaggtgctgtcggacatgaagagacacaagaagctggaggagcagatccttcgtaccgggagggacctcttcagcctggactcggaggaccccagccccgccagccccccactccgatcctccgggagtagtctcttccctcggcagcggaaatactgattcccactgctcctgcctctagggtgcagtgtccgtacctgctggagcctgggccctccttccccagcccagacattgagaaacttgggaagaagagagaaacctcaagctcccaaacagcacgttgcgggaaagaggaagagagagtgtgagtgtgtgtgtgtgttttttctattgaacacctgtagagtgtgtgtgtgtgttttctattgaacacctatagagagagtgtgtgtgttttctattgaacatctatatagagagagtgtgtgagtgtgtgttttctattgaacacctattcagagacctggactgaattttctgagtctgaaataaaa

SEQ ID NO: 103460 - DNA, 369 bp, Homo sapiens
  Payload ID: 215
  Gene Symbol:
  Gene Name: AC009286.1
  ENST ID: ENST00000630493
  CDS Start-End: 1-369
atggcctggactcctctcctcctcctgctcctctctcactgcacaggttccctctcgcagcctgtgctgactcagccaacctccctctcagcatctcctggagcatcagccagattcacctgcaccttgcgcagtggcatcaatgttggtacctacaggatatactggtaccagcagaagccagggagtcttccccggtatctcctgaggtacaaatcagactcagataagcagcagggctctggagtccccagccgcttctctggatccaaagatgcttcaaccaatgcaggccttttactcatctctgggctccagtctgaagatgaggctgactattactgtgccatttggtacagcagcacttct

SEQ ID NO: 103461 - DNA, 3521 bp, Homo sapiens
  Payload ID: 216
  Gene Symbol:
  Gene Name: AC009336.19
  ENST ID: ENST00000468418
  CDS Start-End: 550-990
ggcggcctttgtatggcagaatccctgctcccgccggctgcaggcagggcgggcaggcaggaaccctcctcgcctggggcactctgcccaactcagaggcgagttcacccacccacctttcattgctctgtaccccaataggaggattcattctcccttgagctgtgcctacttggtgtcggggggcgggggttgcattcagctgggggtgagtggaagggccacggaaggttggcaaaatcagtggcagacaaaagctgggattacctgaggggaatggggtgctggggactggaactacattaatatctggcaggggctctcaaatgtgccatagcaagctacttgattacacgtatgttatttagttaaatttgtgaaaattatgagatgctcaccaacccggtgataaacttgctccctcgccattggctggcctggtcacatggctgcccaactttattcagttgacagcaagtaggagggccctatggaaggagaaaaaaagacaacacgagaaaaattagtattttctaccttctgaaattaatggtcatgagttcgtatatggtgaactccaagtatgtggaccccaagttccctccgtgcgaggagtatttgcagggcggctacctaggcgagcagggcgccgactactacggcggcggcgcgcagggcgcagacttccagcccccggggctctacccacggcccgacttcggtgagcagcctttcggaggcagcggccccgggcctggctcggcgctgcctgcgcggggtcacggacaagagccaggcggccccggcggtcactacgccgctccaggagagccttgcccagctcccccggcgcctccgccggcgcccctgcctggcgcccgggcctacagtcagtccgaccccaagcagccgccctccgggacggcactcaagcagccggccgtggtctacccctggatgaagaaggtgcacgtgaattcgggtatctgacaaggcgccgtcggattgaaatcgctcacaccctgtgtctgtcggagcgccagatcaagatctggttccagaaccggaggatgaagtggaaaaaagatcataagctgcccaacactaaaggcaggtcatcgtcctcatcttcctcctcatcttgctcctcctcagtcgcccccagccagcatttacagccgatggccaaagaccaccacacggacctgacgaccttatagaagtggggaccctgggcccatctctccctgcgcaccaggctgagccgaagctgcgggggcaggccgggcctgctgtcacctcgctgggctctaaggtcacctggagcctgggggccggcccagctctctcaggattcagcagacattggaggtggcagtgaaggatacagtggtagtcaatgttatttgagcagggtcagcaggccctggagcttcctgagtgcacaatgcagaaggctgcttactatgaaaacccaggactgtttggaggctatggctacagcaaaactacggacacttacggctacagcaccccccaccagccctacccaccccctgctgctgccagctccctggacactgactatccaggttctgcctgctccatccagagctctgcccctctgagagccccagcccacaaaggagctgaactcaatggcagctgcatgcggccgggcactgggaacagccagggtgggggtggtggcagccagcctcctggtctgaactcagagcagcagccaccacaaccccctcctccaccaccgaccctgcccccatcttcacccaccaatcctggaggtggagtgcctgccaagaagcccaaaggtgggcccaatgcttctagctcctcagccaccatcagcaagcagatcttcccctggatgaaagagtctcgacagaactccaagcagaagaacagctgtgccactgcaggagagagctgcgaggacaagagcccgccaggcccagcatccaagcgggtacgcacggcatacacgagcgcgcagctggtggaattggaaaaggaattccacttcaaccgctacttgtgccggccgcgccgcgtggagatggccaacctgctgaatctcacggaacgccagatcaagatctggttccagaaccggcgcatgaagtacaagaaggaccagaaggccaagggcatcctgcactcgccggctagccagtcccctgagcgcagcccaccgctcggcggcgccgctggccacgtggcctactccggccagctgccgccagtgcccggcctggcctacgacgcgccctcgccgcctgctttcgccaaatcacagcccaatatgtacggcctggccgcctacacggcgccactcagcagctgcctgccacaacagaagcgctacgcagcgccggagttcgagccccatcccatggcgagcaacggcggcggcttcgccagcgccaacttgcagggcagcccggtgtacgtgggcggcaacttcgtcgagtccatggcgcccgcgtccgggcctgtcttcaacctgggccacctctcgcacccgtcgtcggccagcgtggactacagttgcgccgcgcagattccaggcaaccaccaccatggaccttgcgaccctcatcccacctacacagatctctcggcccaccactcgtctcagggacgactgccggaggctcccaaactgacgcatctgtagcggccgccgccagcccgaactcgcggcaaaattacctctcttgctgtagtggtggggtagagggtggggcccgcggggcagttcgggaacccccttccccgctcttgccctgccgccgcctcccgggtctcaggcctccagcggcggaggcgcaggcgaccgggcctcccctccatgggcgtcctttgggtgactcgccataaatcagccgcaaggatccttccctgtaaatttgacagtgccacatactgcggaccaagggactccaatctggtaatggtgtcccaaaggtaagtctgagacccatcagcggcgcgccctgcagagggaccagagcttggagagtcttgggcctggcccgcgtctagcttagtttcagagaccttaatttatattctccttcctgtgccgtaaggattgcatcggactaaactatctgtatttattatttgaagcgagtcatttcgttccctgattatttatccttgtctgaatgtatttatgtgtatatttgtagatttatccagccgagcttaggaattcgcttccaggccgtgggggccacatttcacctccttagtccccctggtctgaactagttgagagagtagttttgaacagtcgtaaccgtggctggtgtttgtagttgacataaaggattaagaccgcaaattgtccttcatgggtagagtcaggaagcccggtggcgtggcacaacacactttggtcatttctcaaaaaccacagtcctcaccacagtttattgatttcaaattgtctggtactattggaacaaatatttagaataaaaaaatttcccagt

SEQ ID NO: 103462 - DNA, 384 bp, Homo sapiens
  Payload ID: 217
  Gene Symbol:
  Gene Name: AC009491.1
  ENST ID: ENST00000624237
  CDS Start-End: 1-384
atgcacctccacagacatcttctctgccaagccacagggacttgtggcaacggtgacattcatgctgtctccgtggtctgttcccacaggaggaggtgtttagactctgaggaggttactgagatctgctcttctgacttcattcctggaagagactgtgtgggagaatcaggtcccatgattggaatgttgtctcgctcacaggggctcttggggaaaggcaggcagcatgacaaaggcaagtcaaaagtagagcagagttcttataccttgaactggcctcccatgggtgcaggtgaaggtgcaggaccccatccacctctcaccagcttatatcctcacctttatctgatgatatggctactcaaactctctgtcctaaaa

SEQ ID NO: 103463 - DNA, 384 bp, Homo sapiens
  Payload ID: 218
  Gene Symbol:
  Gene Name: AC009491.2
  ENST ID: ENST00000623558
  CDS Start-End: 1-384
atgcacctccttggaggtctccttctccagcaatctgcagagacttggccccttctggctgtctctgttgtcgggtctcactggaggaggaggtgttttgactgtgaggtcatcactagaaactgctcttctgactctattcctgaaagaggcagtgtgcaagaaataggtcccatggggattggaatactgtctgtttcacagggtctctctcagataggcaggaaacatgacaaaggcaagtccaaattggagaagtactctcacacctcaaactggcctctcacacatgcaggtgaaggagtgggaccccatccacccctcaccagattgcatcttcaaccctatctgacctttttgctgcttatactctctgtccctgaa

SEQ ID NO: 103464 - DNA, 945 bp, Homo sapiens
  Payload ID: 219
  Gene Symbol:
  Gene Name: AC009758.1
  ENST ID: ENST00000623472
  CDS Start-End: 1-945
atgcctactgtaaaccacagtggcactagccacacagtcttccacttgctgggcatccctggcctacaggaccagcacatgtggatttctatcccattcttcatttcctatgtcaccgcccttcttgggaacagcctgctcatcttcattatcctcacaaagcgcagcctccatgaacccatgtacctcttcctctgcatgctggctggagcagacattgtcctctccacgtgcaccattcctcaggccttagctatcttctggttccgtgctggggacatctccctggatcgttgcatcactcagctcttcttcatccattccaccttcatctctgagtcagggatcttgctggtgatggcctttgaccactatattgccatatgctacccactgaggtacaccaccattcttacaaatgctctgatcaagaaaatttgtgtgactgtctctctgagaagttatggtacaattttccctatcatatttcttttaaaaagattgactttctgccagaataatattattccacacaccttttgtgaacacattggcctagccaaatatgcatgtaatgacattcgaataaacatttggtatgggttttccattctaatgtcgacggtggtcttagatgttgtactaatttttatttcctatatgctgattctccatgctgtcttccacatgccttctccagatgcttgccacaaagctctcaacacatttggctcccatgtctgcatcatcatcctcttttatgggtctggcatcttcacaatccttacccagaggtttggacgccacattccaccttgtatccacatcccgttggctaatgtctgcattctggctccacctatgctgaatcccattatttatgggatcaaaaccaagcaaatccaggaacaggtggttcagtttttgtttataaaacagaaataa

SEQ ID NO: 103465 - DNA, 1668 bp, Homo sapiens
  Payload ID: 220
  Gene Symbol:
  Gene Name: AC009950.1
  ENST ID: ENST00000540870
  CDS Start-End: 1-1668
atggggaggggcttcaggatgttcaccatgacaagagccatggaagaggctctttttcagcacttcatgcaccagaagctggggatcgcctatgccatacacaagccatttcccttctttgaaggcctcctagacaactccatcatcactaagagaatgtacatggaatctctggaagcctgtagaaatttgatccctgtatccagagtggtgcacaacattctcacccaactggagaggacttttaacctgtctcttctggtgacattgttcagtcaaattaacctgcgtgaatatcccaatctggtgacgatttacagaagcttcaaacgtgttggtgcttcctatgaatggcagagcagagacacaccaatcctacttgaagccccaactggcctagcagaaggaagctccctccataccccactggcgctgcccccaccacaaccccctcaaccaagctgttcaccctgtgcgccaagagtcagtgagcctggaacatcctcccagcaaagcgatgagatcctgagtgagtcgcccagcccatctgaccctgtcctgcctctccctgcactcatccaggaaggaagaagcacttcagtgaccaatgacaagttaacatccaaaatgaatgcggaagaagactcagaagagatgcccagcctcctcactagcactgtgcaagtggccagtgacaacctgatcccccaaataagagataaagaagaccctcaagagatgccccactctcccttgggctctatgccagagataagagataattctccagaaccaaatgacccagaagagccccaggaggtgtccagcacaccttcagacaagaaaggaaagaaaagaaaaagatgtatctggtcaactccaaaaaggagacataagaaaaaaagcctcccaggagggacagcctcatctagacacggaatccaaaagaagctcaaaagggtggatcaggttcctcaaaagaaagatgactcaacttgtaactccacggtagagacaagggcccaaaaggcgagaactgaatgtgcccgaaagtcgagatcagaggagatcattgatggcacttcagaaatgaatgaaggaaagaggtcccagaagacgcctagtacaccacgaagggtcacacaaggggcagcctcacctgggcatggcatccaagagaagctccaagtggtggataaggtgactcaaaggaaagacgactcaacctggaactcagaggtcatgatgagggtccaaaaggcaagaactaaatgtgcccgaaagtccagattgaaagaaaagaaaaaggagaaagatatctgttcaagctcaaaaaggagatttcagaaaaatattcaccgaagaggaaaacccaaaagtgacactgtggattttcactgttctaagctccccgtgacctgtggtgaggcgaaagggattttatataagaagaaaatgaaacacggatcctcagtgaagtgcattcggaatgaggatggaacttggttaacaccaaatgaatttgaagtcgaaggaaaaggaaggaacgcaaagaactggaaacggaatatacgttgtgaaggaatgaccctaggagagctgctgaagagtggacttttgctctgtcctccaagaataaatctcaagagagagttaaatagcaagtga

SEQ ID NO: 103466 - DNA, 99 bp, Homo sapiens
  Payload ID: 221
  Gene Symbol:
  Gene Name: AC009977.1
  ENST ID: ENST00000623231
  CDS Start-End: 1-99
aaacataaaaaaaaggtgatagaaagatggagtctcgctctgttgcccaggctggagtgcagtggggcaatcttggctcactgcaagctccgcctccca

SEQ ID NO: 103467 - DNA, 69 bp, Homo sapiens
  Payload ID: 222
  Gene Symbol:
  Gene Name: AC010184.1
  ENST ID: ENST00000629935
  CDS Start-End: 1-69
agagcagcagccccggcccacgccgccccgtcgagatcttgccccgcaggctctgcaacactcgaacct

SEQ ID NO: 103468 - DNA, 599 bp, Homo sapiens
  Payload ID: 223
  Gene Symbol:
  Gene Name: AC010287.1
  ENST ID: ENST00000623879
  CDS Start-End: 77-439
actaactacaaaggggaacaaggaaacctcttgggagataatgaaaatattctgcatcagccaggcatggtagtttatgcctataatcccatcactgtgggaggcaggaagatcacttgaggccaggagttccaaaatattctgtatcttgattgtggtggtagttacacaactgtataaatttgtcaaaattcaaagaactatacacctaaagggaagacttctactgtacgaagtatacctcataaataaccaaccaaaaaacctctgttctcattttagttttcctaccacttatattaaaaaagagaggctttggctgggcccagtggctcacacctataatcccagcactctgggaggccgaggtgggtggatcacccgaggtcaggagttcaagaccagcctggccaacatggtggaaccctgtctctactaaaaatacaaaaattagctgggtgcagtggcacgcgtctgtaatcccagctacttgagaggctgaggcaggagaatcgcttgaactcaggaggcggaaggtgcagtgggcccagattgcaccactgcactctagcctgggggacagagcaagactccatctc

SEQ ID NO: 103469 - DNA, 375 bp, Homo sapiens
  Payload ID: 224
  Gene Symbol:
  Gene Name: AC010412.1
  ENST ID: ENST00000624832
  CDS Start-End: 1-375
atgactcttaacgagcatgctgccttcaagcatctgtttaacaaagcacatcttgcaccgcccttaatccattcaaccctgagtggacacagcacatgtttcagagagcacagggttgggggcaaggtcacagatcaacaggatcccaaggcagaagaatttttcttagtacagaacaaaatgaaaagtctcccatgtctacctcttcctacacagacacagcaaccatccgatttctcaatcttttctccacctttccccattttctattccacaaaactgccattgtcatcatggcccgttctcaatgagctgttgagtacacctcccagacggggtggtggccgggcagaggggctcctcacttcccagtag

SEQ ID NO: 103470 - DNA, 3677 bp, Homo sapiens
  Payload ID: 225
  Gene Symbol:
  Gene Name: AC010547.9
  ENST ID: ENST00000561908
  CDS Start-End: 504-788
agcggtgcgcttctggcctgttttgagtccgcgctcaaaggtgccaaagtgcaaggacccacagttgggcggagcttgggttgggagtgagacagcatagcagtccaggctggtcctttgagcgcagctcaaagaaggggacggggagggcgtcactatacaattgtggccgggtgggacctgggctgtttgctcttggaggctgtacagctgcaagctttgccgctcacgaactggagctggagaaagagccccccaaggatgggaggatgacagaagtgtctgcagatggcactgcctgggcaccaggagaggtctctgaggatccccgggtggaaactcctcccgggagtaaaaccacacaaccactgagaagaccgctccggcatcctagagagtacgcgtgtgagcctgggtgcaaggccaaagtagtgacgcacttccgttcacgcaccgctttctgtttttcctgagcctttgcctgctaagagggagaccaggtcatggcagccatgcctctgaaagctcaataccaggagatggtgaccttcgaggatgtggctgtgcacttcaccaagacagaatggactggcctttctcctgcccagagggccctgtacagaagtgtgatgttggagaattttgggaacctgactgctttggggtacccagttcccaaacctgcactgatctcacttttggagagaggggacatggcttggggcctggaagcacaggatgatcccccagcagagaggaccaaaaacgtctgtaaagttattctctagctgaggatgatgatgttgaacaagatagatacagtgtctgttccctgcagccaccagagaagacagacatataaataaactatcaccattaagggtaacagtcaccgtgggccagacccgagctagccgacagggatgcggccacagctggccgggcgtgaccaccaccgaggcgcagcgaccttgctcctagagaggcccggccgcctggtgacgcacttccggcagcgccggggagcagtccgctacggagctccagcccttctctgagacggggaccaggggatggcagccatgcacctgacagcctggccccagggacttcacggatcccctgaagctcatccatggacttccatggactacagaagtcggtgacctttgaggacgtggctgtgtacttcacccaggcggaatgggatggcctgtcccctgcacagaggaccctgtacagggatgtgatgctggagaattatgggaatgtggcctccctgggatttccacttctcaaacctgctgtgatctcacaactggagggaggaagtgagctggggggctcatctccactggctgcaggaacaggcctccagggcctccagactgtagatattcagactgacaatgatttgacaaaggaaatgtatgaaggaaaagagaatgtatcatttgaacttcaaagagacttttcccaggaaacagacttttcagaagcctctcttctagagaaacaacaggaagtccactcagcaggaaatataaagaaggagaagagcaacaccattgatggaacagtgaaagatgagacaagccccgtggaggagtgtttttttagtcaaagttcaaactcatatcagtgtcataccatcactggagagcagccctctgggtgtacaggattggggaaatccatcagctttgatacaaaactcgtgaagcatgaaataattaattctgaggaaagacctttcaaatgtgaagaattagtagagccctttaggtgtgactctcaacttattcaacatcaagagaacaacactgaggaaaagccttatcagtgttcggagtgtggcaaagctttcagcattaatgagaaattaatttggcatcagagacttcacagtggggagaaacccttcaaatgtgtggagtgtgggaaaagcttcagctacagttcccattatatcacacatcagacaatccacagtggggagaagccctatcagtgtaagatgtgtgggaaggccttcagtgttaatggaagcctaagtaggcatcagagaatccatacgggagagaagccctatcagtgcaaggaatgtggaaatggcttcagctgtagttctgcatatattacacatcagagagtccacactggagagaaaccttacgagtgtaatgactgtgggaaagcgttcaatgttaatgcaaaattaattcaacatcagagaatccatactggagagaaaccttatgaatgtaatgaatgtggaaaaggcttcaggtgcagctcccagcttaggcagcatcagagcatccacacaggagaaaagccctatcagtgtaaagagtgtggaaaaggcttcaataataatacaaaactcattcagcatcagagaatccacacaggtgagaaaccctatgaatgcactgaatgtggaaaagccttcagtgtcaaagggaagttaatccaacaccagagaattcacacaggcgagaaaccctatgagtgtaatgaatgcgggaaagccttcagatgtaactcccaatttcggcagcatctgagaattcacactggggagaagccctatgagtgtaatgagtgtggaaaggccttcagcgttaatgggaaactaatgcggcatcagagaattcacactggggagaaaccttttgaatgtaatgagtgtgggagatgctttacttctaaaagaaacctacttgatcatcaccgaatccatactggagaaaagccctatcaatgtaaggaatgtgggaaagccttcagtatcaatgccaaactaactaggcatcagaggatacatactggggagaaacctttcaaatgtatggaatgtgagaaagcattcagctgtagttctaactatattgtgcaccagagaatccatacaggagagaaaccctttcagtgtaaggagtgtggaaaagccttccatgttaatgcccatttaattcggcatcagagaagccacactggggagaaacccttcagatgtgtggaatgtggcaaaggcttcagctttagttctgactacattatacatcagacagtccacacttggaagaaaccctatatgtgtagtgtgtgtgggaaagcattcaggtttagcttccagctcagtcagcatcagagtgtccatagtgaaggaaaatcctaataatgagaaagatatagaaaactcttaaggttaatgccaaaatggatcaagtatcatcagattcatccattgaaaaacctccaagagggcatgaatatggcagagtcttcatatggaaacagtttttattctattcagtttaaatcaggaaaggatgaccagttaaagagaaacatccaaaaatagctttgttttgtaccaacaggaattagaaaatataatgaaaagatttcgttcccagcagcatcaagaaaagtagattttctagaaataaacagttatggaggacttgtatggagaaatttaagtcttcactgagggccactttacaaaggaaatttgaataaatggagagagagagaagccttgttgttggataggaaaacccgtactaaagatactctacctacattaatttatttgtttaatttttgacaacaagcatgtattacttttgaaaagatgaaaaataaagatttatttaaaaaaggaa

SEQ ID NO: 103471 - DNA, 4227 bp, Homo sapiens
  Payload ID: 226
  Gene Symbol:
  Gene Name: AC010642.1
  ENST ID: ENST00000591325
  CDS Start-End: 117-530
gtcgccggtgcggccgccattgtccggcgttcggcgagtcgggtggtccctttggctggagtgcctctctggtctggggatcacctcaggcgctgtccttcactgggcgatccagcatggaccccgaggacgaaggggtagcgggagtgatgtctgtggggccgccggcggcccggcttcaggtaacaataacaacaataacgacggcggcgggctccgggcaagcgtctcccgcgcagactgaccctttcacctcgcggcgcgatgagagcggcaccgctgttaatgcccttgacacgtggggaaactcagacgcgggtcggggcgtggtgaccgtcctggctggtcagagagggggccgggattccaaccaggcgcctggcccccgaatgcgcatgctccacgcggctctgtcctccccagggctggggtcggtcattcccgagagaatcgagcaggcccatctcctgcgttctgctccgccccgccgacacccttgcccattccaggaaggtctgtcctcgtgttgactgataacagtaattgtagcgttggccgggtgcccagatggcaagaatcatcgaatagagatgctttaacgcgtggagtcagcggacacccaccgggaccccagcaccgcggagcccctgccctggggcttgggcacaacctcttgggggcaatgatgggtcaccacgcactgagtgtgatgagagtgaccaccagggtcgtcccctgcgagactgtgggagaactgcagtgcagggcggtcagtgtttgcagggccatctggccatcagagctccactttctagacaaagtggttgcggcctgtgttctccataaagctgcctcgcgtggcaggaaacaacaataattatccttcctcaagctctgcaactttgaaattatacttttttttattttttgtcgttggtttgttcatggggatttgcattatttcagatttggtacacaaagtgagacttgataatcttaggttgcaggttttcagatgtgtgttgctccaaatttgcatgaaatgctaccacgttttattttgttcttgctgtggatgggggacaaggaatgagtcgtaagaaaggcttgagagaaagtgtattagttacctgttgctgtgtaactcaaaacttcgtgacctggaacaacaataaatatctcacgagttctgacaggagtaatggaatgtcctagctggtggttctggttcaggcccatgaagttacagtgaagatgtcagcatagctgttgtcacctgagacctgagtctggaggatccacctccaggatggctcactcacatgtctgttgataggagacctcagttgttctccatgtaggcctctctttggaactgctagggatccttgcaacatggcatctggcttcccacagaacaagtgatccaggagagggcaaggtagaaactgtaacaccttccatgacctggattcagaattcacactcttgtcacttccacggtgtcttactggttacaaagtcaaccttgttgagtgttggaggggaccacaccagggctggaggtcattggcagaggtggtgggggagcatcttggagactgtccatcacaggagacaaggaccagaatggagagcttcaaggaaccagtgaccttccgggatgtggctgtggactttacccaggaggaatgggggcagctggaccctacccagaggatcctctaccgtgacgtgatgctggagacctttggtcacctgctctccataggtcctgagcttccgaagcctgaagtcatctcccagctggagcaagggaccgagctatgggtggctgagagaggaaccacccagggctgccatccagcctgggagcctcgatctgaaagccaagcatcacgcaaggaagagggcctgcctgaagaggagccatcccatgtcacgggaagggaaggattcccgacagatgctccttatcccaccacgttagggaaagacagggagtgtcagagccagagtctggcactcaaggagcagaataacttgaagcagttggaatttggcctcaaggaagcaccagttcaagatcaaggctacaaaactctcagactcagggaaaactgcgtcctgagttcaagcccaaatccattcccagagatctctagaggggagtatttgtatacttacgactcacagattacagactcagaacataactccagcttagtcagtcagcagacaggctccccaggaaaacagcccggtgaaaacagtgactgtcacagagattccagtcaggccattccaattacggaactcacaaaaagccaggtgcaggacaaaccctacaaatgtactgactgtgggaagtcgtttaaccataacgcacacctcaccgtgcacaagaggattcatacgggagaaagaccttatatgtgcaaggagtgtgggaaagccttcagccagaactcctccctcgtccagcatgagcgcatccacactggagacaagccctacaagtgtgccgaatgtgggaagtctttctgccatagtacacaccttaccgtccatcggaggattcacactggggagaagccctatgagtgtcaggactgtgggagggccttcaaccagaactcctccctggggcggcacaagaggacacacactggggagaagccatacacctgcagtgtgtgtgggaaatccttctctcggaccacttgccttttcctgcacctgagaactcacaccgaggagaggccctacgagtgtaaccactgcgggaagggcttcaggcacagctcatccctggcccagcaccagcggaagcacgcgggggagaagccctttgagtgccgccagaggctgatctttgagcagacgccagctctcacaaagcatgaatggacagaagccctgggctgtgacccacctttgagtcaagatgagaggactcaccgaagcgacagacccttcaaatgtaatcagtgtgggaagtgtttcattcagagctctcacctcatccggcaccagataactcacaccagagaggagcagccccatgggcgaagccggcggcgtgaacaatcctcgagcaggaactcacacctggttcagcatcaacacccgaactccagaaagagctctgcaggcggagcaaaggcagggcagccggaaagcagagccctggctttgtttgacatccaaaaaatcatgcaagagaaaaaccctgtgcacgttattggggtggaagagccttctgtgggtgcttccatgttatttgacatcagagaatccacataggagagaaactttgctgatgacttttaaccacaagtaaaaaatgtgaagcaaccgtgacaagtggtgcccgaccagggacctgaacgaggaaggtctgccagagcagagaaagtgaaactgatcagacgaactacgaacccctggacgggagagtctgccggcggagaatataaggagatggacaaaccgtgtgggtgccctccaggtgtgtgtgaccatggaacgggagaccggagggatccatggtattcaaccgtgggcctgttacctccagtacgagccatgagccagcggaatctgaatgcaaagacagaacaagggccgaccggagtcacaatgacatccaaccccataacatggggacagatcaagaaaacgacacaagaagctgagaaactactggagcgccagggtcaggcaaaaacccctgactccatgttcttggccatgctagctgtagtgtcctgtgcgtctataggatcgggtgaaccaccaaccggcaattgaaagctgcacagcctgaaattacctttattcaattaatgcaaaaacaaaaggggagatgttggaggccgaaggaatgagggtcgtgaccaactcagtataccactggaggctctgtgagcaaacagcaaactgttctcatgaaagcaggatgttggcgaactgacaaactctgtctgccgccagaaggaatgctgggggcagtcatgtcccaggtcccgtgctccttgaggttatccacaggaacatccagaacctgttgaacaaagaaaggaatcatgtgggcctgtgttaaatcaaatagctgaccgacagttatcccttcctccctattcactctacctaataaatatgaagggctgtaaaagctcaggtccctgttccctaatatcaaggagccccctgaccccttctttc

SEQ ID NO: 103472 - DNA, 515 bp, Homo sapiens
  Payload ID: 227
  Gene Symbol:
  Gene Name: AC010646.3
  ENST ID: ENST00000594059
  CDS Start-End: 377-515
aaacagcagtggcggacatagcagcggaggtggcagcagcggggacgaggaagagtggtatcagggccttcctgctgtccctggtggcaccagtggcattgatggtggccaggtgggcagagcctgggacccagagaagttagcccaggaactggcagcatcgctcaccaggacactggacctgcaggagcagctgcagtctctgcgcagggagctggaacaggtggctcagaaggggcgagccagacggtctcagagtgccgagctgaacagggatttatgcaaagcccacaggtccaaccgtgactgccagatcgaccagcaccaccggaaccagtgccagtactgccgtctcaagaagtgcttccgggtgggcatgaggaaggaggcggtgcagcgcggccgcatcccgcactcgctgcctggtgccgtggccgcctcctcgggcagccccccgggctcggcgctggcggcagtggcgagcggcggagacctcttcccggggcagccggtgt

SEQ ID NO: 103473 - DNA, 66 bp, Homo sapiens
  Payload ID: 228
  Gene Symbol:
  Gene Name: AC010655.1
  ENST ID: ENST00000624208
  CDS Start-End: 1-66
agtcatttattcaacaactatttattaaatgtcaagatgaccttgggctcagtatttgcatcagtt

SEQ ID NO: 103474 - DNA, 1468 bp, Homo sapiens
  Payload ID: 229
  Gene Symbol:
  Gene Name: AC011043.2
  ENST ID: ENST00000611619
  CDS Start-End: 97-459
tactcactatcagaagttctctgttttgaaaaaagaataactgatgtgataaatttatgtaatttaacaattaatctacctcacgtgcttgtaggtatgtattcatttcctaccaccgtagtggaagagagactatccctatcaatacacctggtaacattcccaacagtaagccgtgagattctgcttgaaatcacctctcagacaaataaaaaacagtcctgggaaatgtacgacactcattctgctaaagaaataggcatcatagctggggaacagattcaaaagacccaggctgttccctacatatgtttcctcctcagacatcagttaatcagtcaatcaagtcaagtgagagtggaggccatgtattccctcttattcttgggcactctcctccaaggaggaaaaggccaggaggtcctgttagaggatgcactcagagcccgggctccctaaggtatgagagttctaaccagcaggtgtagacttttcaggagtgaggaatgaggcaggcattccaaacctggagcttcatcaccttttgtttcatctcaagacaattctgaggggctgttttggagcgtgtctggaaggtgaacgttgaagaagagtgtgggctttgatgtgactcagatgagatctttcatggggaggcaggaattcaatgcccagaatctgggctggtgtctttgaggtcagtaggttgcctctttgtatccaagtccattgttactaaattggaggctggagattctaaatggcttccagaccatctctctgattctctttgggagattgggtctgaaaaagacaatgtcagtatttttgggaaattctagaaagtctgcttggaaacctgggaagacctcttgcctagtgcctaaatattcaatgtgcagctctagccatgtagatgcttggtaggtatagagctgggttttcatttatatcagcaaaacctatgtcagagttgaagaagtagtcaagacaaagtgtcttggtcgcaggccggggaacatcttaaaagcaaacttctagcctgatgactcttggcaatgagtgttgggtcctggctaaagtgccttgaatgcagcatgaggccaatccatgaatccaacttccaatggagaaatgttaatattttttcagtttgaatcaatcagggtgaaattaccttgctattggtttgcttactttttattatttcatataaaatctaagacaaaatacattaaatgcttattgatatatgtatttattcttcacctggctcataatatttgcctaattttaaactttcttctattttgtaggtttcaacttatttcattgtaagatattgttaaatctaatacgggcattgtcacttttacaaataattttattttatttcatgtatttcctattcactttttacatttaaattatggaccatttcatcatataaaaagctccatttctattt

SEQ ID NO: 103475 - DNA, 216 bp, Homo sapiens
  Payload ID: 230
  Gene Symbol:
  Gene Name: AC011155.1
  ENST ID: ENST00000623202
  CDS Start-End: 51-176
gcacaaagcacttcttgttacagagagaaatgttttgattcattatttcaggaaaggatgccaaggaaaaaaagcagctgacttacaacagcagttcgtacatttcctggactgttgggatgtatcatgtattccatttacattgcacctgcctcaggcacaggatatcactacgtaagagcaaacatattggcaagtaacaatatggtgtatgtg

SEQ ID NO: 103476 - DNA, 498 bp, Homo sapiens
  Payload ID: 231
  Gene Symbol:
  Gene Name: AC011295.1
  ENST ID: ENST00000610645
  CDS Start-End: 13-408
agaacggaccagatgggtccagcagtgctgggtcaaggcgaggaggggcagccggaagcgcgcgcatgctctggactcctgcagccgccgaaacggccaatcgtgtttaaggagaaactaacaatgaaaacggactcgttgatggaggaaaagttggaatgcagcctctggtgctgtttgagcgatccctctaccccgggtcgctgctgtgttctggaaaggcgcattgtaccctggatgcagcaggaatcctattcatcttcttcaccgatatggtctgtggactctgatgagccaaatctgacatcagttctggaacgtctagaagatactaaggacaacagttcggtaaggaaagaaaccaagctattttctcttttcctcatgaacattatatttagaaattaaatgttaaatgataatattatataaaaacatgattaataactataatcttagaggaattaaagtctgggtattttaagtcctccaaatctt

SEQ ID NO: 103477 - DNA, 48 bp, Homo sapiens
  Payload ID: 232
  Gene Symbol:
  Gene Name: AC011380.1
  ENST ID: ENST00000626887
  CDS Start-End: 1-48
aactcacaatcaggtactcgggaggctgagactgggagaaggaaaaaa

SEQ ID NO: 103478 - DNA, 578 bp, Homo sapiens
  Payload ID: 233
  Gene Symbol:
  Gene Name: AC011513.3
  ENST ID: ENST00000598976
  CDS Start-End: 121-578
aagagactcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaa

SEQ ID NO: 103479 - DNA, 277 bp, Homo sapiens
  Payload ID: 233
  Gene Symbol:
  Gene Name: AC011513.3
  ENST ID: ENST00000435837
  CDS Start-End: 76-277
acagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccacccaccactgccaagctcactattgaatccacgccgttcaatgtcgcagaggggaaggaggttcttctactcgcccacaacctgccccagaatcgtattggttacagctggt

SEQ ID NO: 103480 - DNA, 397 bp, Homo sapiens
  Payload ID: 234
  Gene Symbol:
  Gene Name: AC011530.4
  ENST ID: ENST00000596586
  CDS Start-End: 1-397
ccccttgtgtgcaagaagatcgcccaggagcggctcacagtcctcctgttcctggaggactgcatcatcactgcctgccaggagggcctcatctgcacctgggcccggccgggcaaggcgttcacagacgaggagaccgaggcccagacaggggaaggaagttggcccaggtcacccagcaagtcagtggtagaggagctgggcgcctccgaactggcccaggacaagtacgtggccgacttcttgcagtgggcggagcccatcgtggtgaggcttaaggaggtccgactgcagagggacgacttcgagattctgaaggtgatcggacgcggggcgttcagcgaggtagcggtagtgaagatgaagcagacgggccaggtgtatgccatgaagatca

SEQ ID NO: 103481 - DNA, 321 bp, Homo sapiens
  Payload ID: 234
  Gene Symbol:
  Gene Name: AC011530.4
  ENST ID: ENST00000595946
  CDS Start-End: 1-321
ccccttgtgtgcaagaagatcgcccaggagcggctcacagtcctcctgttcctggaggactgcatcatcactgcctgccaggagggcctcatctgcacctgggcccggccgggcaaggcggagctgggcgcctccgaactggcccaggacaagtacgtggccgacttcttgcagtgggcggagcccatcgtggtgaggcttaaggaggtccgactgcagagggacgacttcgagattctgaaggtgatcggacgcggggcgttcagcgaggtagcggtagtgaagatgaagcagacgggccaggtgtatgccatgaagatc

SEQ ID NO: 103482 - DNA, 558 bp, Homo sapiens
  Payload ID: 234
  Gene Symbol:
  Gene Name: AC011530.4
  ENST ID: ENST00000593999
  CDS Start-End: 1-398
cgggtgtggcggcagagcctggcacaccattcagcattggccgcttcgccacgctcacactgcaggagcggcgggaccggggggcagagaaggagcacaagcgctaccacagcctgggcaacatcagccggggtggcagtggcggcagtggcagtggtggggagaagcccagcggccctgttccccgcagccgcctggaccccgccaaggtgctgggcactgcgctgtgcccgcgcatccacgaggtgcccctgctggagccccttgtgtgcaagaagatcgcccaggagcggctcacagtcctcctgttcctggaggactgcatcatcactgcctgccaggagggcctcatctgcacctgggcccggccgggcaaggcgcggagcccatcgtggtgaggcttaaggaggtccgactgcagagggacgacttcgagattctgaaggtgatcggacgcggggcgttcagcgaggtagcggtagtgaagatgaagcagacgggccaggtgtatgccatgaagatcatgaacaagtgggacatgctgaagaggggcgaggt

SEQ ID NO: 103483 - DNA, 432 bp, Homo sapiens
  Payload ID: 234
  Gene Symbol:
  Gene Name: AC011530.4
  ENST ID: ENST00000597712
  CDS Start-End: 1-171
ccccttgtgtgcaagaagatcgcccaggagcggctcacagtcctcctgttcctggaggactgcatcatcactgcctgccaggagggcctcatctgcacctgggcccggccgggcaaggcgccccaaatccagggttttccaaagtgtggttcaagaaccacctgcatctgaatctagaggtactggatacaaccccacgtctgggccgttacccaggacattctacatgagaacgtgggggtggggccctggctgcacctgaactgtcacctggagtcagggtggaagcggagcccatcgtggtgaggcttaaggaggtccgactgcagagggacgacttcgagattctgaaggtgatcggacgcggggcgttcagcgaggtagcggtagtgaagatgaagcagacgggccaggtgtatgccatgaagatca

SEQ ID NO: 103484 - DNA, 1468 bp, Homo sapiens; identical to SEQ ID NO: 103474
  Payload ID: 235
  Gene Symbol:
  Gene Name: AC011841.1
  ENST ID: ENST00000621382
  CDS Start-End: 97-459

SEQ ID NO: 103485 - DNA, 406 bp, Homo sapiens; identical to SEQ ID NO: 103428
  Payload ID: 236
  Gene Symbol:
  Gene Name: AC012005.3
  ENST ID: ENST00000624575
  CDS Start-End: 28-105

SEQ ID NO: 103486 - DNA, 501 bp, Homo sapiens; identical to SEQ ID NO: 103427
  Payload ID: 237
  Gene Symbol:
  Gene Name: AC012005.4
  ENST ID: ENST00000624333
  CDS Start-End: 13-411

SEQ ID NO: 103487 - DNA, 711 bp, Homo sapiens
  Payload ID: 238
  Gene Symbol:
  Gene Name: AC012314.2
  ENST ID: ENST00000617291
  CDS Start-End: 57-641
ctctttctcagtgaccgggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttac

SEQ ID NO: 103488 - DNA, 476 bp, Homo sapiens
  Payload ID: 238
  Gene Symbol:
  Gene Name: AC012314.2
  ENST ID: ENST00000629607
  CDS Start-End: 57-476
ctctttctcagtgaccgggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagccctcggaggtga

SEQ ID NO: 103489 - DNA, 711 bp, Homo sapiens; identical to SEQ ID NO: 103487
  Payload ID: 239
  Gene Symbol:
  Gene Name: AC012314.3
  ENST ID: ENST00000616928
  CDS Start-End: 57-641

SEQ ID NO: 103490 - DNA, 476 bp, Homo sapiens; identical to SEQ ID NO: 103488
  Payload ID: 239
  Gene Symbol:
  Gene Name: AC012314.3
  ENST ID: ENST00000626065
  CDS Start-End: 57-476

SEQ ID NO: 103491 - DNA, 711 bp, Homo sapiens; identical to SEQ ID NO: 103487
  Payload ID: 240
  Gene Symbol:
  Gene Name: AC012314.5
  ENST ID: ENST00000618751
  CDS Start-End: 57-641

SEQ ID NO: 103492 - DNA, 476 bp, Homo sapiens; identical to SEQ ID NO: 103488
  Payload ID: 240
  Gene Symbol:
  Gene Name: AC012314.5
  ENST ID: ENST00000630768
  CDS Start-End: 57-476

SEQ ID NO: 103493 - DNA, 711 bp, Homo sapiens; identical to SEQ ID NO: 103487
  Payload ID: 241
  Gene Symbol:
  Gene Name: AC012314.6
  ENST ID: ENST00000620720
  CDS Start-End: 57-641

SEQ ID NO: 103494 - DNA, 476 bp, Homo sapiens; identical to SEQ ID NO: 103488
  Payload ID: 241
  Gene Symbol:
  Gene Name: AC012314.6
  ENST ID: ENST00000625297
  CDS Start-End: 57-476

SEQ ID NO: 103495 - DNA, 711 bp, Homo sapiens; identical to SEQ ID NO: 103487
  Payload ID: 242
  Gene Symbol:
  Gene Name: AC012314.7
  ENST ID: ENST00000616839
  CDS Start-End: 57-641

SEQ ID NO: 103496 - DNA, 476 bp, Homo sapiens; identical to SEQ ID NO: 103488
  Payload ID: 242
  Gene Symbol:
  Gene Name: AC012314.7
  ENST ID: ENST00000627525
  CDS Start-End: 57-476

SEQ ID NO: 103497 - DNA, 711 bp, Homo sapiens; identical to SEQ ID NO: 103487
  Payload ID: 243
  Gene Symbol:
  Gene Name: AC012314.9
  ENST ID: ENST00000610953
  CDS Start-End: 57-641

SEQ ID NO: 103498 - DNA, 476 bp, Homo sapiens; identical to SEQ ID NO: 103488
  Payload ID: 243
  Gene Symbol:
  Gene Name: AC012314.9
  ENST ID: ENST00000630852
  CDS Start-End: 57-476

SEQ ID NO: 103499 - DNA, 42 bp, Homo sapiens
  Payload ID: 244
  Gene Symbol:
  Gene Name: AC012363.2
  ENST ID: ENST00000631153
  CDS Start-End: 1-42
ttgtcaggtaatgaaagcaaagggcattcatcattgtcactc

SEQ ID NO: 103500 - DNA, 1653 bp, Homo sapiens
  Payload ID: 245
  Gene Symbol:
  Gene Name: AC013269.5
  ENST ID: ENST00000409259
  CDS Start-End: 197-646
gggaagcaggggcagagcgctcaggccagggccggcgggggcactgcgcactggccgcctccctcctctggccaatcctcctgccgctgcgcgtctagtccacctcgtccctctctgcaggtccactaacccatctgattaccggatcctgcttgggtatgaccagcaaagccatcccacagagcacagcaagcagatgacagtgaataagatcatggtgcacgctgactataacgagttgcaccgcatggggagtgacatcaccctgctgcagctgcaccatcatgtggaattcagctcccacatcctccccgcctgccttccggaaccaaccacgtggctggcccctgacagctcctgctggatatctggttggggaatggtcaccgaggatgtcttcctgcctgagcccttccaacttcaggaggcagaggtcggtgtcatggacaacactgtctgcggatcctttttccagccccagtaccccggccagccaagcagcagtgactacaccatccacgaggacatgctgtgcgctggggacctcataacaggaaaggccatttgccgatgcggggaactgaggcccagagaggaagtgtatcacccaagcgagactccaggggtcccctcgtctgcccattaaatggcacctggttcctgatggggctgtctagttggagcctcgactgctgctcacccgtcggtcccagggtcttcaccaggctcccctacttcaccaactggatcagccagaagaagagggagagcacccctccagatcccgccttggctcctcctcaggaaacacccccagccctggacagcatgacctctcagggcatcgtccacaagcccgggctctgcgcagcccttctggctgctcacatgttcctcctgctgctgattctcctggggagcctgtgaagggccagggcccctggcctcttaccacaagcatgcccacctcaggccggcctccttgctgagctctgcacactcctgacgtgtttccatctctgagctctcctgtccacccaaggccacccctgcctcaggcctgacaaactaaaaaccacccaagaagcttcttgctctggtttctggcccaccagagccatctcccatgctccactgtgtctccagctcctcagggagggaaggtctccctcctccctgggcagggtccaggctgaccatatgggagccaagtcactctccttgggaagttgggtcgcgcagactcaggccccattcgggtcctccagggcatgcagtcttccagaaaaatggggccagggcctccccacatggaagaagctgcctgtcctcctggagctgggtgttgtgcaccggtcagggatgaagcggcatcttccaggtgcgcaggtcacagaggctctcctcgacagcttgcaagtaaactgtgaagggggctgaggtcttcggtcagcagtaccagagctgtgtcccatgggccagctctcagctgactgccccctgtacccgctgccctgccctctccctgcctccagaaacccagcccccatccctgtggcttgctccagcttgtaggggttgtggcttagctgacccaggacttgctggtccagcactgagcccataaaccagactctgagttgcccctgtaaa

SEQ ID NO: 103501 - DNA, 48 bp, Homo sapiens
  Payload ID: 246
  Gene Symbol:
  Gene Name: AC013286.1
  ENST ID: ENST00000629453
  CDS Start-End: 1-48
atggctgtttcggagtcaatagcttccacaccgcaaaaccactacaca

SEQ ID NO: 103502 - DNA, 603 bp, Homo sapiens
  Payload ID: 247
  Gene Symbol:
  Gene Name: AC015688.3
  ENST ID: ENST00000584605
  CDS Start-End: 1-282
tcctggagtccagtaatccaaagatgtagccagccatatggtttttcgctgctgatctctttctttttaaaatgtgtttctgaaacatcccaacaaccaccacgacaaaaaaacactgcctgcccagcgctgcaaaccaggagcacacgtcctagattcagactgttggccataaaccccactcgggagatggagctgcacctgctatttcttaaaatgacaccaccaacaaccaaacctgtcatgacagacagcaaatgtttacacgtatatttctcctgagtgaacctgatgttttacaataggctgtccccttttctgggactattcaaggaggtctccaggacggacttcagatcactgtcaatgggaccgttctcagctccagtggaaccaggtttgctgtgaactttcagactggcttcagtggaaatgacattgccttccacttcaaccctcggtttgaagatggagggtacgtggtgtgcaacacgaggcagaacggaagctgggggcccgaggagaggaagacacacatgcctttccagaaggggatgccctttgacctctgcttcctggtgcagagctcagatttcaaggtga

SEQ ID NO: 103503 - DNA, 532 bp, Homo sapiens
  Payload ID: 247
  Gene Symbol:
  Gene Name: AC015688.3
  ENST ID: ENST00000579290
  CDS Start-End: 1-200
aaacatcccaacaaccaccacgacaaaaaaacactgcctgcccagcgctgcaaaccaggagcacacgtcctagattcagactgttggccataaaccccactcgggagatggagctgcacctgctatttcttaaaatgacaccaccaacaaccaaacctgtcatgacagacagcaaatgtttacacgtatatttctcctgagtgaacctgatgttttacaataggtaataataaaaacagtctgtgcagatgcactggcactgacggccaggatggcggaaatggccatcccctctgaggaccttgtaggcggtgagggacccatgctgggccagaaggaagacaaacatggctgtccccttttctgggactattcaaggaggtctccaggacggacttcagatcactgtcaatgggaccgttctcagctccagtggaaccaggtttgctgtgaactttcagactggcttcagtggaaatgacattgccttccacttcaaccctcggtttgaagatggagggtacgtggtgtg

SEQ ID NO: 103504 - DNA, 375 bp, Homo sapiens
  Payload ID: 248
  Gene Symbol:
  Gene Name: AC016142.1
  ENST ID: ENST00000622932
  CDS Start-End: 1-375
atgactcttaacgagcatgctgccttcaagcatctgtttaacaaagcacatcttgcaccgcccttaatccatttaaccctgagtggacacagcacatgtttcagagagcacagggttggggataaggtcacagatcaacaggatcccaaggcagaagaatttttcttagtacagaacaaaatgaaaagtctcccatgtctacttctatccacacagacccggcaaccatctgatttctcaattttttccccacccttcccgcctttctattccacaaaaccgccattgtcatcatggcccatccccaatgagccgctgggcacacctcccagacggggtcgtggccgggcagaggggctcctcacttcccagtag

SEQ ID NO: 103505 - DNA, 1802 bp, Homo sapiens
  Payload ID: 249
  Gene Symbol:
  Gene Name: AC016549.1
  ENST ID: ENST00000627417
  CDS Start-End: 1149-1514
cactcattcattccaaagggtctctcaaggcaatggtaatgtgcaaggaggtgatacctaaatgaatgaccaaaagaacatgcttctgcttttgtgtgtctcctacattttagacatttgtttgtttctcttggtagcctttaaattccttgaagcccaggaccatgtctcacttacctttgtgtttccactaactagtctacctcctggaattggcagatactcagtgaaagcctgtgaaataagtgatgtctatttctagcatattattctgagatttaatgatagatttagtgattgaatgagatttccattttcaaatacagcaaaagcataactattttcattcattcatattcattcaacttcattctcaaaattaggtcctgagttaactaataattacctttgaaatgtgtgggttatttgaggcaatcaggtggtgacattgagctctcagccagagtttgtttctggaattgattcagttccattgcattgatttttgttctcagaagccaaggtttcccaggaaaaatcattcccacttgaattgggctgtgattcttgctgcgtttaagtaaaggaagcctcttggttctagttctgcaaacttacacactgaactgggacaagtttttgtttagagtaatggctgggaaaagaggaacctttcattttattcagaagtcaaaaacaaaggcctcccagccacctggagatgttttgttgcagacaccagcctggctctgtctttatgcctaacaattgagcatccagtcttctttgtgctgggaccattgctcagctctgcaaggggaaaagagggagaaagccagagctgccaggcttcttgcactggggccgggggagggttcctgggaagcaggtgctctctggcttcttggtacgtgaggctctcggagctgcctctcctctgaccctcaggtcctcaccgagtttgctccaggagtatattgaaaacatacccagtgctctctcaagcacccactgcttagagggcccagatttcttttccttctttcccttgcagagctggagactgcatcgggcatctggtgtttaaactaaacaggaaaactgactaaaggtccacagtgctcattgtgtagactagctgccctccgatgggtgctctgattatcagtggttccagtgcagggcctgtcactaaacaggcctcacttcctccttgggggctttcccatgggaggtgtggctttttactctacatggaaatgactctctgcagccacagaacacagtcattttctgaattatcccagtctctcatgcgccctggattcctccagatgccttatatctcttgtgcaaagttgtctaaaatttggttcccagcttccaagccttgccttttggccttcctggaagtatttttgttgatgagtcgtctgtcattattctctaaaatgatttgctttttgtttctttcattcctatttccaccccacatatacacacatgcttcttaacttaggggattacatgccaataaatctattgttgaaaatgcactaatactatcgcaaagatgaaaattcacaggctgaaccgttgtaagtccatatgctcctcaacttacatgtgtgatggagttatgcccaaataagtccatcgtcaagttgaaaaatcaaaatcaagccatcttaggttgaggaccatttgtttgtacctccaaagatgtcatatctttaaacatactccctagcttttctttttactttttattttgaagtaattatagaatcacagaaagttgc

SEQ ID NO: 103506 - DNA, 228 bp, Homo sapiens
  Payload ID: 250
  Gene Symbol:
  Gene Name: AC016577.1
  ENST ID: ENST00000624963
  CDS Start-End: 1-228
atgaacccatcggagatgcaaagaaaagggcctccacggagatggtatctgcaggtgtacccaacagctccgaagagacagcgaccatcgagaacgggccatgatgatgatggcggttttgtcgaaaagaaaagggggaaatgtggggaaaagcaagagagatcaaattgttactgtgtctgtgtagaaagaagtagacataggagactccattttgttatgtgctaa

SEQ ID NO: 103507 - DNA, 1640 bp, Homo sapiens
  Payload ID: 251
  Gene Symbol:
  Gene Name: AC016734.1
  ENST ID: ENST00000620528
  CDS Start-End: 72-878
cgcgtttgtagaggggtgggtgcgcacgctctgtccctgcgtgaccttccgaccccgctgtcctcaccgcaatggcggctgtgagggccctggtggcctcgaggctcgctgcggcatctgcattcacgtccctgtcccccggcggtcggacgccttcccagcgcgcagcccttcacctctccgtgccgcgccccgcggccagggtcgcgctggtgctgtctggatgcggagtctacgatgggaccgagatccacgaggcctcggcgatcctggtgcacctgagccgtggaggggctgaagtccagatctttgctcctgacgtccctcagatgcacgtgattgaccacaccaaggggcagccgtccgaaggcgagagcaggaatgttttgaccgagtctgcgaggatcgcccgtggcaaaatcacagacctggccaacctcagtgcagccaaccatgatgctgccatctttccaggaggctttggagcggctaaaaacctgagcacgtttgccgtggacgggaaagattgcaaggtgaataaagaagtggagcgtgtcctgaaggagttccaccaggccgggaagcccatcggcttgtgctgcattgcacctgtcctcgcggccaaggtgctcagaggcgtcgaggtgactgtgggccacgagcaggaggaaggtggcaagtggccttatgccgggaccgcagaggccatcaaggccctgggtgccaagcactgcgtgaaggaagtggtcgaagctcacgtggaccagaaaaacaaggtggtcacgaccccagccttcatgtgcgagacggcactccactacatccatgatgggatcggagccatggtgaggaaggtgctggaactcactggaaagtgacgcgcatggacggggcccagctaggcgccaggacttggcctcaccctctggctgaggagctgtcggctgctttccatccagctgggagtctggcaggcccttttttttttttctttgccgaaacctgcaggcgttctctctctaaggaggatgtgctgcagtgcatgggggatgtttcttcctgggtgtggctgggctgctctcacatacagaggccgaggggccaattcgttctctgccacagggacttgcctcactgtgtcccaaaaacaaatcgcagccagcttttccagaaatagaaaattctgccgtctgaggttttatacttcaggttagttagtttttggaaggaagaacatttttaggtttgcaagcctcctgatcaggaaaccagaaataccacatttatggaccatgaaaggttggttcttgactctgaagggacttttgagttaatcagcgtaaggggatttctaaagcaggcaatccctgtagccgcagagaataaacgccttcccaaaatggcaacttcccacagccacatttcagacctgctgagactgctgagtgaggaatggcagtgaggtttcttcaattagtctcagttctcttaattttcaggaagaaagggaaattgcagctcctcagcccccaggattgacctctggggagtgatggtagcgttggtgccaggccgtgggttcaggtgtggcagaagcttgcagatgcgtccgaagggaaataaagtgtgttggcgttaga

SEQ ID NO: 103508 - DNA, 1435 bp, Homo sapiens
  Payload ID: 251
  Gene Symbol:
  Gene Name: AC016734.1
  ENST ID: ENST00000620015
  CDS Start-End: 125-673
gtgctactggaaatgactgcaggccgaaccagtagggcaggaggccaccacgcgtgccaggatcctggtgcacctgagccgtggaggggctgaagtccagatctttgctcctgacgtccctcagatgcacgtgattgaccacaccaaggggcagccgtccgaaggcgagagcaggaatgttttgaccgagtctgcgaggatcgcccgtggcaaaatcacagacctggccaacctcagtgcagccaaccatgatgctgccatctttccaggaggctttggagcggctaaaaacctgagcacgtttgccgtggacgggaaagattgcaaggtgaataaagaagtggagcgtgtcctgaaggagttccaccaggccgggaagcccatcggcttgtgctgcattgcacctgtcctcgcggccaaggtgctcagaggcgtcgaggtgactgtgggccacgagcaggaggaaggtggcaagtggccttatgccgggaccgcagaggccatcaaggccctgggtgccaagcactgcgtgaaggaagtggtcgaagctcacgtggaccagaaaaacaaggtggtcacgaccccagccttcatgtgcgagacggcactccactacatccatgatgggatcggagccatggtgaggaaggtgctggaactcactggaaagtgacgcgcatggacggggcccagctaggcgccaggacttggcctcaccctctggctgaggagctgtcggctgctttccatccagctgggagtctggcaggcccttttttttttttctttgccgaaacctgcaggcgttctctctctaaggaggatgtgctgcagtgcatgggggatgtttcttcctgggtgtggctgggctgctctcacatacagaggccgaggggccaattcgttctctgccacagggacttgcctcactgtgtcccaaaaacaaatcgcagccagcttttccagaaatagaaaattctgccgtctgaggttttatacttcaggttagttagtttttggaaggaagaacatttttaggtttgcaagcctcctgatcaggaaaccagaaataccacatttatggaccatgaaaggttggttcttgactctgaagggacttttgagttaatcagcgtaaggggatttctaaagcaggcaatccctgtagccgcagagaataaacgccttcccaaaatggcaacttcccacagccacatttcagacctgctgagactgctgagtgaggaatggcagtgaggtttcttcaattagtctcagttctcttaattttcaggaagaaagggaaattgcagctcctcagcccccaggattgacctctggggagtgatggtagcgttggtgccaggccgtgggttcaggtgtggcagaagcttgcagatgcgtccgaagggaaataaagtgtgttggcgttaga

SEQ ID NO: 103509 - DNA, 318 bp, Homo sapiens
  Payload ID: 251
  Gene Symbol:
  Gene Name: AC016734.1
  ENST ID: ENST00000625036
  CDS Start-End: 1-318
cgatgggaccgagatccacgaggcctcggcgatcctggtgcacctgagccgtggaggggctgaagtccagatctttgctcctgacgtccctcagatgcacgtgattgaccacaccaaggggcagccgtccgaaggcgagagcaggaatgttttgaccgagtctgcgaggatcgcccgtggcaaaatcacagacctggccaacctcagtgcagccaaccatgatgctgccatctttccaggaggctttggagcggctaaaaacctcgggtctccctatagtgacccggccaagcacagaagtctgggtttgcagctgtt

SEQ ID NO: 103510 - DNA, 898 bp, Homo sapiens
  Payload ID: 251
  Gene Symbol:
  Gene Name: AC016734.1
  ENST ID: ENST00000624120
  CDS Start-End: 19-732
cccgctgtcctcaccgcaatggcggctgtgagggccctggtggcctcgaggctcgctgcggcatctgcattcacgtccctgtcccccggcggtcggacgccttcccagcgcgcagcccttcacctctccgtgccgcgccccgcggccagggtcgcgctggtgctgtctggatgcggagtctacgatgggaccgagatccacgaggcctcggcgatcctggtgcacctgagccgtggaggggctgaagtccagatctttgctcctgacgtccctcagatgcacgtgattgaccacaccaaggggcagccgtccgaaggcgagagcaggaatgttttgaccgagtctgcgaggatcgcccgtggcaaaatcacagacctggccaacctcagtgcagccaaccatgatgctgccatctttccaggaggctttggagcggctaaaaacctcttgtgctgcattgcacctgtcctcgcggccaaggtgctcagaggcgtcgaggtgactgtgggccacgagcaggaggaaggtggcaagtggccttatgccgggaccgcagaggccatcaaggccctgggtgccaagcactgcgtgaaggaagtggtcgaagctcacgtggaccagaaaaacaaggtggtcacgaccccagccttcatgtgcgagacggcactccactacatccatgatgggatcggagccatggtgaggaaggtgctggaactcactggaaagtgacgcgcatggacggggcccagctaggcgccaggacttggcctcaccctctggctgaggagctgtcggctgctttccatccagctgggagtctggcaggcccttttttttttttctttgccgaaacctgcaggcgttctctctctaaggaggatgtgctgcagtgcat

SEQ ID NO: 103511 - DNA, 696 bp, Homo sapiens
  Payload ID: 251
  Gene Symbol:
  Gene Name: AC016734.1
  ENST ID: ENST00000624648
  CDS Start-End: 1-675
ccttcccagcgcgcagcccttcacctctccgtgccgcgccccgcggccagggtcgcgctggtgctgtctggatgcggagtctacgatgggaccgagatccacgaggcctcggcgatcctggtgcacctgagccgtggaggggctgaagtccagatctttgctcctgacgtccctcagatgcacgtgattgaccacaccaaggggcagccgtccgaaggcgagagcaggaatgttttgaccgagtctgcgaggatcgcccgtggcaaaatcacagacctggccaacctcagtgcagccaaccatgatgctgccatctttccaggaggctttggagcggctaaaaacctgagcacgtttgccgtggacgggaaagattgcaaggtgaataaagaagtggagcgtgtcctgaaggagttccaccaggccgggaagcccatcggtcactcacttaaggacctgcctggtcactgtccagggaggcccctaaagtggagcctcaggaagaggtgcaggctcagagctcctgaaggaggtccctgctgcagccgtgtcacagccggggtgaaggtttcgcccatggtctccacctcgggatcccgtccttgtcagagaagtgttccttggatgagcgcccagagggaggagcccatggccctttcttctgtgactgattaaaaatctcgatgaaacaagaca

SEQ ID NO: 103512 - DNA, 781 bp, Homo sapiens
  Payload ID: 251
  Gene Symbol:
  Gene Name: AC016734.1
  ENST ID: ENST00000623810
  CDS Start-End: 60-233
ggggtgggtgcgcacgctctgtccctgcgtgaccttccgaccccgctgtcctcaccgcaatggcggctgtgagggccctggtggcctcgaggctcgctgcggcatctgcattcacgtccctgtcccccggcggtcggacgccttcccagcgcgcagcccttcacctctccgtgccgcgccccgcggccagggtcgcgctggatcctggtgcacctgagccgtggaggggctgaagtccagatctttgctcctgacgtccctcagatgcacgtgattgaccacaccaaggggcagccgtccgaaggcgagagcaggaatgttttgaccgagtctgcgaggatcgcccgtggcaaaatcacagacctggccaacctcagtgcagccaaccatgatgctgccatctttccaggaggctttggagcggctaaaaacctgagcacgtttgccgtggacgggaaagattgcaaggtgaataaagaagtggagcgtgtcctgaaggagttccaccaggccgggaagcccatcggtcactcacttaaggacctgcctggtcactgtccagggaggcccctaaagtggagcctcaggaagaggtgcaggctcagagctcctgaaggaggtccctgctgcagccgtgtcacagccggggtgaaggtttcgcccatggtctccacctcgggatcccgtccttgtcagagaagtgttccttggatgagcgcccagagggaggagcccatggccctttcttctgtgactgattaaaaatctcgatgaaacaaga

SEQ ID NO: 103513 - DNA, 411 bp, Homo sapiens
  Payload ID: 251
  Gene Symbol:
  Gene Name: AC016734.1
  ENST ID: ENST00000624810
  CDS Start-End: 1-411
cgatgggaccgagatccacgaggcctcggcgatcctggtgcacctgagccgtggaggggctgaagtccagatctttgctcctgacgtccctcagatgcacgtgattgaccacaccaaggggcagccgtccgaaggcgagagcaggaatgttttgaccgagtctgcgaggatcgcccgtggcaaaatcacagacctggccaacctcagtgcagccaaccatgatgctgccatctttccaggaggctttggagcggctaaaaacctgagcacgtttgccgtggacgggaaagattgcaaggtgaataaagaagtggagcgtgtcctgaaggagttccaccaggccgggaagcccatcggcgggtctccctatagtgacccggccaagcacagaagtctgggtttgcagctgtt

SEQ ID NO: 103514 - DNA, 75 bp, Homo sapiens
  Payload ID: 252
  Gene Symbol:
  Gene Name: AC016753.2
  ENST ID: ENST00000630104
  CDS Start-End: 1-75
ataataataataataataataataaaattcatttttatttatttatttattttttttgagacagggtctcactgt

SEQ ID NO: 103515 - DNA, 264 bp, Homo sapiens
  Payload ID: 253
  Gene Symbol:
  Gene Name: AC017028.10
  ENST ID: ENST00000623536
  CDS Start-End: 1-264
atgaggagccaggggcagggtgggcctggggcctggcggaggatggagagctggagtgcagagcctgctggaccagggcagggccgccttgggtccccctgtgaggcagccgagcaagcgagctttgagaagacagtgataggagtggggcaagcacgggcagccctttctgaagaggagcacagagtctgggaggctgcagcgggagttggaggactagagcagtggggctgctgggaagcaggggtcacgagtggctggggc

SEQ ID NO: 103516 - DNA, 381 bp, Homo sapiens
  Payload ID: 254
  Gene Symbol:
  Gene Name: AC017081.1
  ENST ID: ENST00000625193
  CDS Start-End: 1-381
atggtgatgactcttaatgagcatgctgccttcaagcatctgtttaacaaagcacatcttgcaccgcccttaatccatttaaccctgagtggacacagcacatgtttcagagagcacagggttgggggtaaggtcatagatcaacaggatcccaaggcagaagaatttttcttagtacagaacaaaatgaaaagtctcccatgtctacttctttctacacagacacggcaaccatccgatttctcaatcttttccccacctttcccccttttctattccacaaaaccgccattgtcatcatggcccgttctcaatgagctgttgggtacacctcccagacggggtggtggccgggcagaggggctcctcacttcccagtag

SEQ ID NO: 103517 - DNA, 48 bp, Homo sapiens
  Payload ID: 255
  Gene Symbol:
  Gene Name: AC018512.1
  ENST ID: ENST00000625006
  CDS Start-End: 1-48
atgtctcaaaaaaaaaaaaaaaaaagccagaaaaaagaaaaaaaaaag

SEQ ID NO: 103518 - DNA, 1926 bp, Homo sapiens
  Payload ID: 256
  Gene Symbol:
  Gene Name: AC018755.18
  ENST ID: ENST00000429354
  CDS Start-End: 131-1786
cacagctctcactcaccctccggcttcctgtcggggctttctcagccccaccccacgtttggacatttggagcatttccttccctgacagccggacctgggactgggctggggccctggcggatggagacatgctgcccctgctgctgctgcccctgctgtggggggggtccctgcaggagaagccagtgtacgagctgcaagtgcagaagtcggtgacggtgcaggagggcctgtgcgtccttgtgccctgctccttctcttacccctggagatcctggtattcctctcccccactctacgtctactggttccgggacggggagatcccatactacgctgaggttgtggccacaaacaacccagacagaagagtgaagccagagacccagggccgattccgcctccttggggatgtccagaagaagaactgctccctgagcatcggagatgccagaatggaggacacgggaagctatttcttccgcgtggagagaggaagggatgtaaaatatagctaccaacagaataagctgaacttggaggtgacagccctgatagagaaacccgacatccactttctggagcctctggagtccggccgccccacaaggctgagctgcagccttccaggatcctgtgaagcgggaccacctctcacattctcctggacggggaatgccctcagccccctggaccccgagaccacccgctcctcggagctcaccctcacccccaggcccgaggaccatggcaccaacctcacctgtcagatgaaacgccaaggagctcaggtgaccacggagagaactgtccagctcaatgtctcctatgctccacagaccatcaccatcttcaggaacggcatagccctagagatcctgcaaaacacctcataccttccggtcctggagggccaggctctgcggctgctctgtgatgctcccagcaacccccctgcacacctgagctggttccagggctcccctgccctgaacgccacccccatctccaataccgggatcttggagcttcgtcgagtaaggtctgcagaagaaggaggcttcacctgccgcgctcagcacccgctgggcttcctgcaaatttttctgaatctctcagtttactccctcccacagttgctgggcccctcctgctcctgggaggctgagggtctgcactgcagatgctcctttcgagcccggccggccccctccctgtgctggcggcttgaggagaagccgctggaggggaacagcagccagggctcattcaaggtcaactccagctcagctgggccctgggccaacagctccctgatcctccacggggggctcagctccgacctcaaagtcagctgcaaggcctggaacatctatgggtcccagagcggctctgtcctgctgctgcaagggagatcgaacctcgggacaggagtggttcctgcagcccttggtggtgctggtgtcatggccctgctctgtatctgtctgtgcctcatcttctttttaatagtgaaagcccgcaggaagcaagcagctgggagaccagagaaaatggatgatgaagaccccattatgggtaccatcacctcgggttccaggaagaagccctggccagacagccccggagatcaagcatctcctcctggggatgcccctcccttggaagaacaaaaggagctccattatgcctcccttagtttttctgagatgaagtcgagggagcctaaggaccaggaggccccaagcaccacggagtactcggagatcaagacaagcaagtgaggatttgcccagagttcagtcctggctggaggagccacagcctgtctgggggaaaggacaagtcagggaccacttgctgaagcacgaagagcccttgtggcaatgttaacattaactgatgtttaagtgctccaagcaga

SEQ ID NO: 103519 - DNA, 1837 bp, Homo sapiens
  Payload ID: 256
  Gene Symbol:
  Gene Name: AC018755.18
  ENST ID: ENST00000599649
  CDS Start-End: 42-1697
gccggacctgggactgggctggggccctggcggatggagacatgctgcccctgctgctgctgcccctgctgtggggggggtccctgcaggagaagccagtgtacgagctgcaagtgcagaagtcggtgacggtgcaggagggcctgtgcgtccttgtgccctgctccttctcttacccctggagatcctggtattcctctcccccactctacgtctactggttccgggacggggagatcccatactacgctgaggttgtggccacaaacaacccagacagaagagtgaagccagagacccagggccgattccgcctccttggggatgtccagaagaagaactgctccctgagcatcggagatgccagaatggaggacacgggaagctatttcttccgcgtggagagaggaagggatgtaaaatatagctaccaacagaataagctgaacttggaggtgacagccctgatagagaaacccgacatccactttctggagcctctggagtccggccgccccacaaggctgagctgcagccttccaggatcctgtgaagcgggaccacctctcacattctcctggacggggaatgccctcagccccctggaccccgagaccacccgctcctcggagctcaccctcacccccaggcccgaggaccatggcaccaacctcacctgtcagatgaaacgccaaggagctcaggtgaccacggagagaactgtccagctcaatgtctcctatgctccacagaccatcaccatcttcaggaacggcatagccctagagatcctgcaaaacacctcataccttccggtcctggagggccaggctctgcggctgctctgtgatgctcccagcaacccccctgcacacctgagctggttccagggctcccctgccctgaacgccacccccatctccaataccgggatcttggagcttcgtcgagtaaggtctgcagaagaaggaggcttcacctgccgcgctcagcacccgctgggcttcctgcaaatttttctgaatctctcagtttactccctcccacagttgctgggcccctcctgctcctgggaggctgagggtctgcactgcagatgctcctttcgagcccggccggccccctccctgtgctggcggcttgaggagaagccgctggaggggaacagcagccagggctcattcaaggtcaactccagctcagctgggccctgggccaacagctccctgatcctccacggggggctcagctccgacctcaaagtcagctgcaaggcctggaacatctatgggtcccagagcggctctgtcctgctgctgcaagggagatcgaacctcgggacaggagtggttcctgcagcccttggtggtgctggtgtcatggccctgctctgtatctgtctgtgcctcatcttctttttaatagtgaaagcccgcaggaagcaagcagctgggagaccagagaaaatggatgatgaagaccccattatgggtaccatcacctcgggttccaggaagaagccctggccagacagccccggagatcaagcatctcctcctggggatgcccctcccttggaagaacaaaaggagctccattatgcctcccttagtttttctgagatgaagtcgagggagcctaaggaccaggaggccccaagcaccacggagtactcggagatcaagacaagcaagtgaggatttgcccagagttcagtcctggctggaggagccacagcctgtctgggggaaaggacaagtcagggaccacttgctgaagcacgaagagcccttgtggcaatgttaacattaactgatgtttaagtgctccaagcaga

SEQ ID NO: 103520 - DNA, 72 bp, Homo sapiens
  Payload ID: 257
  Gene Symbol:
  Gene Name: AC018867.1
  ENST ID: ENST00000626288
  CDS Start-End: 1-72
attcctcctgccttagcctcccaagcagctgggtctacagactccgtctcaaaaaaaaaaaagaaaattatt

SEQ ID NO: 103521 - DNA, 45 bp, Homo sapiens
  Payload ID: 258
  Gene Symbol:
  Gene Name: AC018902.1
  ENST ID: ENST00000628998
  CDS Start-End: 1-45
atggtaatactaaaaatatatacagagttcagtagggtatggatt

SEQ ID NO: 103522 - DNA, 192 bp, Homo sapiens
  Payload ID: 259
  Gene Symbol:
  Gene Name: AC019206.1
  ENST ID: ENST00000624334
  CDS Start-End: 1-192
agcagaagaagaagcaagagcagcagaaggagcagcagaaggagcagcagaagaagcagaagcaaaagaagcagaagccgaagaagaagcaagagcagcagaaggagcagcagaagaagcagacgcagaagcagaaccagaagaagcaggagcagcagcaggagaagcagcacaaacagaagcagcagcaag

SEQ ID NO: 103523 - DNA, 531 bp, Homo sapiens
  Payload ID: 260
  Gene Symbol:
  Gene Name: AC021106.1
  ENST ID: ENST00000623925
  CDS Start-End: 275-430
tgggtgatggctactttggtgtccattgtactattgattgtataagtttgacattctccataaaaaggataagcaagaatacattctcagaagaaaaagacaagtgaaaaatcaccaaaggtcctgggcaggtgttttgaagtgtcaacgaacagagtagattgcaggatagggaggtggggaactgagtgggaaaacctaacttgaggccagactacatttaaagcaatttgaggacttccgagtgggaaagtccaagtagggaaatggcgatatgaagatggagcttgggagagacgtttgtagctctgcacttaggataatgaaagccacaaacataaagaagcgttcagggggcagagataccgttgcaccacagggaatgaaccaactaggaaaggaaaaaaaagaaagcctgttgagctcataaaggagataattagcccaagctcctacctacattttacttttgttttagaaaaccaataaacacctctcagaaatggagctccatttcactcttgccaccta

SEQ ID NO: 103524 - DNA, 501 bp, Homo sapiens
  Payload ID: 261
  Gene Symbol:
  Gene Name: AC022016.1
  ENST ID: ENST00000634510
  CDS Start-End: 1-501
atgggcaaggacttcatgactaaaacaccaaaagcaatggcaacaaaagccaaaatagacaaatgggatctaattaaactaaagagcttctgcacagcaaaagaaactaccatcagagtgaacagacaacctacagaatgggagaaaatttttacaatctacccatctgacaaagggcaatcccattactgggtatatacccaaaggattataaatcatgctactataaaaacacatgcacacgtatgtttattgagtataataaaaaaacaaaaacaaaaacaaaaacaaacctctctgcctgtagtcctagcactttgggaggccaaggtgggaggattgcttgagctcaggaggttgagaccagcctgggcaaaatggaaaaaccatgtctctacaaaaaatacaaaaattagctgggcatggtggtgtgtgcctatagtcccagctacttgggaggctgaggtgggaagatcacctgagccccaggaggtcaaagtt

SEQ ID NO: 103525 - DNA, 54 bp, Homo sapiens
  Payload ID: 262
  Gene Symbol:
  Gene Name: AC022210.1
  ENST ID: ENST00000624966
  CDS Start-End: 1-54
atgactctgccaagaaaacagaccctgagccatgaagcaaggaagcccctgagc

SEQ ID NO: 103526 - DNA, 375 bp, Homo sapiens; identical to SEQ ID NO: 103469
  Payload ID: 263
  Gene Symbol:
  Gene Name: AC022405.1
  ENST ID: ENST00000624839
  CDS Start-End: 1-375

SEQ ID NO: 103527 - DNA, 81 bp, Homo sapiens
  Payload ID: 264
  Gene Symbol:
  Gene Name: AC022819.2
  ENST ID: ENST00000626579
  CDS Start-End: 1-81
gtgactagattatgcactagaatttcattcagtattcttccaaaaaataaaaatttattttttaactttactactttgcac

SEQ ID NO: 103528 - DNA, 2404 bp, Homo sapiens
  Payload ID: 265
  Gene Symbol:
  Gene Name: AC023491.2
  ENST ID: ENST00000619792
  CDS Start-End: 428-1714
ggcggctggacgaggacgctccgagcccagctctcgagagttcaagcaaccgacggttccccactgctcccaggagcggttacctgggcactctgtgcccctccttcctgttcgggcccaggccgaggacctgccagtagggctcagttgcctggagcccgttcagcccatcccccagttcactttgcctgtgggatctccccgttgctcctgcccgtggactgagtggcaggccatcctacaagcacccggacacttgacatcagtggtgtcaagacaactctaagaaggttttccgtgatcctgcaagccctgccttccttcctgggatcctgccttcaatttgattgcacaggtaccacagcaagccagtgctgtgtgctccgagttccagggcgtcctccagctcagccactgcactgagaacatggactctctgtggggcccaggagccgggagtcacccctttggggtccacaacacccggctgtccccagacttgtgtccagggaagatagtgttgagggccctcaaggagagcggggcagggatgcctgagcaggacaaggaccctagagtccaagagaatcctggtgatcagagaagggtccccgaggtcaccggggatgcaccgtctgcatttcggcccctgcgggacaatagaggcctctctccctttgtgcccgggcccgggcctctgcagacagacctccatgcccagaggtcagaaatcagatataaccagacatcccagatctcctggacgagctcctgcaccaaccgaaatgccatctccagctcctacagctccatgggaggcttgccggggctaaagcggaggagggggccagcctcatcccactgccagctgaccctcagttcctcaaagacagtgagtgaggacaggcctcaggctgtctcttcaggtcacacccagtgtgaaaaggcagcagatatagcaccagggcagacactcgccctcaggaatgactcctccacatccgaggcctctaggcccagtacacacaagtttcccctgctgccacgcaggcgaggggagcctttgatgctgccacctcccttagagctggggtaccgggtcactgttgaagacctggaccgggagaaggaggcggcattccagcgcatcaacagtgcactgcaggttgaggacaaggccatctcggactgcagaccctcacggccttcccacactttgtcctcacttgcaacagggacttctggtctgcctgccatttctaaagcacccagtatggatgtacagcaggagacacacaagtcccaagactgcctgggcctactggcccccttagcatctgctgcaggggtcccctctacagctcccatgtctgggaagaagcacagaccaccaggccccctgttctcctcctcagatccccttcctgccacctcttcccattcccaggactcagcccaggtcacctcgctgattcctgcccccttcccagctgcaagcatggatgcgggcatgagaagaacaaggtgtggcacttctgctcctgcagctgccgcagcagcccctcccccctccacattgaaccccacgttggggtcactactggagtggatggaggcccttcacatttctgggcctcagccacagctgcagcaggtgcccagaggtcagaaccagagatcccagacctcccggaccagctcgtgccccaaacgaaatgccatctcgagcccctaccactctacgggaggcctcccggaacgaaagcggagaagggggccagcctcatcccactgccagctgaccctcagttcctgaaacacagtgagtgaggacggacctcaggctgtctcttcgggtcacacccagtgtgaaaagatggcagatacagcaccagggcagacactcgaccccaggggtggctcccccagatcccaggcctctaggccctgtagatgcaagtttcccctgctgccacgcaggcgaggggagcctttgatgctgccacctcccttagagctggggtaccgggtcactgctgaagacctggaccaggagaaggaggcggctttccagcgcatcaagagtgcactgcaggttgaggacaaggccatttagtactgcagaccctcacggccttcccacactttgtcctcacttgcaacaggggcttctggtctgcctgccatttctaaagcacccagtatggatgcacagcaggagagacacaagtcccaagactgcctgggcctagtggccccccagcatctgctgcacaggcctgtagtcccagctactcaggaggctgaggcaggagaagggcataaacccgggaggcagagcttgcagtgagctgagatcgcgccactgcactccagcctgggtgacagagcgagactccgtctc

SEQ ID NO: 103529 - DNA, 63 bp, Homo sapiens
  Payload ID: 266
  Gene Symbol:
  Gene Name: AC024060.1
  ENST ID: ENST00000629101
  CDS Start-End: 1-63
ttaaaaaggttagtagatggagtctcgctctgtcgcccaggctggagtgcggtggcacgatct

SEQ ID NO: 103530 - DNA, 54 bp, Homo sapiens
  Payload ID: 267
  Gene Symbol:
  Gene Name: AC024361.1
  ENST ID: ENST00000629043
  CDS Start-End: 1-54
gagagtgtcctcagacgacacctcaactgcagtcctgttccacctacaggacac

SEQ ID NO: 103531 - DNA, 2118 bp, Homo sapiens
  Payload ID: 268
  Gene Symbol:
  Gene Name: AC024592.12
  ENST ID: ENST00000592091
  CDS Start-End: 80-445
tctcgcgatagccagccgcggctgcccttgcgcttcccgagctggcggggtccgtggtgcgggatcgagattgcgggctatggcgccgaaggtttttcgtcagtactgggatatccccgatggcaccgattgccaccgcaaagcctacagcaccaccagtattgccagcgtcgctggcctgaccgccgctgcctacagagtcacactcaatcctccgggcaccttccttgaaggagtggctaaggttggacaatacacgttcactgcagctgctgtcggggccgtgtttggcctcaccacctgcatcagcgcccatgtccgcgagaagcccgacgaccccctgaactacttcctcggtggctgcgccggaggcctgactctgggagcacgcaagactgggtttcaccgtgttagccaggatggtcttgatctcctgacctcgtgatctacctgcctcggcctcccaaagtgctgggattacagacatgagccacctcgcccagccttttcatggctgagtgatattccattgtgtggatggatcacactagctactctgacccatggatcccctgggcccagccaagccacagtggctgtggcgccgctgtctggccgggctgctgtttcagctgctggtggctgtgtgtttcttctcctacctgcgtgtgtcccgagacgatgccactggatcccctaggccagggcttatggcagtggaacctgtcaccggggctcccaatgggtcccgctgccaggacagcatggcgacccctgcccaccccaccctactgatcctgctgtggacgtggccttttaacacacccgtggctctgccccgctgctcagagatggtgcccggcgcggccgactgcaacatcactgccgactccagtgtgtacccacaggcagacgcggtcatcgtgcaccactgggatatcatgtacaaccccagtgccaacctcccgccccccaccaggccgcaggggcagcgctggatctggttcagcatggagtcccccagcaactgccggcacctggaagccctggacggatacttcaatctcaccatgtcctaccgcagcgactccgacatcttcacgccctacggctggctggagccgtggtccggccagcctgcccacccaccgctcaacctctcggccaagaccgagctggtggcctgggcggtgtccaactggaagccggactcggccagggtgcgctactaccagagcctgcaggctcatctcaaggtggacgtgtacggacgctcccacaagcccctgcccaaggggaccatgatggagacgctgtcccggtacaagttctatctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcactggcgggagacgctgcggcctcgctccttcagctgggcactggctttctgcaaggcctgctggaagctgcagcaggaatctaggtaccagacggtgcgcagcatagcggcttggttcacctgagaggccggcatggggcctgggctgccgggacctcactttcccagggcctcacctacctagggtctcactagtcgggggatttacctacctggggcctcggctgcctggggcctcggctgcctggggtctcacctgcctggggcctcacctgctggagtctttggtggccaggcatgtgacttacctgggatttcacttgccgggcttcactgccaggagcctcccctgctggggaccttgccagctggggctggggatggtgcctactggggaccttgctttctggaggctgcacctactgaggatctcggctgttggggactttacctgctgggacctgctcccagagaccttgccacactgaatgtcacctgctaggagcctcacccgctgggaggcacagggcccaagggagctggatgtgttgccc

SEQ ID NO: 103532 - DNA, 506 bp, Homo sapiens
  Payload ID: 268
  Gene Symbol:
  Gene Name: AC024592.12
  ENST ID: ENST00000586349
  CDS Start-End: 1-506
gccgaaggtttttcgtcagtactgggatatccccgatggcaccgattgccaccgcaaagcctacagcaccaccagtattgccagcgtcgctggcctgaccgccgctgcctacagagtcacactcaatcctccgggcaccttccttgaaggagtggctaaggttggacaatacacgttcactgcagacactggcagtgagcgcccaagaggctcctgctgtgcccgtctcgaggcccttgctcttcccgtctaccccgcagctgctgtcggggccgtgtttggcctcaccacctgcatcagcgcccatgtccgcgagaagcccgacgaccccctgaactacttcctcggtggctgcgccggaggcctgactctgggagcacgcactactctgacccatggatcccctgggcccagccaagccacagtggctgtggcgccgctgtctggccgggctgctgtttcagctgctggtggctgtgtgtttcttctcctacctgcgtgtgtcc

SEQ ID NO: 103533 - DNA, 431 bp, Homo sapiens
  Payload ID: 268
  Gene Symbol:
  Gene Name: AC024592.12
  ENST ID: ENST00000585661
  CDS Start-End: 1-431
gccgaaggtttttcgtcagtactgggatatccccgatggcaccgattgccaccgcaaagcctacagcaccaccagtattgccagcgtcgctggcctgaccgccgctgcctacagagtcacactcaatcctccgggcaccttccttgaaggagtggctaaggttggacaatacacgttcactgcagctgctgtcggggccgtgtttggcctcaccacctgcatcagcgcccatgtccgcgagaagcccgacgaccccctgaactacttcctcggtggctgcgccggaggcctgactctgggagcacgcactactctgacccatggatcccctgggcccagccaagccacagtggctgtggcgccgctgtctggccgggctgctgtttcagctgctggtggctgtgtgtttcttctcctacctgcgtgtgtcc

SEQ ID NO: 103534 - DNA, 548 bp, Homo sapiens
  Payload ID: 269
  Gene Symbol:
  Gene Name: AC025263.3
  ENST ID: ENST00000550437
  CDS Start-End: 1-231
ttacaacctatccggtttgtgaaagcttctgcagttgaatgcggaggaccaaaaaaatgtgctctcactggccagagtaagtcctgtaaacacagaattaaattaggggactcaagcaactattattatatttctcctttttgcagatacaggatcacttctgtatgtaacttttttacatacattcgatacattcagcagggactcgtgaaacagcaggatgttttataatcacatttgaaaactcaaccatctttctgggcacaatttgatggctgaagatatgcttcactccaataaaaagaaaatgaagatttttcaagagcattcgtaggcttcgaatcaaaaggacagtacttatttcctgaggtctgataaccgttgttttatgaggaaatagtactaggatcacagtaccatggatgtggtaggcgaaaatgaggccctgcagcagttctttgaagctcagggagccaatggtactctggagaacccagccctggacacaagtctgttggaggaatttctgggcaatgactttgatttgg

SEQ ID NO: 103535 - DNA, 375 bp, Homo sapiens
  Payload ID: 270
  Gene Symbol:
  Gene Name: AC026248.1
  ENST ID: ENST00000623475
  CDS Start-End: 1-375
atgactcttaacgagcatgctgccttcaagcatctgtttaacaaagcacatcttgcaccgcccttaatccattcaaccctgagtggatacagcacatgtttcagagagcacagggttgggggtaaggtcacagatcaacaggatcccaaggcagaagaatttttcttagtacagaacaaaatgaaaagtctcccatgtctacctctttctacacagacacggcaaccatccgatttctcaatctttcccccacctttcccccctttctattccacaaaaccgccattgtcatcatggcccgttctcaatgagctgttgggtacacctcccagacggggtggtggccgggcagaggggctcctcacttcccagtag

SEQ ID NO: 103536 - DNA, 2734 bp, Homo sapiens
  Payload ID: 271
  Gene Symbol:
  Gene Name: AC026369.1
  ENST ID: ENST00000621764
  CDS Start-End: 119-676
ggaggctgggccggtgggagagggaggcgagccgaccgctgggctgctgggctcccgcgccctcgcgctccccgccgccagcccaggcgcaggcagggcgcaggcggcggcgggcggcatggagagcctgctggagaatccggtgcgcgccgtgctctacctcaaggagctcacggccatcgtgcagaaccagcagagcctcatccacacccagcgagagcgtatcgacgagctggagcggcggctggacgagctgagcgctgagaaccgcagcctgtgggagcaccagcagctgctgcaagcccagcctccgcccgggctcgtccccccgtcatcggccccgctgccggccgctccggccaccgctcctgccgccgccgccagggcccaggaacctctccaggaccagggacagcgctcagcagccgcgccgcatcccgcgcccgatcggccgccgcgtcagcaccacggacagctcctggagcagccccagcggggccctggcagcagggctcacacaccccagtcgccccacaagcatctggggacacaaggggccgtgactgacaaggagaaggagcgtcccccgagttgctgcgctgctgccggagccctccttcagcacaaatccccctccgccctcggcaagggcgtcctgagcaggagacctgagtgagcggggagaggagatgggcactgttgtggtgggagcaagggaagcaagtgggtgtgagggagagacggggacgttgggtgcgtaggagtctaaaggaccggagtgatgtggcctgaaggcgccagaagtgtgcaaaggagattttgggtaaatgagggaacgatatccctgcttgagaaggttttggggaatgctggagcaaaaaggagtaaccagaccattagtaggagcaaaggaggaaggaggtgggtgttaagcgattggtgatactgggaactgacagcatttaaacggggttaggctgggttgaagttcgagtgaagattaaactgtagaaaagagaaccattgaaggaatctttttaagtgagaaaaaatttggaaggaagtttgggtagtaaaagtatttgcatggagactgagatgtgagaaaagctgaaggcttggaaagaggcatgtgaagagctttaaaaaggctggggcccaggaagagtaggactggggtagaggggaatccaggaggccggggacaaacctgaaaagcaggagtgatgtgggaaaccaagggagctggaggcagaggaagagaaaatgtggctctttagctggtgaagtgggagccacagctaggagtggctcatttagggaagctttctcttctctgacctgattggacacccttcctctgaattcccgcagagccgaagaggtgcaagggaacatcccatcaaaccaatggaggactcaggcatggcttgaggactcagtctggttacagctttttcctccaactcaaggagggtttttcatacagggtgtttggccgttgttgaaagggagcaatgacatgggggacagttggcagatggagttggtattcagatgccatgcctgtttaaatctccctgttaaggccagcaactgcaaacccttttttcccggttatctggtgatcactgaaatcttgccttgggtcctgagagaaatgttaacctctcagttcctagaacttcaagctctttcttcactcaggaggtccatgaactaggaatatgggaagaagatatgaaagtgtctgggatgttctctcctctgtactggaaaggctgtggccatgtctgcttcttttctctgattaggcaagtgatggagaactaaacaaagaacagttcaagggaaattgtccctggtcagcacctgaccttgacaatggtgatgcataagggaatggggagggggaagtagagctgagaatctcatcttcatccaggtgcattaagtctgggagatacttgtgaatatttgctgtattccttcaaaactcattttcttttaccatctgtggtagagttagagaagttgggttagggcagggtagctcacagagcacgttgatcaaaaccacaggatctaagaggtgaaggtctaacatgatctggcttggcagacttaaaacatttgattcaagtcccaagaagatacagttttctaccccaactccctcaaaacccctttgtacttccctcagtttcacatttttatttttattttttccttatctggcataaaaagcagaaagtcagttttccctcaatgcccaaggctcagcaaaaggcaacattgttccaagatactaagtggtcttttcccccacatgaggggatgaatttttccagtccccttccctgagggcagccacagctacctggtcattatgatttctctcctcatgacttttggtgtctcctgtctctcccactgcaactccactttctttgcatctcttcagggcactgtgtggccaagaagagttgaggaaagattatttttcttagacaaagacatagccatagccttcagagtggcctacggaacccaaaccctttcactcagttggtcctgctcggaatcctgggatttaggaatcatctgggctcctgtccagctccacatgtcaattctggagaggagttataatatcctcacctttccttctcacctgtcctgcttttgcttcccaaaggagcagaacaaaaataaaaaataattagcatggtgg

SEQ ID NO: 103537 - DNA, 63 bp, Homo sapiens
  Payload ID: 272
  Gene Symbol:
  Gene Name: AC026449.1
  ENST ID: ENST00000623778
  CDS Start-End: 1-63
aaagtttatttttgtttttcattactacacaatttcttgagaaaaaggtcatgggaaagtttc

SEQ ID NO: 103538 - DNA, 977 bp, Homo sapiens
  Payload ID: 273
  Gene Symbol:
  Gene Name: AC037459.4
  ENST ID: ENST00000450780
  CDS Start-End: 103-977
tccccggctgcctcctcccaacaggccggcctcggccgcgctggcgactcggcggtgctggtgctgccgccttccccgggccctcgttcctccaggcccagcatggactcggaagggggaagcctcctcctggacgaggactcggaagtcttcaagatgctgcaggaaaatcgcgagggacgggcggccccccgacagtccagctcctttcggctcttgcaggaagccctggaggctgaggagagagatggggctggcgagggcctggcacggggctgcatagtgcctggagtcaccagcacctacagacggatccccgacgctgcccacgggtgctcatcctgggagagaggtgacaagttcagaggtgtcggcagggaggcactctttctcaaactggcctcccgggactcaggagtggagatggcagttggggacagccccctggccgccttaccgggcctttctcaggactccctggactttgaatcctcagggagttctgagccccccgcccaggtaggccgactcctggccagccagaagctgggggaggtgttggagcggtcccgccggctcccaacagctcccaccagcttgtcaggacaacaccgctccctgcggctggcaagcaagcctgagcgtgaagtgccccttggagcagggcaacaggagtccatggaggcagacacagacctagaggcaggcctggaagaagaggcggtggggggcctggggcctggagcctgggcctgcctccccgggcagggtcttcgctatctggaacacctgtgcctggtgctggagcagatggcaaggctccagcagctctacctgcagctgcggatccagaggcccccaggggatcccggcgaggaggagtcgacccgagcccctttaccgtccccgttacacaccccaggcaatcgggggcaggggccatgggagctgctaagccagacagagcacacaggtga

SEQ ID NO: 103539 - DNA, 531 bp, Homo sapiens
  Payload ID: 273
  Gene Symbol:
  Gene Name: AC037459.4
  ENST ID: ENST00000430850
  CDS Start-End: 84-482
aacaggccggcctcggccgcgctggcgactcggcggtgctggtgctgccgccttccccgggccctcgttcctccaggcccagcatggactcggaagggggaagcctcctcctggacgaggactcggaagtcttcaagatgctgcaggaaaatcgcgagggacgggcggccccccgacagtccagctcctttcggctcttgcaggaagccctggaggctgaggagagaggtggcacgccagccttcttgcccagctcactgagcccccagtcctccctgcccgcctccagggccctggccacccctcccaagctccacacttgtgagaagtgcagtaccagcatcgcgaaccaggctgtgcgcatccaggagggccggtaccgccaccccggctgctacacctgtgccgactgtgggctgaacctgaagatgcgcgggcacttctggatggggctggcgagggcctggcacggggctgcatagtgcctggagtcaccagcacctacagacggatccccgacgctgcccacgg

SEQ ID NO: 103540 - DNA, 794 bp, Homo sapiens
  Payload ID: 273
  Gene Symbol:
  Gene Name: AC037459.4
  ENST ID: ENST00000447849
  CDS Start-End: 1-424
ggcggtgctggtgctgccgccttccccgggccctcgttcctccaggcccagcatggactcggaagggggaagcctcctcctggacgaggactcggaagtcttcaagatgctgcaggaaaatcgcgagggacgggcggccccccgacagtccagctcctttcggctcttgcaggaagccctggaggctgaggagagaggtggcacgccagccttcttgcccagctcactgagcccccagtcctccctgcccgcctccagggccctggccacccctcccaagctccacacttgtgagaagtgcagtaccagcatcgcatggggctggcgagggcctggcacggggctgcatagtgcctggagtcaccagcacctacagacggatccccgacgctgcccacgggtgctcatcctgggagagaggtgacaagttcagaggtgtcggcagggaggcactctttctcaaactggcctcccgggactcaggagtggagatggcagttggggacagccccctggccgccttaccgggcctttctcaggactccctggactttgaatcctcagggagttctgagccccccgcccaggtaggccgactcctggccagccagaagctgggggaggtgttggagcggtcccgccggctcccaacagctcccaccagcttgtcaggacaacaccgctccctgcggctggcaagcaagcctgagcgtgaagtgccccttggagcagggcaacaggagtccatggaggcagacacagacctagaggcaggcctggaagaagaggcggtg

SEQ ID NO: 103541 - DNA, 1157 bp, Homo sapiens
  Payload ID: 274
  Gene Symbol:
  Gene Name: AC037482.2
  ENST ID: ENST00000571574
  CDS Start-End: 58-690
aaacccaagaacttcactctcttgaaaacccacccagatcctccccgttctgacaccatggtcagctcctgttgtggctccgtgtgctctgaccagggctgcggccaagtcctctgtcaggagacctgctgccgccccagctgctgtcagaccacctgttgcaggaccacctgctaccgccccagctgttgtgtgtccagctgctgcaggccccagtgctgccagtctgtgtgctgccaacccacctgctgtcgccccagctgctgtgagacgacctgctgccaccctaggtgctgcatctccagctgctgccgccccagctgctgtatgtccagctgctgcaagccccagtgctgccagtctgtgtgctgccagcccacctgctgccaccccagctgctgcatctccagctgctgtcgccccagctgctgtgtgtccaggtgctgcaggccccagtgctgccagtctgtgtgctgccagccaacctgctgccgtcccagctgctgcatctccagctgctgccgcccctcttgctgtgaatccagctgctgccgcccatgctgctgccgcccctgctgctgcctgcgtccagtctgtggccgagtctcctgccacaccacttgctatcgcccaacctgtgtcatctccacctgtccccgccccttgtgctgtgcctcctcttgctgctgagcccactgccctggctcacgtcccccttcaccactggcccacagatgtagacccttctactgtgctgaccattaggatacatgaagtggggttgatgtcattcaataggatggaccttatgcttccaaagagcccaccaccatttcactgactctgtgagaacattctggttcattttaaactccctcccttgctttctttttcttctggtggtggcaccaaatgtgaattaatttgtaatacactagctaagaaattattccaatcttctgatttccttattttctttatcactttaaggtacagattctccttctcagtgaggtagatattatctgcaggaccagttttgtcactgatgttgcaccctcagatccagccacccaattgtattctgtgtttctcctagggtgaatttcttatgctttgttgcatctctgctttctaataaacttttctgcacttaa

SEQ ID NO: 103542 - DNA, 375 bp, Homo sapiens
  Payload ID: 275
  Gene Symbol:
  Gene Name: AC055733.1
  ENST ID: ENST00000624326
  CDS Start-End: 1-375
atgactcttaacgagcatgctgccttcaagcatctgtttaacaaagcacatcttgcaccgcccttaatccatttaaccctgagtggacacagcacatgtttcagagagcacagggttggggataaggtcacagatcaacaggatcccaaggcagaagaatttttcttagtacagaacaaaatgaaaagtctcccatgtctacttctatccatacagacccggcaaccatgcgatttctcaattttttccccacccttcccgcctttctattccacaaaaccgccattgtcatcatggcccatccccaatgagccgctgggcacacctcccagacggggtggtggccgggcagaggggctcctcacttcccagtag

SEQ ID NO: 103543 - DNA, 33 bp, Homo sapiens
  Payload ID: 276
  Gene Symbol:
  Gene Name: AC055866.1
  ENST ID: ENST00000628087
  CDS Start-End: 1-33
ggggactttttacctccaggacaagtggtgctc

SEQ ID NO: 103544 - DNA, 51 bp, Homo sapiens
  Payload ID: 277
  Gene Symbol:
  Gene Name: AC063956.1
  ENST ID: ENST00000623021
  CDS Start-End: 1-51
atcaagttcaggctgtttgccatatcattaattctaatgctgtctgtgaca

SEQ ID NO: 103545 - DNA, 51 bp, Homo sapiens; identical to SEQ ID NO: 103544
  Payload ID: 278
  Gene Symbol:
  Gene Name: AC063956.2
  ENST ID: ENST00000635707
  CDS Start-End: 1-51

SEQ ID NO: 103546 - DNA, 516 bp, Homo sapiens
  Payload ID: 279
  Gene Symbol:
  Gene Name: AC064829.1
  ENST ID: ENST00000624593
  CDS Start-End: 82-369
tcaggcctgcctagatgttgtaggggatcatgggactctcccatggatcccacagagaagacaggtgagagtccaccactgacgcacctccacagaggtctctttctctgccaagccgcaggaaattgtcgcattcaggatatctctgtggtcaggtcccactggaggaagagatttctaaactctgaggtggtcgctgagaactgcttttctgacttcattcccgaaagaggctgtgtgcaagaatcaggtcccatggagattggattattatctggtaaagttgagggaccgcatccacccctcaccagattgtatcctctcccctatctaatcttattcctgctcacactctgtgtcccaaaatgaaattccaagacgatggcggagtgccatgaagctcctgctcagctgtgaaccaaatttgaggtaaattcaaggggccctgaaaacagcacttctagtgtctctccctgggttggttgcaggacaataaaacactgggagatatctgtt

SEQ ID NO: 103547 - DNA, 387 bp, Homo sapiens
  Payload ID: 279
  Gene Symbol:
  Gene Name: AC064829.1
  ENST ID: ENST00000624507
  CDS Start-End: 1-387
atgcaaagccagagaggtctccttctctgccaagccacagggacatgcggcatttgtgctgtctccgttgtagggtccctctggaggaggaggtgtcaagactgtgaagtggtcgctgagaactgcttttctgacttcattcccgaaagaggctgtgtgcaagaatcaggtcccatggagattggattattatctgccttgcacgggctatctgggaaaggcaggcaccatgacaaaggcaagtccaagatcaagcagtgttcccatatgtctaactggcctcttaaaggtgcaggtaaagttgagggaccgcatccacccctcaccagattgtatcctctcccctatctaatcttattcctgctcacactctgtgtcccaaaatga

SEQ ID NO: 103548 - DNA, 375 bp, Homo sapiens
  Payload ID: 280
  Gene Symbol:
  Gene Name: AC066615.1
  ENST ID: ENST00000557832
  CDS Start-End: 1-375
atgactcttaacgagcatgctgccttcaagcatctgtttaacaaagcacatcttgcaccgcccttaatccatttaaccctgagtggacacagcacatgtttcagagagcacagggttggggataaggtcacagatcaacaggatcccaaggcagaagaatttttcttagtacagaacaaaatgaaaagtctcccatgtctacttctatccacacagacccggcaaccatccgatttctcaattttttccccacccttcccgcctttctattccacaaaaccgccattgtcatcatggcccatccccaatgagccgctgggcacacctcccagacggggttgtggccgggcagaggggctcctcacttcccagtag

SEQ ID NO: 103549 - DNA, 922 bp, Homo sapiens
  Payload ID: 281
  Gene Symbol:
  Gene Name: AC068533.7
  ENST ID: ENST00000450043
  CDS Start-End: 1-922
atggatgccactagtgagcgggactttgtggccgagttcctgttctgggcttcgctgtgcatgacccatctcagcaggatggccgaggacctcatcctctactgcaccaaggaattcagcttcgtgcagctctcagatgcctacagcacgggaagcagcctgatgccccagaagaaaaaccccgacagtttggagctgatccggagcaaggctgggcgtgtgtttgggcggtgtgccgggctcctgatgaccctcaagggacttcccagcacctacaacaaagacttacaggaggacaaggaagctgtgtttgaagtgtcagacactatgagtgccgtgctccaggtggccactggcgtcatctctacgctgcagattcaccaagagaacatgggacaggctctcagccccgacatgctggccactgaccttgcctattacctggtccgcaaagggatgccattccgccaggcccacgaggcctccgggaaagctgtgttcatggccgagaccaagggggtcgccctcaaccagctgtcactgcaggagctgcagaccatcaggaaggatgccaattctgcgcttctcagtaactacgaggtatttcagttactaactgatctgaaagagcagcgtaaagaaagtggaaagaataaacacagctctgggcaacagaacttgaacactatcacctatgaaacgttaaaatacatatcaaaaacaccatgcaggcaccagagtcctgaaattgtcagagaatttctcacagcattgaaaagccacaagttgaccaaagctgagaagctccagctgctgaaccaccggcctgtgactgctgtggagatccagctgatggtggaagagagtgaagagcggctcacggaggagcagattgaagctcttctccacaccgtcaccagca

SEQ ID NO: 103550 - DNA, 66 bp, Homo sapiens
  Payload ID: 282
  Gene Symbol:
  Gene Name: AC069063.1
  ENST ID: ENST00000623611
  CDS Start-End: 1-66
atgacacatatttactcaaatttttgttttaataagtctgtctttgcctttgatcttataccaatg

SEQ ID NO: 103551 - DNA, 1318 bp, Homo sapiens
  Payload ID: 283
  Gene Symbol:
  Gene Name: AC069063.2
  ENST ID: ENST00000623916
  CDS Start-End: 1119-1229
atgactctgggtgacaaagatgtagaaacgtagttcatcaattgtaacaaatgtaccgctatgctggaaaacgttactaatggtggaggctatgtatgtggcggtaagatgtgtttagaaaatctccgtatcttatgctcaaatttgctgtgaacctacaattgctctaaaaaaaaatcaagtctattaaaaaatttatcatgtagtagatcttgtataaagtctcaacaaatatcaaagaattaacatcatacaaactctctaagcacaagcaacttaagtaaaaaattaacagaaaaaaattttttgagtcaataggagttattttgggaacaaaacacaaagtaaagacttgaggggattgaaaccatcaggatgaatgtaagccagacgggggcaaattgcagaatgtcaattgccttaacctaggaaaggtaaatttctaaaaatgataccaaatggttaaaaatcactaaatgaggaattgaagagaatttcaggttagaaggttgtaaaaagtgaaataattgtccaaagtcaccaaactagttcacgagaaagctggaactagaaactcatgcctctcaatccagtgttctttccactgtaacagattggcaccatagaacatgtttgactcaaggcagtaaattaagtacactgaagaaaaagataagaaaaaagtgataaaatgtaaagtctttgattcagacccaagtattacagctgctatggcaaaaaatagccacaatttctaagtgactttaaccaggaaaaaaagaaagagatgagatttgaaaaggaattaaatttcaagaatcaacaggaagtgatgacagccttccctatttggtagtttcaggcctgaacttttgtcattaaggtaataattcaaagtgctttaatgcctggactgaccacactaaataacaaaattataacccgttgagctacggtcagttttataaactgtgcctaaaatttcctgagttcaaatctgattataaatgggcaataaattcatctgttcattgggctgatttactttattttctgggtgcatttaaaatcttttttattgtggaaactttcaaacatacaaaaagagtacataataaatgattcccttgtacccatcattcaatttcaataagtcacattttgcctttcaaattttacctattgccactaacatcctttttttttctggagtagctgaactgatttaagatgaaggaggaaaaataaaggatgaaaggaatattttcaatctgttattcattgatactctagccaaaaagattccagattatgaggc

SEQ ID NO: 103552 - DNA, 750 bp, Homo sapiens
  Payload ID: 284
  Gene Symbol:
  Gene Name: AC069368.3
  ENST ID: ENST00000437723
  CDS Start-End: 70-750
gacgcggtggcagagcccgcgcggcgctggaagcgagtggcggagcggcgggacctcggcggactcgccatggaggaggagggtgtgaaggaagccggtgagaagcctcggggagcacagatggtggacaaggctggctggatcaagaagagcagtgggggcctcctgggtttctggaaagaccgatatctgctcctctgccaggcccagctgctggtctatgagaatgaggatgatcagaagtgtgtggagactgtggagctgggcagctatgagaagtgccaggaccttcgtgccctcctcaagcgaaaacaccgctttatcctgctgcgatccccagggaacaaggtcagcgacatcaaattccaggcacccaccggggaggagaaggaatcctggatcaaagccctcaatgaagggattaaccgaggcaaaaacaaggctttcgatgaggtaaaggtggacaagagctgcgccctggagcatgtgacacgggaccgggtgcgagggggccagcgacgccggccaccaacgagagtccacctgaaggagtttgggatgaatgcgcttctcctgtctgcctggttcggccacttacgaatcctccagatcttggtaaactcaggggccaagatccactgtgagagcaaggaggggaacactgcccttcatctggctgctggtcggggccatatggctgtgctgcagcgacttgtggacatcgggctggacctggaggagcagaatgcg

SEQ ID NO: 103553 - DNA, 48 bp, Homo sapiens
  Payload ID: 285
  Gene Symbol:
  Gene Name: AC069499.1
  ENST ID: ENST00000625266
  CDS Start-End: 1-48
gccaaaagcagttgtctcaaagctttgctgataagagtttcacattat

SEQ ID NO: 103554 - DNA, 123 bp, Homo sapiens
  Payload ID: 286
  Gene Symbol:
  Gene Name: AC073072.1
  ENST ID: ENST00000625271
  CDS Start-End: 1-123
tggctcatgcctgtaatctcagcactttgggaggctaaggtgggtggatcacctgagatctgttcattttcaggagttcaagaccagcctgggcaacatggtgaaactcagtctctacaaaaa

SEQ ID NO: 103555 - DNA, 48 bp, Homo sapiens
  Payload ID: 287
  Gene Symbol:
  Gene Name: AC073130.2
  ENST ID: ENST00000628802
  CDS Start-End: 1-48
ctagaacaggaatcagaagtcaaaaaaatgggcaaaggacatgaacag

SEQ ID NO: 103556 - DNA, 381 bp, Homo sapiens
  Payload ID: 288
  Gene Symbol:
  Gene Name: AC073333.1
  ENST ID: ENST00000623891
  CDS Start-End: 1-381
atggtgatgactcttaacgagcatgctgccttcaagcatctgtttaacaaagcacatcttgcaccgcccttaatccatttaaccctgagtggacacagcacatgtttcagagagcacagggttgggggtaaggtcatagatcaacaggatcccaaggcagaagaatttttcttagtacagaacaaaatgaaaagtctcccatgtctacttctttctacacagacacagcaaccatccgatttctcaatcttttccccacctttcccccttttctattccacaaaaccgccattgtcatcatggcccgttctcaatgagctgttgggtacacctcccagacggggtggtggccgggcagaggggctcctcacttcccagtag

SEQ ID NO: 103557 - DNA, 406 bp, Homo sapiens
  Payload ID: 289
  Gene Symbol:
  Gene Name: AC073610.5
  ENST ID: ENST00000537495
  CDS Start-End: 1-189
aacaaacaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaacggatgcagtggtgcagtatgacgtggagctgattgcactaatccgagccaactactggctaaagctggtgaagggcattttgcctctggtagggatggccatggtgccagccctcctgggcctcattgggtatcacctatacagaaaggccaatagacccaaagtctccaaaaagaagctcaaggaagagaaacgaaacaagagcaaaaagaaataataaataataaattttaaaaaa

SEQ ID NO: 103558 - DNA, 183 bp, Homo sapiens
  Payload ID: 290
  Gene Symbol:
  Gene Name: AC073657.1
  ENST ID: ENST00000624812
  CDS Start-End: 1-183
aagaatcagagtttcttttttttgagacggagttttgctctgtcacccaggctggagtgcagtggcgcgatctcggctcactgtaagctctgcctcccgggttcacgccattctcctgccccagctactcgggaggctgaggcaagagaatcacttgaacccgggaggtggaggttgcagtga

SEQ ID NO: 103559 - DNA, 45 bp, Homo sapiens
  Payload ID: 291
  Gene Symbol:
  Gene Name: AC074033.1
  ENST ID: ENST00000626819
  CDS Start-End: 1-45
tctggaagtaactttgatcctttcttgcaaaaactgctcaaaatt

SEQ ID NO: 103560 - DNA, 648 bp, Homo sapiens
  Payload ID: 292
  Gene Symbol:
  Gene Name: AC079355.1
  ENST ID: ENST00000621874
  CDS Start-End: 1-648
acggcctccggtcggtgggcttctccaggcccagcttgggcctcccggcggcctctgcaggcccaagtggtcctgaagtcagcctctccaggcccagctccggcctcccagcaagcaagctcttttggctcagctcctgcccagctcccgccggcttttgtagaccctgaactttctccagcgaagctcctcagtcccacctcctgcctcccggtggcctgtacaggcccaggtctggctggagaacagcctctgcaggccccgctcttgcctcccaggggcgtctccaggcccagctctcgcctcacggcggcctcccgggaccaagtccctgcctgcctcccagcagcctgtgtgcggcccagctcctccgttacggtggcctgtggcccaactcatgcctctggcaccctttccagaggcgtgagcccctgcctcacattggcctctctcacgctgagggaggtcagcgtgagcccctgcctcacactggcctctctcacgctgagggaggtcagcgtgagcccctgcctcacactggcctctctcacgctgagagaagtcctccctcacgctggcctgttgaggcccagttcatgcctctgttggcttctcctggcccagcccctgcctgttggcggcctctag

SEQ ID NO: 103561 - DNA, 63 bp, Homo sapiens
  Payload ID: 293
  Gene Symbol:
  Gene Name: AC079907.1
  ENST ID: ENST00000626900
  CDS Start-End: 1-63
aacagattttcactaattgtggaccacgagacagggtcttgctctgtcacccaggctggagtg

SEQ ID NO: 103562 - DNA, 3766 bp, Homo sapiens
  Payload ID: 294
  Gene Symbol:
  Gene Name: AC084219.2
  ENST ID: ENST00000591793
  CDS Start-End: 84-1880
tttaccacagtagtttgagtcatttccacatcttgcgagtccttccgaacgagtctcctttccttggggctcgcaaccacccaatgatcgattcaggagaaaagaagcctgggcggagagcagaggaggcagtgaccttcaaggatgtggctgtgatcttcactgaggaggagctggggctgctggaccctgcccagaggaagctgtaccgagatgtgatgcttgagaacttcaggaacctgctctcagtggggcatcaaccattccatggagatactttccacttcctaagggaagaaaagttttgggtgatggggacaacaagccaaagagaagggaatttgggcacaattctgctttccctggaactgtgtcattcaggactctgcaaattccctaaagtaggaggaaaaatgaccatgtccaaggaggcagtgaccttcaaggatgtggcagtggtcttcactgaggaggagctggggctgctggaccttgcccagaggaagctgtatcgagatgtgatgctggagaacttcaggaacctgctgtcagtggggcatcaaccattccaccgagatactttccactttctaagggaggaaaagttttggatgatggatatagcaacccaaagggaagggaattcaggaggcaagatccaacctgagatgaagacttttccagaagcaggaccacatgaagggtggtcctgccagcagatctgggaagaaattgcaagtgatttaaccaggcctcaagactctaccataaagagctctcagttctttgaacagggtgatgcccactcccaggttgaggaaggactatctataatgcacacaggacagaaaccttccaattgtgggaagtgtaaacaatccttcagtgatatgtccatctttgatcttcctcagcaaatacgctcagcagagaagtctcattcctgtgatgagtgtggaaaaagcttctgttacatctcagcgcttcatattcatcagagagtccacctgggagagaaactctttaagtgtgacgtgtgtggtaaggaattcagtcagagtttacatctgcaaactcatcagagagtccatactggagagaaacctttcaaatgtgaacaatgtgggagaggcttcagatgtagatcagcacttacagttcattgcaaattacacatgggagagaaacattataattgtgaggcatgtgggagggccttcattcatgatttccagcttcagaaacatcagagaattcacacaggggagaagccattcaaatgtgagatatgtagtgtgagcttccgtcttaggtcaagtcttaataggcattgtgtggtccacacaggaaagaaaccaaacagcactggggaatatggaaaaggcttcattcgtaggctggatttgtgtaagcatcagacgatccacacaggagagaaaccatataattgtaaagaatgtgggaagagcttcagacggtcctcctatcttttgatccatcagcgagtccacactggagaaaagccatacaaatgtgacaagtgtgggaagagctacattactaagtcaggtcttgacttgcaccatagagcccacacaggagagagaccttataactgtgatgactgtgggaagagctttagacaggcctcaagtattttgaatcataagagactccattgccgaaaaaaaccattcaaatgtgaggattgtggaaagaagcttgtataccggtcataccgtaaagaccaacaaaaaaaccacagtggagaaaatccatccaaatgtgaagactgtgggaagcgctacaagaggcgcttgaatcttgatataattttatcattatttttaaatgacacgcacaattctgtcttctcttgaactgcataactgagaactctgcaaattccccaaagaaggaggaaaaatgaccatgttcaaggaggcagtgaccttcaaggatgtggctgtggtcttcaccgaggaggagctggggctgctggacgtttcccagaggaagctgtatcgagatgtcatgctggagaacttcagaaacctgctatcagtggggcatcaactttcccaccgagatacttttcacttccaaagagaagaaaagttttggatcatggagacagcaacccaaagagaagggaattcaggaggcaagatccaaactgagttggagtctgttccagaaacaggaccacatgaagagtggtcttgccagcaaatctgggaacaaactgcaagtgagttaactagacctcaagactccataagtagctctcagttctccacacaaggtgatgtcccctcccaggttgacgcaggactatctataattcacataggagagacaccttctgagcatgggaagtgtaaaaaattcttcagtgatgtctccatccttgatcttcatcaacaattacactcaggaaagatatcccatacatgtaatgagtacaggaagagattctgttatagctcagctctttgtcttcatcagaaagttcacatgggagagaaacgctataagtgtgatgtgtgtagtaaggcatttagtcagaactcacaactgcaaactcatcagagaatccacactggagagaaaccattcaaatgtgagcagtgtgggaaaagtttcagccgtagatcaggaatgtatgttcattgcaaattacacacaggagaaaaacctcatatttgtgaggaatgtgggaaggccttcattcacaattcccagcttcgggaacatcaaagaatccatactggggagaagccattcaaatgttatatatgtggtaagagcttccatagtagatcaaatcttaataggcattccatggtccacatgcaagagaaatcatttagatgtgatacctgtagtaatagctttggtcagagatcagcacttaatagtcattgcatggaccacacaaaagagaaactatacaaatgtgaagaatgtggaaggagcttcacttgtaggcaagatctttgtaagcatcagatggaccatacaggagacaaaccatataattgtaatgtatgtgggaagggcttcaggtggtcctcatgtctttcaagacatcagcgggtccacaatggagaaacaacattcaagtgcgacggatgtgggaagagattttatatgaattcacagggccattcacatcagagagcctatagagaagaagaactgtataaatgtcagaagtgtgggaagggctacattagtaagtttaatcttgacttgcaccagagggtccacacgggagagagaccttataattgtaaggaatgtggaaagagcttcaggtgggcctcaggtattttgagacataagagactccatactggagaaaaaccattcaaatgtgaagagtgtgggaagaggtttactgagaattcaaaacttcgtttccatcaaagaattcacactggagaaaagccttacaaatgtgaggagtgtggaaagggattcagatgggcctcaactcatctaacccatcaaagactccacagcagagaaaaactattccaatgtgaggattgtgggaagagcagtgagcacagttcatgccttcaagaccaacaaagcgaccacagtggagaaaaaacatccaaatgtgaggactgtgggaagcgctacgagaggcgcttgaatctagatatgattttatcattatttttaaatgatatataattattgtccatatttatgggttacagcatatttcaatacatgtatacaatgtataatg

SEQ ID NO: 103563 - DNA, 96 bp, Homo sapiens
  Payload ID: 295
  Gene Symbol:
  Gene Name: AC087350.1
  ENST ID: ENST00000626876
  CDS Start-End: 1-96
tttttggtcttgaagaaatttaaaggtttaaccttcactcagtctaagtgttttagcaaagttatgctttaccctggtccaagttattatattgta

SEQ ID NO: 103564 - DNA, 57 bp, Homo sapiens
  Payload ID: 296
  Gene Symbol:
  Gene Name: AC087392.1
  ENST ID: ENST00000631259
  CDS Start-End: 1-57
tgttctactgtccggctggagtgtactggcatgatctctgctcactgcaacctctgc

SEQ ID NO: 103565 - DNA, 63 bp, Homo sapiens
  Payload ID: 297
  Gene Symbol:
  Gene Name: AC087651.1
  ENST ID: ENST00000626282
  CDS Start-End: 1-63
cgcgccctgaggccctctgtgctccccgggtccacggtccgcatcaaacctgaacttggtggg

SEQ ID NO: 103566 - DNA, 63 bp, Homo sapiens
  Payload ID: 298
  Gene Symbol:
  Gene Name: AC087651.2
  ENST ID: ENST00000629937
  CDS Start-End: 1-63
caaatgcaaaaagctgttcaatcaagcctcaagagatggggtttcaccatcttggccaggctg

SEQ ID NO: 103567 - DNA, 1766 bp, Homo sapiens
  Payload ID: 299
  Gene Symbol:
  Gene Name: AC087762.1
  ENST ID: ENST00000623469
  CDS Start-End: 751-1275
ctccccacccctctttgttgtgtaagtgtgattggtcacacatcacagaaaactcatatagcagatatttgccacgtaacgtagaatttgaaagcacatctatgccataggaaacggctaattgccttgactcaggagtgcccccaagagcctgtctcattgggaatccttcagctgtcccaagaggaaaccattgcgttgacttttgtgacagtcatgtacttggttttaatgatgtttatcacttacttacaagttcttaagcaccagagttgagttgggcctctttctgcccctgggatcactgggcatgtcctcgtcagtgcctgatttcttttgctcagtgtgtttgggggatccttctatttcattgcctggtcttcgctcatttcctattgcagttccgtgcatggcccattacatgaacacaaccattgttttctctcttccattgttttctctcttctgctattgatggactcggggttgcttctgatctttggctcttaggaaggttgccccataaacatcctcttacctgtctccaggtgcacctgtgcacagtgcctgccagaaaagtacctgggggtggaactgagtttcttcactttggcaggtgctgcagacggtcagcttctcttctcaccagcagtgggagagccccctgtgctccagccctccccagagctggggatcatcagacctgagagccacaggtcctcgtccatgtgtagctgaccagatgtgaggatgctctgcccatgtttggggacagcttcttttcctctccccatctggctccccgctgctccctgtgtgcccaccccacctgccccggtgtttggctggcctcctcttcctgctgagccagtgcctctaaggagctgccagcagtggggatgcgccaggcctcctccagttctccagggcgcaggctttctgctgcgaccatcccgggtctcatcgagctctgcaccctgcacccgcagcgctgacctcacggagtctgcccctctgctgcagcttgccctggcctcctgcctgcctctttctgatcctgtcgtcttttgcctccttggcctccctcctggccttgctgctgtctcccttcctcagcttgtcttttggggaatctctaaccttccagaactccctctgcccatatggagccccgatctgggcagcaccacccctttgcaaaactcccctccgtccacacctccctggggcttgcaggcaccatccaaggaacagcaggactcaccatctcagtgagccagggcagggtagcccgggtctgaggcagcgtgggattgggagtctgagccatggcgtgggctatgggacctgggccaggcagcaaatgtctctaagctctcctgttctcatccataaaagaacataattataaggattcagtgagagaatatccacggcagtgtttgggagtgatgtgctacctggctcagaagtcactgtgaacatcattgtccctttctgtaatgtagctttctgtcatgcatctagctagtatgtaaggagaacctggtgcacacaggctgttacttcaccttatcttgttgtggagtgctcgtaactgcccgccaggaggtaggcaccgtgttcctctctgctttacagaagaggaaaccgaggcctaggaagggggctggccttggctgagatgtcacccctgatgacaggcaaagctgggaatctcatctctgtggccagactcccagcaccatcatgcacggctttctgga

SEQ ID NO: 103568 - DNA, 171 bp, Homo sapiens
  Payload ID: 300
  Gene Symbol:
  Gene Name: AC090154.1
  ENST ID: ENST00000623055
  CDS Start-End: 1-171
ggctgggcgcggtggctcacacctgtaatcccagcactttgggagactgaggcaggcggatcacctgaggtcaggagttcaagaccagcctggccaacatggcgaaaccccgtttctacaaaaatgactaagttgttgcaaatatatgaacttatgcttgaatatcaggct

SEQ ID NO: 103569 - DNA, 407 bp, Homo sapiens
  Payload ID: 301
  Gene Symbol:
  Gene Name: AC090498.1
  ENST ID: ENST00000623936
  CDS Start-End: 28-105
cgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcatgaacaaaatgcccatgttggtcctctgccctggacctgtgacattctggactatttctgtgtttatttgtggccgagtgtaacaaccatataataaatcacctcttccgcggttttagctgaagaatt

SEQ ID NO: 103570 - DNA, 533 bp, Homo sapiens
  Payload ID: 302
  Gene Symbol:
  Gene Name: AC090958.1
  ENST ID: ENST00000630055
  CDS Start-End: 210-533
atctgggctgcgtcttctcgccgctgctcttcgtggcccaacgccccaatccttgcgtgtgcttgcagtcccaccccacactcagccttgtgtccctcgatccagtctccgacttccatttcccaccctaaaccgcctacccggtgtctgttccccgcccggttgtcctcgccctgctgcgctgagtgtcccctgttagcctcgaccccatggcgctgcagacgctgcagagctcgtgggtgaccttccgcaagatcctgtctcacttccccgaggagctgagtctggctttcgtctacggctccggggtgtaccgccaggcagggccgagttcagaccagaagtcatatctgacggcagcttccagaacatgctggctcccatatccacagagcactttcctccaacacggctccctacccttccctgtgcttcccccagtgcttccagcaagtctgtttaactcacgtgtccttcaagactcagatttgtcatctctaggagaatttctccctcctgtgcccctgatctga

SEQ ID NO: 103571 - DNA, 51 bp, Homo sapiens
  Payload ID: 303
  Gene Symbol:
  Gene Name: AC091180.1
  ENST ID: ENST00000628664
  CDS Start-End: 1-51
agcaaggtggagcaaaacacgaccccttcccctcaccctcctcaacctgaa

SEQ ID NO: 103572 - DNA, 78 bp, Homo sapiens
  Payload ID: 304
  Gene Symbol:
  Gene Name: AC091304.2
  ENST ID: ENST00000617112
  CDS Start-End: 1-78
atgagagccaagtggaggaagaagcgaatgcgcaggctgaagcgcaaaagaagaaagatgaggcagaggtccaagtaa

SEQ ID NO: 103573 - DNA, 550 bp, Homo sapiens
  Payload ID: 305
  Gene Symbol:
  Gene Name: AC092159.1
  ENST ID: ENST00000624944
  CDS Start-End: 88-228
actttctaactctgtaggacacagcaaatcaaaatagaggtcctgggagggatccactaatttagtgagttagacaaagaatgatttatggcagtaaccacattcaggagaaatattcctataaaaactcagcaaatatggaaaactgagcacatgaagcaaaaatatttaaagattttcagaaatttggaaaacctaaattacattttaagacataggatgtcatgatctattttgtgctgatatagtagaatacctgagactgggtagcttataataaacagaaatgtattggctcacagttctggaagctggaagctcaatatcaaggtgttggcatcttgcaagggcctccttgctgtgccatcatatggcagaacgcacagagaaggagagaaccactccattaatcccaccatgagggcagggctcctgtggcctaacgacctcttaaaagtctccctctaaatactgatggaatgccaattaagactcaatgtgagttttggaggggacaaacattcagaccttagcacaggaatcatgaatg

SEQ ID NO: 103574 - DNA, 48 bp, Homo sapiens
  Payload ID: 306
  Gene Symbol:
  Gene Name: AC092384.1
  ENST ID: ENST00000629085
  CDS Start-End: 1-48
gcagacggcgatcgccagcttctccaacagaaggtgagaagcttcccc

SEQ ID NO: 103575 - DNA, 921 bp, Homo sapiens
  Payload ID: 307
  Gene Symbol:
  Gene Name: AC092718.1
  ENST ID: ENST00000624382
  CDS Start-End: 1-921
atgggggaggactctccagtggctatgttcagctggtatttggacaacaccccaacagagcaggctgagcccctcctggatgcctgcagactcagaggattttggccaaggtccttaaccctcctccagagcaacacctccacgttgctgttgaacagctcgtttctgcagtcccggggagaggtcatccgaatcagagccacagcactgaccaggcatgcctatggggaggacacctatgtgatcagcactgtgcctccccgtgaggtgcctgcctgcactattgccccagaggagggcaccgttctgacgagctttgccatcttctgcaacgcctccacagccctgggacccctggagttctgcttctgtctggaatcaggttcctgcctacactgtggccctgaacctgccctcccatcagtgtatctgccacttggagaggagaacaatgactttgtgctgacagtagttatttctgccaccaatcgtgcaggggacacgcagcagacccaggccatggctaaggtggcactcggagacacatgtgttgaggatgtagcattccaggctgccgtgtcagagaaaatccccacagctctgcaaggcgagggtggccccgagcagctcctccagctggccaaggctgtgtcctccatgctgaaccaagagcatgaaagccagggctcaggacagtcactgagcatagacgtcagacagaaggtcagagagcatgtgctgggatcactgtctgcagtcaccaccggcttggaggacgtgcagagggtgcaggagctggccgaggtgctgagagaggtgacctgccggagtaaggaactcacaccctcggcccaggggtcctgcatgggcgattcatgggaaggtgcccctcctgctgcccatgtatctcacgctaggtga

SEQ ID NO: 103576 - DNA, 1850 bp, Homo sapiens
  Payload ID: 308
  Gene Symbol:
  Gene Name: AC092835.2
  ENST ID: ENST00000425953
  CDS Start-End: 282-1850
gttggccggcgctaggcgtccccgccggctgttagatgcctttgtcgtcgggctcggcttcctcagtgtgtggctggaggtcgaacccagggtagaggagggctgaacgcatccccttttaatctgagtgtccgggaggagggtggcgggaggacccccgggtgggggcgccaggctgcccacgcgtgcgttcccggcctcttgggggacccgagcggcggacctccggctccttcccctgtcgcggttgcctccagcgcgggccggaggaaggagtctccatggaacctgagggcagaggatcactttttgaggactcagaccttctccatgctggaaacccaaaagaaaatgacgtgactgctgtgctgctgacccctgggtcccaagaattgatgatcagggatatggccgaggctctcacccagtggaggcagctgaactctcctcagggagatgtgcctgagaagcctaggaatctggtcttgctggggcttccaatttccacacctgatgtaatctctcagttggagcatgaggaagagctggagagagaagtctcaaaggcagccagtcaaaagcactgggaaacaataccagaaagcaaggagctaactccagagaaggatatttctgaagaagaatcggctcctggggtgttaattgtaagattttcaaaggaaagttctagtgaatgtgaggattctttagagagtcagcaggaaaaccatgagaaacatttaatacaagaggctgtcactgagaaatcttctagggagagaagctaccaatctgatgaatttagaagaaattgcactcagaggtccttacttgttcagcagcaaggagagagactacatcattgtgattcatttaaaaataacttaaaacaaaattcagatataattaggcatgagagaatttgtgcaggaaagaaaccttggaaatgcaatgaatgcgagaaagccttcagttactactcagcttttgtcttgcatcagagaattcacacaggagaaaaaccctatgaatgtaacgaatgtggtaaagcctttagccagagcatacaccttactctgcaccagagaattcatactggggagaaaccctatgaatgtcatgagtgtgggaaagccttcagtcaccgctcagcccttattcggcatcatataattcatactggagaaaaaccctatgaatgcaatgaatgcgggaaggcctttaatcagagttcatacctcactcaacatcagcgaattcatactggagagaaaccttatgagtgtaatgaatgtgggaaggccttcagccaaagcacattccttacccagcatcaggtcattcacactggagagaaaccttataagtgtaacgaatgtggcaaagcctttagtgatcggtcaggtcttatccagcaccagagaactcatactggggagcggccatatgagtgtaacgaatgtgggaaagcctttggctactgctcagccctgactcagcaccagaggactcacactggggagaaaccctataaatgcaatgattgtgccaaagccttcagtgaccgctcagcccttattcgtcatcagagaacacacactggagagaaaccttacaaatgtaaagattgtggaaaagcattcagccagagctcatctcttacaaagcatcagaaaactcacactggagaaaagccctacaagtgtaaggaatgtggaaaagcctttagccagagttcatccctctctcaacatcagaaaactcatgctggagtgaaaaccaagaaatatgtccaagctcttagtgagcatttaacctttggccaacacaagagaattcatactggataa

SEQ ID NO: 103577 - DNA, 475 bp, Homo sapiens
  Payload ID: 308
  Gene Symbol:
  Gene Name: AC092835.2
  ENST ID: ENST00000614286
  CDS Start-End: 106-475
tgcccacgcgtgcgttcccggcctcttgggggacccgagcggcggacctccggctccttcccctgtcgcggttgcctccagcgcgggccggaggaaggagtctccatggaacctgagggcagaggatcactttttgaggactcagaccttctccatgctggaaacccaaaagaaaatgacgtgactgctgtgctgctgacccctgggtcccaagaattgatgatcagggatatggccgaggctctcacccagtggaggcagctgaactctcctcagggagatgtgcctgagaagcctaggaatctggtcttgctggggcttccaatttccacacctgatgtaatctctcagttggagcatgaggaagagctggagagagaagtctcaaaggcagccagtcaaaagcggaattctcttggcgacaactccccattgaagaatgttcctttcttctggagaaaggagggcacctttc

SEQ ID NO: 103578 - DNA, 2598 bp, Homo sapiens
  Payload ID: 309
  Gene Symbol:
  Gene Name: AC092881.1
  ENST ID: ENST00000623993
  CDS Start-End: 2221-2577
ggcacccaataaatacataattattagaatgaatacattctatcacaatgtcttaattcaacagattcttggcacctgtggatttaacactggtagtttctactatgtacaaatggctttctagggtcatggcattcaggtatcaaagaaactgatgttttcagctcatgttcacatagttactcttacaaagtaatataatcctggttctactacttacaatctgtgtaaccttgaacaaattccttaaactcttgtggagctgctgtgaaggttaaatgagttaattcacataaatacttaaaatcgcatctgatacacagtagataatattcaataaatattagctctgtgtgtgtgtgtgtgcgtgtgtcatacttatgaaaagaaagccaacaggtggtaccaaaagtgaagataaaataagatagtctaatcaagtgatggttttcacacacacaaaaaggatgttttatggtggaaaatgttattctatagctgtgttcttgaactttaaaagtagcaatgatcttgaaataaatctctcagaaatgtgaagactgtacttcttgctgaaatcaatataacagcctaacaggtgtctcctgtcttgataaagtaggccattcctaaatctatcccatgctgtggatgttattcccactgctaaaacaactttactcacagtctgttcaatgctaatctcaaatataatctcatcagtaaattcttttcctaatcattttccaagatacctgattactcctgtctttgaaatatccaaatagtctacagccgtaccatcctgaatgtgccctatctcatctgaaacatccaaataacctcgaacttcttattctactacatagtaaaatcatttgtgtacttatcctactagattatatgagactgcttcttgttcatcatgcattcaagatttactgagtgcttgtcatatgcgaggtacagaggatacaaaggcaatgaggacatgcaataaataatgcagcaacaccatagcagtaggtacactatgcagagatggcataaatgaggatgatctcttctaccacacatctgcagtatctagaatggcacaacatgtatggtagggacccataagtatttgtcaactttaattcctacctgctttttgaagtttttccataccactatagcttccctttttttttggttctcctcaaggagaatggtatagacagaatttgctccctaaaagtctgtctacaccattctgcacatggtatcttttaatctatgtgttagcatcacaggctgttatttaatattttacatataaatatgtcctatcttccccaactataaaacatgtgttcaaaagagcaagaaatcctagagcactctgtacttattactaagcatttagtatctgttcaatggtcctacaatttccgaaagcaaccaaaatatgtcatgcacctatttacatagctgatagcatcacttctgaaccaccccacctgtgctctgggttctctatgaaacaagtagctttcacataggtgttcttaaagcaggaggccaaagaaatgtctgctggaagcatgagactatgtcattgttctcaagctaggagtccagaacttagaaattctgacagatttagctcttcttccatctagatgcctgggtcctctgagaattcagacacaaatttgtataatgaattcacccagatattttgctaagctaggtgcctataagataatatgcacacagaaagcactcagtaaatgacagtttcctttttctccaatcttacaaggtcctagatcctgttggtaactaagaaaaggtaaatgcaactatcaaccacttaattccaatgctttgactatccaggagaaattaattcctggttccctgttgattctaatctaggagacagcttaagggagctcatgggtcttgaagcttataaggtgtacagtaagtcttcacttaatgccactgatcattcttggaaactgtgatttcaggcaaaaatacatacagcaggtccttgaatagtgttgtttcattcaacttcattccattgtaatgttgatgagaacaaaaaattggttttgttatatgtagttttgcttcaagtcgcagtttcaaaaaacttatgttaagtgaggacttaattcacctgaaagcttatcacacactcaaatataacaaataggaaacattatgcaacttgaatacaagagtatgttcattggtttctatagttatcattccatgtacagtattcacgtgaattattggatgaaaagtccaattatttacatatttggatacaatcatactatactagaactgaagaccatacaggtctctgttccagcattttctggctacctcatggcactgcataatcacttccacccaaatctagccaaatctaagtttaagcacttctgtatctattccaagacaaactccctttcttgtttaatctcagtgactcttacttctagagagggcactcttccttctatatctcttccacctctaacctttctaaccatcaagaacatacaatagatagtagatctcacattttta

SEQ ID NO: 103579 - DNA, 60 bp, Homo sapiens
  Payload ID: 310
  Gene Symbol:
  Gene Name: AC100821.2
  ENST ID: ENST00000625207
  CDS Start-End: 1-60
gaattgatgcaggaagtaaaaaatatttccataaagttagaaaatttaaggtggtatcca

SEQ ID NO: 103580 - DNA, 903 bp, Homo sapiens
  Payload ID: 311
  Gene Symbol:
  Gene Name: AC104057.1
  ENST ID: ENST00000624636
  CDS Start-End: 1-903
atgagagggccggaccagatggaaattcgggggggtccgtatctcctgctcggtgaggtcgttggacacagcgcacttggtgcccagcccgcgcaggctgccaatggagatgccgatgagcttctggagctgtccgcactgctgcagccccgggctggccggggcccctgcgccaccctcagcggccgctgcatcacccccgccaccgccctccttcttctctcccatcgcctccgcgcgcagtgccgccctatgcaggccacagcggccgaggcagggagcccggggctcgggcgcctaggcaaggaacccccgagccgggagagctggaccgggagcgcccctcggcgctgcccttgccaggacgccagtagagctggcagcggagtctgccgctcccgccctcagagccgcggcggcgggagcagaaagccgcggcggcaaaaagccgcggcgacggggcaaaaagccgcggcggcgcaggcaaaaagcttaggcggcgggggcaaaaagccgcggcggcaaaaatgcgcggcggggcaaaaagccgcggcggaagaaagccgccggggcgggggcaaaaagccgcggcgggggggacaaaaagcagtgggagctggggcaaaaaaaccacaaaaagccgcggcggcggggaccaaaacgccgcggcggcggaggcaaaaagctgcaaaagccgcggtgtgggggcagaaagccgcagcgggagaaagtctcactccaaattcccttgcttcagtaagcttctctaggccaatgttccttcggcattacccattttcttcctgtgaatgcaaatcacataaacatggaagtacatttgaccattttaattgtttaacattccatgtcacacgaccttccacaatagaatcaatgtattaa

SEQ ID NO: 103581 - DNA, 906 bp, Homo sapiens
  Payload ID: 312
  Gene Symbol:
  Gene Name: AC104073.2
  ENST ID: ENST00000624631
  CDS Start-End: 1-906
atgagagggccggaccagatggaaattcgggggggtccgtatctcctgctcggtgaggtcgttggacacagcgcacttggtgcccagcccgcgcaggctgccaatggagatgccgatgagcttctggagctgtctgcactgctgcagccccgggctggccggggcccctgcgccaccctcagcggccgctgcatcacccccgccaccgccctccttcttctctcccatcgcctccgcgcgcagtgccgctctatgcaggccacagcggccgaggcagggagcccggggctctggcgcctaggcaaggaacccccgagccgggagagctggaccgggagcgcccctcggcgctgcccttgccaggacgccagtagagctggcagcggagtctgccgctcccgccctcagagccgtggcggcgggagcagaaagccgcggcggcaaaaagccgcggcgacggggcaaaaagccgcggcggcgcaggcaaaaagcttaggcggcgggggcaaaaagccgcggcggcaaaaatgcgcggcggcggggcaaaaagccgcggcggaagaaagccgccggggcgggggcaaaaagccgcggcgggggggacaaaaagcagtgggagctggggcaaaaaaaccacaaaaagccgcggcggcggggaccaaaacgccgcggcagcggaggcaaaaagctgcaaaagccgcggtgtgggggcagaaagccgcagcgggagaaagtctcactccaaattcccttgcttcagtaagcttctctaggccaatgttccttcggcattacccattttcttcctgtgaatgcaaatcacataaacatggaagtacatttgaccattttaattgtttaacattccatgtcacacgaccttccacaatagaatcaatgtattaa

SEQ ID NO: 103582 - DNA, 411 bp, Homo sapiens
  Payload ID: 313
  Gene Symbol:
  Gene Name: AC104389.1
  ENST ID: ENST00000624109
  CDS Start-End: 1-411
atggattgccaaaacggtcaccagcacatttcccaggagctggaagttctcaggatccacatgcagcttgtcacagtgcagttcactcagctgggcaaaggtgcccttgagatcatccaggtgctttatggcatctcccaaggaagtcagcaccttcttgccatgtgccttgactttggggttgcccatgatggcagaggcagaggacaggttgccaaagctgtcaaagaacctctgggtccatgggtagacaaccaggagcctccttcccagggtttctcctccagcatcttccacattcaccttgccccacaggcttgtgatagtagccttgtcctcctctgtgaaatgacccatggcgtctggactaggagcttattgataacctcagacgttccagaagcgagtgtg

SEQ ID NO: 103583 - DNA, 411 bp, Homo sapiens
  Payload ID: 314
  Gene Symbol:
  Gene Name: AC104389.2
  ENST ID: ENST00000623781
  CDS Start-End: 1-411
atggattgccaaaacggtcaccagcacatttcccaggagctggaagttctcaggatccacatgcagcttgtcacagtgcagttcactcagctgggcaaaggtgcccttgagatcatccaggtgctttgtggcatctcccaaggaagtcagcaccttcttgccatgtgccttgactttggggttgcccatgatggcagaggcagaggacaggttgccaaagctgtcaaagaacctctgggtccatgggtagacaaccaggagcctccttcccagggtttctcctccagcatcttccacattcaccttgccccacaggcttgtgatagtagccttgtcctcctctgtgaaatgacccatggcgtctggactaggagcttattgataacctcagacgttccagaagcgagtgtg

SEQ ID NO: 103584 - DNA, 580 bp, Homo sapiens
  Payload ID: 315
  Gene Symbol:
  Gene Name: AC104532.2
  ENST ID: ENST00000588891
  CDS Start-End: 51-257
agttccgggccgcctgggggcgtggccgggcctgtacagcagcctgggccatgtcggcgccgccggccctgcagatccgggaggcaaacgcacacctggcagccgtgcaccggcgcgcagcggagctggaggcgcggctggacgcggcggagcgcacggtgcacgcccaagccgagcgcctggccctccacgaccagcagctgcgcgccgccctagacgaactgggtcgcgccaaggaccgaggcaccttccactagcaacagtctccccaggcacaacacagctaacacaaggccccgcaggcaggactctgggacagacgcaggccagctgcccagagcccagaccaagcatggacgccgtggatgccaccatggagaaactccgggcacagtgcctgtcccgcggggcctcgggcatccagggcctggccaggtttttccgccaactagaccgggacgggagcagatccctggacgctgatgagttccggcagggtctggccaaactcgggctggtgctggaccaggcggaggcagagggtgtgtgcaggaagtgggaccgcaatggcagcgggacg

SEQ ID NO: 103585 - DNA, 963 bp, Homo sapiens
  Payload ID: 316
  Gene Symbol:
  Gene Name: AC104534.3
  ENST ID: ENST00000594769
  CDS Start-End: 1-963
tcatggtctatggcttggatcaatctaagatgaactgtgaccgagtcttcaatgtcttctgcttatatggcaatgtggagaaggtgaaattcatgaaaagcaagccgggggccgccatggtggagatggctgatggctacgctgtagaccgggccattacccacctcaacaacaacttcatgtttgggcagaagctgaatgtctgtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaagactgacaggctccaactacccgggactcagtattagccttcgcctcactggctcctctgcacaagaggaggcttccggagtagccctcggtgaagccccagaccacagctatgagtcccttcgtgtgacgtctgcgcagaaacatgttctgcatgtccagctcaaccggcccaacaagaggaatgccatgaacaaggtcttctggagagagatggtagagtgcttcaacaagatttcgagagacgctgactgtcgggcggtggtgatctctggtgcaggaaaaatgttcactgcaggtattgacctgatggacatggcttcggacatcctgcagcccaaaggagatgatgtggcccggatcagctggtacctccgtgacatcatcactcgataccaggaga

SEQ ID NO: 103586 - DNA, 342 bp, Homo sapiens
  Payload ID: 316
  Gene Symbol:
  Gene Name: AC104534.3
  ENST ID: ENST00000602021
  CDS Start-End: 1-342
tcatggtctatggcttggatcaatctaagatgaactgtgaccgagtcttcaatgtcttctgcttatatggcaatgtggagaagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaagtattgacctgatggacatggcttcggacatcctgcagcccaaaggagatgatgtggcccggatcagctggtacctccgtgacatcatcactcgataccaggaga

SEQ ID NO: 103587 - DNA, 342 bp, Homo sapiens; identical to SEQ ID NO: 103586
  Payload ID: 316
  Gene Symbol:
  Gene Name: AC104534.3
  ENST ID: ENST00000635188
  CDS Start-End: 1-342

SEQ ID NO: 103588 - DNA, 963 bp, Homo sapiens; identical to SEQ ID NO: 103585
  Payload ID: 316
  Gene Symbol:
  Gene Name: AC104534.3
  ENST ID: ENST00000634693
  CDS Start-End: 1-963

SEQ ID NO: 103589 - DNA, 48 bp, Homo sapiens
  Payload ID: 317
  Gene Symbol:
  Gene Name: AC104581.1
  ENST ID: ENST00000628882
  CDS Start-End: 1-48
ctttggacaagaagtttgtatttatttgggaggaatggtgtttgtttg

SEQ ID NO: 103590 - DNA, 84 bp, Homo sapiens
  Payload ID: 318
  Gene Symbol:
  Gene Name: AC104650.2
  ENST ID: ENST00000625822
  CDS Start-End: 1-84
cagaacctcccttccactgtttcccaggcacctctaccatatggtcgggggccgtgcaggccgcaggggggaggctccgttaga

SEQ ID NO: 103591 - DNA, 375 bp, Homo sapiens; identical to SEQ ID NO: 103504
  Payload ID: 319
  Gene Symbol:
  Gene Name: AC104981.1
  ENST ID: ENST00000623847
  CDS Start-End: 1-375

SEQ ID NO: 103592 - DNA, 60 bp, Homo sapiens
  Payload ID: 320
  Gene Symbol:
  Gene Name: AC105009.1
  ENST ID: ENST00000626806
  CDS Start-End: 1-60
gaaatttctcctggagcaatggacagggtgataagacaatttcactactttcaaacaaat

SEQ ID NO: 103593 - DNA, 483 bp, Homo sapiens
  Payload ID: 321
  Gene Symbol:
  Gene Name: AC105052.2
  ENST ID: ENST00000624140
  CDS Start-End: 1-483
atgagacaagaggtagaggggagaggtagaggtagccacgagctgataattacagacaagagatgcggagtatgtgggggctcattatcctgcatagtctatctttgtatatctttgaacttttcaagaataaaaaagcttaaaaagtatacatggcctggtcctaccagagactcacccaatgccagcctccagccagggagagccaagtttgcattttcacacgcatctcacactcctctgcactctcaacttggagcgctccaaacagggaaaccccaagccttgctggcttctgccaaccccctgagcagaagcatgggtccccctgatcaccacctcaccaccctcatcctgatctcactgtacacaccctttcccggtctgctaagtagcgggtgtttttccttgacactaacgctaccgctagaccacggtgggcttggcaacaggtgtcttcccagatgctggcgttaccgctag

SEQ ID NO: 103594 - DNA, 129 bp, Homo sapiens
  Payload ID: 322
  Gene Symbol:
  Gene Name: AC107081.1
  ENST ID: ENST00000627186
  CDS Start-End: 1-129
aaaggtatcttaaagacggagtcttgctctgtcacccaggatagagtgcaatggcattatctcggctcactgcaagctcaggctggtcttgaactcctgggctcaagtgatcctcctgccttgggctcc

SEQ ID NO: 103595 - DNA, 375 bp, Homo sapiens
  Payload ID: 323
  Gene Symbol:
  Gene Name: AC108925.1
  ENST ID: ENST00000625070
  CDS Start-End: 1-375
atgactcttaacgagcatgctgccttcaagcatctgtttaacaaagcacatcttgcaccgcccttaatccatttaaccctgagcggacacagcacatgtttcagagagcacagggttggggataaggtcacagatcaacaggatcccaaggcagaagaatttttcttagtacagaacaaaatgaaaagtctcccatgtctacttctatccacacagacccggcaaccatccgatttctcaattttttccccacccttcccgcctttctattccacaaaaccgccattgtcatcatggcccatccccaatgagccgctgggcacacctcccagacggggtcgtggccgggcagaggggctcctcacttcccagtag

SEQ ID NO: 103596 - DNA, 3202 bp, Homo sapiens
  Payload ID: 324
  Gene Symbol:
  Gene Name: AC108938.5
  ENST ID: ENST00000603767
  CDS Start-End: 298-1044
gtttatagcatagtccactgggactgccgctctgacaaagactgtgtcactactttgtggaatgttattttagaacttccagaatgcctcagtaaatcctgactgccatgtaactgtgtactgtgctgctgagctcttaacatgaagcagcagcagtgaccctggcgggccaggctgacgtgcgtgggaacagtgggagtgaccctggctgggaagcagggaggcctggatattgtttctcctggctctgtgtcctgccattctcatccctgtgctcagagctctcaagcacccacgatggccttctcaggccgagcgcgcccctgcattatcccagagaacgaagaaatcccccgagcagcccttaacactgtccacgaggccaatgggaccgaggacgagagggctgtttccaaactgcagcgcaggcacagtgacgtgaaagtctacaaggagttctgtgacttttatgcgaaattcaacatggccaacgccctggccagcgccacttgcgagcgctgcaagggcggctttgcgcccgctgagacgatcgtgaacagtaatggggagctgtaccatgagcagtgtttcgtgtgcgctcagtgcttccagcagttcccagaaggactcttctatgagtttgaaggaagaaagtactgtgaacatgactttcagatgctctttgccccttgctgtcatcagtgtggtgaattcatcattggccgagttatcaaagccatgaataacagctggcatccggagtgcttccgctgtgacctctgccaggaagttctggcagatatcgggtttgtcaagaatgctgggagacacctgtgtcgcccctgtcataatcgtgagaaagccagaggccttgggaaatacatctgccagaaatgccatgctatcatcgatgagcagcctctgatattcaagaacgacccctaccatccagaccatttcaactgcgccaactgcggacaggaaggatctgactgccgatgcacaggagctgaaaggggagctatactgcctgccatgccatgataaaatgggggtccccatctgtggcgcttgccgacggcccatcgaagggcgtgtggtgaacgccatgggcaagcagtggcatgtggagcattttgtttgtgccaagtgtgagaaaccctttcttggacatcgccattatgagaggaaaggcctggcgtattgtgaaactcactataaccagctatttggtgatgtttgcttccactgcaatcgtgttatagaaggtgatgtggtctctgctcttaataaggcctggtgcgtgaactgctttgcctgttctacctgcaacactaaattaacactcaatttctagaaaatttctccacaaactgagagctccagaattgatgactcagagtgaaccgaggagatcactactgtgcacaagtttgcctccaaacaactgggtgatgcctccaaacagacctggaatcatccatttctccaaggatctctgcttcttcttgtaaaataggctatttaaggactacaatctgagcattaagggactgtccttattagaagaggaaacttggacacagatacacacagagggagcaccgtgtgaagacacagagaggagatggccagctaccagccaagcagagagcccttactgtaaaccaaccctgccgcatcctgatctcagaattttggcttccagaactttccagctactagggaggctgaagcaagagaatggcatgaacctgggaggcggagcttgtcgtgagcccagatcaggccactacactccagccggggcaacagagcgcaactccgtctcaaaacaaacaaacaaaacaaaacaaaaaaaacttatagacaagtacaaaatgagaagaaaaagtccctttcccttcatgcctctacttcctgctgtattctcaaagaactatcataggaacgtactgggaaaaccaaaagaattcacggatcctttgaaagaagacgcacaccactgtaaattctgtggaacaggagaaaaactgtcttggaggaaggcatccttctattctactgatcagaaagctggacaaagtcccactgccaggctacacagttggtgccatttgcggaggtgacctttgacctttaacccacgcggccacccgcccgagctcttacccctgctgcccctcgcgcgtcccactccccgtccctgccggatccgcttccctgcgctgggcccagcgcgccgccagggaaggggccggagcctgggagcccgccccgccgtcgcccgtcctccgcccgcaggcccacccgcagcggtcacgtgaaggaccgagcgccgcgcgcccaggcggggcctccggcctgcacgaggagggcagagtccgttgcggctgccgccccgacgcccgcgcatccccgctcgccgcgcccgccgccgcgatgtccggggccggcctagccgcggtggtgagctgcctgcgcccgcagcccggcgaggagccgcagacccatgaggaccttctcctggcagctgcctatgttttggatgcccagtacaacagaaatgttccatttgaaactcacctcaggccatcagacgttactatttttataaccactagacaacgcaggttgccgcatacttctttatttgtgtagacctcgctcttgccctgtttgaagagcctgagttgcttcccctgcctttcttggccacctcaatagcagaagtactctgcctgactgcatactttggcagactggtacattttgcaaaagtcactcctcaaatggttttctggaaggatacaaaagacatctgcaccatggtaaccacagtggcgagtgttcattgtagtacctgtaagagtttatgaccaaaggcaggagccatgaagaaaaaagactcaatagatttgcttttgatgaaacaacaacacttccatacagtgaacgccataagcacaactgcaagcaaaccgcaaactgaagaacaaatagggcaaaatgtggcagtgcagacatttcagcatatcaagagcacttccaaattacaggaaaaaaaagatatctcaatagataattttgctgaagataagtgaaggcaactcataaggaaaaaatatgtaaaatggccgataggaaagatgtttaacgtcactaattaaaaattatagaataaaacgacaataaaatacca

SEQ ID NO: 103597 - DNA, 690 bp, Homo sapiens
  Payload ID: 325
  Gene Symbol:
  Gene Name: AC109344.1
  ENST ID: ENST00000623296
  CDS Start-End: 1-690
atgtcccctctgatcatgggacttgatgtgaacccagatgcctgcttgacggctctgctggacatctgcaagctcctagaggctgtctgtccctccagccctacctcctctggccatgaaatccccactcagctgctcggcaaggaccttcagtcatccctgtgcccaccctttcccttggcctgggcactcctcctgccaactccacttctgagctttcacccagagggctgtgcaccctcccactcccactgccttgcctgtcatctctccttgcacccagtgcaaacctcctccagtggtctcctggcccatcagcctgtcatgggctggatgcccaaatgcagggccaagctcatgcacctgctgcttatgagcttcagtgtctgcctgatgacctcaggggatccgagctcctcggcacggcagccgaggtcccctacgctggcctcagcatacctgcccagccacggcagacagcatcctcagtcacgagaagtctgtgcttctggaacctggaacatgcagggctttgcagacagagctccatgctacttcctctgcccttctcactccctccaaaatccacactgctcccccgtcaccacctgtgccctcctaattccatcagcacccatcagccactcaccagccatcctaactccatcggccaccttcctaattccttag

SEQ ID NO: 103598 - DNA, 375 bp, Homo sapiens
  Payload ID: 326
  Gene Symbol:
  Gene Name: AC109486.1
  ENST ID: ENST00000624505
  CDS Start-End: 1-375
atgactcttaacgagcatgccgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacctctttctacacagacacagcaaccatccgatttctcaatcttttccccacctttcccccctttctattccacaaaaccgccattgtcatcatggcccgttctcaatgagctgttgggtacacctcccagatggggtggtggccgggcagaggggctcctcacttcccagtag

SEQ ID NO: 103599 - DNA, 825 bp, Homo sapiens
  Payload ID: 327
  Gene Symbol:
  Gene Name: AC109829.1
  ENST ID: ENST00000447166
  CDS Start-End: 42-825
gaggcagaaaactctggctgagaagagcatggggttgagaaatggcaccaatttgggggatggacgtcccactgccatcagatatcagccttctattattgtttgttttttttatttggcggctttggacactgttttccaggaatcggagctggaagcaggtggcagccaagataaactcagagacttcaaagcagcatagattgaaaaagatccagaaattaacaggtcagagagatcctatcctttactcttcagctcaagatccacagtgggaagaaaacctcaggatggcttgcactgaagctaacctgacatgtgtttcagaactccctgtgggctggacccaggaatatatactctggtcaatggagcggagccttcaacagatcttccgatacctagaaagcgcaagatcaaggcttgtggaacaggatttgcctgaatcacaggatatgatttcttcctctaccacctctgttcttgtggctcagaagactgttctatgctgttgtgactataagaaagcaaaacattctactgaccacagcatctcctttagttcatcatgcaatgactccagtctgtctcatcttcctgtcttttctgaaggaacaacttgggaattccggagccatagtttacctatttcccacaaaaagcaatcctctgtgttcaggaaccaaggcagaaccctgcctctttttcagctctcagagccccagaaatcaaaaatttttcagaatttggcagatctttcacccttacaacctcagagctcttttatcaactctatttctgaacccctaaatatctgcaaacaaa

SEQ ID NO: 103600 - DNA, 375 bp, Homo sapiens
  Payload ID: 328
  Gene Symbol:
  Gene Name: AC109829.2
  ENST ID: ENST00000624185
  CDS Start-End: 1-375
atgactcttaacgagcatgctgccttcaagcatctgtttaacaaagcacatcttgcaccgcccttaatccatttaaccctgagtggacacagcacatgtttcagagagcacagggttggggataaggtcacagatcaacaggatcccaaggcagaagaatttttcttagtacagaacaaaatgaaaagtctcccatgtctacttctatccacacagacccggcaaccatccgatttctcaattttttccccacccttcccgcctttctattccacaaaaccgccattgtcatcgtggcccatccccaatgagccgctgggcacacctcccagacggggtcgtggccgggcagaggggctcctcacttcccagtag

SEQ ID NO: 103601 - DNA, 108 bp, Homo sapiens
  Payload ID: 329
  Gene Symbol:
  Gene Name: AC110602.1
  ENST ID: ENST00000625901
  CDS Start-End: 1-108
ataagggaggcaggttcaagcgattctcccacctcaccctcccgagtagctgggaatattattctgacaccacaggcctgcatgttcgtaaaacagttatatcttagc

SEQ ID NO: 103602 - DNA, 1129 bp, Homo sapiens
  Payload ID: 330
  Gene Symbol:
  Gene Name: AC110615.1
  ENST ID: ENST00000625176
  CDS Start-End: 811-1089
ggcattagaaaccttttattgagacaaggtaaacagtgggctgaaaatattacaggctgaaggaaggctgaggaaaccagtatgaaggcagctcaaatgatgaactaaatatattccaaaggtactatttatacttaaggcagttttaaaagtgaggtcttaaccaaaaagcctttacatggcattcaaaacaaaaacaaaaacaaaaaaaacacgggggggggggggtcacttaaatctcttggattgactaaaagagctaaattatgtacccaaaatctgtacagcaggggcctgttttcagcaggaaagcctatgtacaagtaagaacctcttactcttgtaacattgtcctgttttgttttgtcttataagaatatataactcctatcctcacagagttagtccataaggcctcagtgacctcacagaaatatggagttaacctctactacagaactatttacactgcactgtaaatacacatatgtgtgtccaccctcacagctaagctgtcaatgccttgagtgaaggggttacagctcattcgttttgcatctacagtgacaatgaataggcactcaatacatacttttttttgcatgaatgataaatgaaatgattttacattaccaccactatttacattaacattcctaccattagccgtctccaaaataaaaacacaaaattgctgccacatgttcagcagttttcacaatacagtgtgtctggactttttaatgtaaacaaacatgcttgatttaccaattttcagagcaaggacacaaacttagcattcttctaggaatggaaaacttgccaggaagttacttcattctttttctctttttcaaaagtgcatctcgtagtgccaactgtttttctcggaaggaacgcttattttttgaccggacattctggctataccgcatcatcataaagttcttctgttttttcttctctttatttgtcgaactggaaaatggatttgttttggttttcttcctcacaaattcttttcggtctgtctttccagccattgcagttgctagtcttgtctctttgtcagactttggctttttatgaaggcgttcaatgtcccgaagagaaagtaattcacccctgg

SEQ ID NO: 103603 - DNA, 90 bp, Homo sapiens
  Payload ID: 331
  Gene Symbol:
  Gene Name: AC112719.2
  ENST ID: ENST00000629900
  CDS Start-End: 1-90
tcctcagtcagagtttttaattcagatcctgaacaaccctctaaaataggtgctattgttatctacattttacagaagaggaaacaagct

SEQ ID NO: 103604 - DNA, 468 bp, Homo sapiens
  Payload ID: 332
  Gene Symbol:
  Gene Name: AC118758.1
  ENST ID: ENST00000599370
  CDS Start-End: 1-468
atggcctccggtcggtgggctcctccaggcccagcttgggcctcccagcggcctctgcagacccaagtcgtcctgaagtcggcctctccaggcccagctccggcctcccggcaagcaatctgttttggctcagctcctgcccagctcccgctggcctttggaggccccaaactttctccagccaagctcttcaggcctacctcctgcctcccggtggcctgtacgggcccagctctggcaggagaacagcctctgcaggccccgctcttgcctcccaggggcctctccaggcccagctctcgccccacggtggcctcctggggccaagtccctgcctgcctcccggcagcccgcgagcggcccagctcctccctcacggtggcctgtttaggcccaactcgtgtctctggcaccctgtccagaggcgtgagcccctgcctcacactggcctctctcatgctgagagag

SEQ ID NO: 103605 - DNA, 291 bp, Homo sapiens
  Payload ID: 333
  Gene Symbol:
  Gene Name: AC123512.1
  ENST ID: ENST00000623203
  CDS Start-End: 1-291
atgaatgtctgctgttcaagccacccagtcaatgaaaaagtttggaaaccttcatctagaaagtggtctagcaaagtgtggtccatggatgagtttgatctgcaaactgcttgttattggttcatgacaaggtctaccaattgcattttgagagctcagataagcagagagcaatgcaatttgtcacagaaggatgattatgtatatgcactgtcatgtctatttccatgcctaactcaaaggagacacaaggagaaagtgagctcagcctggataaattggagattgtga

SEQ ID NO: 103606 - DNA, 258 bp, Homo sapiens
  Payload ID: 334
  Gene Symbol:
  Gene Name: AC123512.2
  ENST ID: ENST00000623676
  CDS Start-End: 1-258
atgaatgtctgctgttcaagccacccagtcaatgaaaaagtttggaaaccttcatctagaaagtggtctagcaaagtgtggtccatggatgagtttgatctgcaaactgcttgttattggttcatgacaaggtctaccaattgcattttgagagctcagataagcagagagcaatgcaatttgtcacagaaggatgattatgtatatgcactgtcatgtgtatgtatgtgtatgtatatacgctatttccatgcctaa

SEQ ID NO: 103607 - DNA, 418 bp, Homo sapiens
  Payload ID: 335
  Gene Symbol:
  Gene Name: AC124312.1
  ENST ID: ENST00000623624
  CDS Start-End: 1-417
atggagccgatctacagggtactctccagaaagaaaataagcatcaccaacctcctcacaactgacttccactgctgctacgaaaacaccatgggcactaaaaagtcctcagccatgaaaaaaaatgagccaaagaacaacaaagatgtggccttgggctctcttcccaaccacaaggagctatctacctctggggaacaagggaacccagagccagcactcaaggacaaacctggccacacagaggcgggttaccggctaactcttctgtgccacctgcacattcacccagtcctgcagacattgtgcgtgctacccagcctcacaaagagaagtccttcacacaaggaatctcctctgcacaggagcacctactgccctgtgactccctttgatccaaagtggaccccatcctaag

SEQ ID NO: 103608 - DNA, 96 bp, Homo sapiens
  Payload ID: 336
  Gene Symbol:
  Gene Name: AC126407.1
  ENST ID: ENST00000626930
  CDS Start-End: 1-96
gctcctccagcagctccacggtctgcattggctgaatctggagcagcagattccccggagggctcacagacgggaaggtccggcccagacacaccc

SEQ ID NO: 103609 - DNA, 756 bp, Homo sapiens
  Payload ID: 337
  Gene Symbol:
  Gene Name: AC129492.1
  ENST ID: ENST00000622992
  CDS Start-End: 319-720
ctgaacgcatctggaagagcctccaacacacaggcctcccctcagtgggcacttcccaccaggactccctgaagagtccttagggtcctgctgggccctgccctggccaggaccggcctctcctgtcctcctggtcacttgcacagggcctccaacacctccagagtacgtcggatatcccggacttggcgcgccagcccctgaaccggctgcagagcccgctccagctcctcgcagcgcgccagcagggtgtacatgcccttgatgctcatgtccacggcttcacctaaggagtccacagcatcgcggtaggtctggatgcaacccacgctcagcgccgtcagctcctgcaccgcgccacccagaccgcgaagcagacggtccacccggcctcccagctcccgactcaaccgctccagatcccgcagcacctcggggtcgattgggggaatggccggtgtgggtgtgggtgcaggcgctgggcagggccgcgcaggggcagaaggcgggggtggaggcgcgccgctcagacggatcttgagttgcaggttgttggcgacaaagtgggtaaggtcgccgtggcggctcactgtgccttcgagctccaggggactggagatggtggcgcggcgtccgccgcccgcgccggactcggcactccctgaggacccggcgccaccgcacgcctcgctcagcccgtccaggctgcggctgtcctgaagacggctggagaacgagcggccggctctgctgccc

SEQ ID NO: 103610 - DNA, 2175 bp, Homo sapiens
  Payload ID: 338
  Gene Symbol:
  Gene Name: AC130310.1
  ENST ID: ENST00000614594
  CDS Start-End: 1018-1614
ggcgcatgccactacacccggctaatattttgtatttttagttgagacaggattttaccatgttggccaggctggtctcgatttcctgacctgtgatctgcctgcctcggcctcccaaagtgctgagattacaggcgtgagccactgtgcccagcccttggctactttttatatttttagtacagacagggtttcatcatgtcggccagtctggtcttgaactcctgaccttgtgatacactcacctcggcctcgcaaagtgctgggattacaggcgtgagccaccgtgcctggcccttggctactttttatatttttagtagagatggggtttcaccatgttggccagtctggtctcgaactcctgacctcaggtgatccgccctcctcggcctcccaaagcactgggattacaagcgtgagccactgtgcctggcccaatcatagttattttaaagcccttgtttcctaactccaatatgtggcttatctgtaatctgcttcttctgttagctttccgcatgattattgatcactgtttcctgctgtgtcctgtatctcgtgctttctgtcagaggtatgcctcaaaggaccgtgggggtccatatctagggaccgtggggggtccatatgtcgggaccgtgggggtgtctatatctcgggaccgtgggggtccatatctaaggaccgtgggggtccatatcttgggaccatggggggtctatatgtcaggaccgtgggggtctatatctaaggaccgtggggttctgtatctcaggaccgtgggggtccatatctagggaccgtgggggtccatatctagggaccgtggggggtccatatgtcgggaccgtgggggtgtctatatctcgggaccgtgggggtccatatctaaggactgtgggggtccatatcttggagcccccacaagaaccacaggcccccttggagcacccacaggagccacagccccctttgccacagctggagcaggaacaagctggcacacagcagcacatgggcttgcagcagcagacaggcacacagcagctggagccacatcccccacagccggaaccacagccacccttggatcccccacaagagccacagccccccttggagcccccacaggagccacaaccccccttggatcccccacaagagcacagccccccttgcagcctccacaggagccacagccccccttggagcccccagaagagccacagccccctttgccacagctggagcaggaacaggttggcacacggcagcacacgggcttgcagcagcagacgggcacacagcagctggagccagaacctccacagccagagccacagcccccacagccggagccacagcccccacagccggagccacagcccccacagctggagccacagcctccggagcagccgcaacagcccatggttctggtggattgagggtggagcaggtagaggagcaggtgagagggaggtgcaggtgtggagctccctgagcctggaccctttatatccctgcccagggtcatgtgtgaggctgggcacacatttcctggttcctgtttgtgccatttttagggcccctttttcttgtttcctctagaaatccgccccttggtgtatgggctgctcagtgggctgctgctctcttgctgaatctgtgtccagacttaatggaggcccccaagggtctagcctctccctgttgactccagagtcacactggatttacaaaagcatctattttaggctgggcatggtggctcacacctgtaatctcagcactttgggaggcctaggcaggtggatcacttgaggtgaggggttggagaccagcctggccaaaatggtgaaatctcgtgtctactaaaaacacaaaaattaactgggtgtggtggctcacatctgtaatcccagcactttgggaggccgaggcaggtggatcatttgaggtcaggagttggagaccagcctgcccaacatggcaaaaccccatctctactaaaaatacaaaaattagccaggcatggtggtgcatgcttgtaactccagctacttgggaggctgaggcaggagaatggcttgaacccagaggtgaaggttgcagtgagcagagatcacaccactgcactctagtgtgggcaacagagcgggactctgtctc

SEQ ID NO: 103611 - DNA, 171 bp, Homo sapiens
  Payload ID: 339
  Gene Symbol:
  Gene Name: AC131263.1
  ENST ID: ENST00000628571
  CDS Start-End: 1-171
gacagagtctcactctgttgcccaggctggaatgtagtggtgctatctcagctcactgcagcctctgcctccgctggtctcaaactcctgacctcaggtgatctgcctgcctcggcctcccaaagtgctgggattataggcgtgagccaccacgcccggctaacttgtaag

SEQ ID NO: 103612 - DNA, 1806 bp, Homo sapiens
  Payload ID: 340
  Gene Symbol:
  Gene Name: AC133551.1
  ENST ID: ENST00000616638
  CDS Start-End: 31-339
gagagactacaactcccagtatgcaccgcgatgcgcgcctcaccctgcatctcccagcccgcagccagctggcatcctagaccctctgccctgcgaccaacagccgggagcggaccagacaccagaactcccggaacggttgaagacggttccgctccctgtcccgcctttcgcagcccagcagtttcgccctgcggagaggagccttgctgtttccaaatctctcctgctgaagagacattggagctagggcggctagtttcacctggctgtcacaaatcctctgcaccccaggagcgccgcttggacccccgggctcgctgcgtggtccatatctaggtcgggcctctcacggagactttcccaccagtgtaataaagaggagaaaacgtcacagcggaagggcctgaccctgctgcatccactaaggaaacagctacggggatgggaccctgggagctgctgtggagcctcatccaccgcttctctgaccccacccaggctgcttcccaggcctcagggtcttagtgtggacctccgggccgtgattaatgcaggtcagcaggaccagagcgccccttggtccctcccaacacatgagggtagtttgtgtggtgaggtcagggatagtgtctgcgcttctaccctgaatagggctcccttggaaaatactttaatatctctttttaaatacccccttggaccacttttaatagttttctgatagaactaaacagtgatcattctcttaattcatgtttccattaagtttttcaggttaagtactgcacgactactcgcttctgaaactgatagacactgcctcagctccgtgcagggcagacgcacaagagcagaatctccgtgggacatctctctggagcatcaatattactgcagtatttggaagaaacaaatttaaataagttctaaggtgaagaatggaacatttaagacaagtctggaaagtcatctgcctttaataactgtcgtttgtccttaacgtcagactttctccaagaccaaaactctaagaacttatttccattcttacaaatagtaaaaatgataaatcatatcaagtcaattgaaagtcctgcctgctgctttcctaaattgcaatatggccttggtatggttttatttgtacttttgtgggggattcgtggatctttagattaaaaaaaaaaaaataggtttttgaacaatttttgcaagtttgcagctgttagttattgatttatttttccaacccatctaattcttctgtctctctcctctcctcaggctcaataattccatgggtctctaaggctgtgtttattttctttaaattttgttgatttacttttatactccatttgattttttctatctctcaccttttctcagactcagtcatcccacaggtctgtaaggctctgttcattttctttaaacttcttttttttttcctctcctcagattggataaattatattgctatgtctctgtttctgaactatagaaaagctcaaaattattatttttatttctcattttttatatggctattttttctctgctgatgtttcacatctattcatttatgagaatattttcctttgccctcatgagcgtgtttataatagctgccttcaaattcttgtctgccgtttacatcttggacatcttggagatggctactgcctgctttttatcttgtgtatttattacattttcacgtgtcttcacgcatcccttgaattggaaattgtgccctggagactgtatacaagactggattaaaaagactggattctgttt

SEQ ID NO: 103613 - DNA, 2132 bp, Homo sapiens
  Payload ID: 341
  Gene Symbol:
  Gene Name: AC136352.4
  ENST ID: ENST00000614604
  CDS Start-End: 368-2113
gctttgcctggtgtttcttgcttggattggcgtttcctccctcgcattcctttgctggacttgaccttttctctgctgggtttggcattcccttgactgggctgggtgtttccttgggagggggggcttggcctttcctggggtgggcgtggggtccccctggtgggcgtgggctttccccgggtgggtgtgggttttccctgggtggggtgggctgggctcccttgctgggcttggcaagttttggctgggattgacctttctcttcaaacagattggaaacccagggtttcctgctagttggtgaaactggttggtagacgcgatctgttcgctactaccggcctcccctggctgttaaaagcagatggtggctgaggtttgttcaatgcccgctgcctctgctgtgaagaagccatttgatctcagaagcaagatgggcaagtggtgccaccaccgcttcccctgctgcagggggagcggcaagagcaacatgggcacttctggagaccacgacgactcctttatgaagacgctcaggagcaagatgggcaagtgttgccatcactgcttcccctgctgcagggggagcggcacgagcaatgtgggcacttctggagaccatgacaactcctttatgaagacactcaggagcaagatgggcaagtggtgctgtcactgcttcccctgctgcagggggagcggcaagagcaacgtgggcacttggggagactacgacgacagcgccttcatggagccgaggtaccacgtccgtcgagaagatctggacaagctccacagagctgcctggtggggtaaagtccccagaaaggatctcatcgtcatgctcagggacactgacatgaacaagagggacaagcaaaagaggactgctctacatttggcctctgccaatggaaattcagaagtagtacaactcctgctggacagacgatgtcaacttaacgtccttgacaacaaaaaaaggacagctctgataaaggccgtacaatgccaggaagatgaatgtgtgttaatgttgctggaacatggcgctgatggaaatattcaagatgagtatggaaataccgctctacactatgctatctacaatgaagataaattaatggccaaagcactgctcttatatggtgctgatattgaatcaaaaaacaagtgtggcctcacaccacttttgcttggcgtacatgaacaaaaacaggaagtggtgaaatttttaatcaagaaaaaagctaatttaaatgcacttgatagatatggaagaactgccctcatacttgctgtatgttgtggatcagcaagtatagtcaatcttctacttgagcaaaatgttgatgtatcttctcaagatctatctggacagacggccagagagtatgctgtttctagtcatcatcatgtaatttgtgaattactttctgactataaagaaaaacagatgctaaaaatctcttctgaaaacagcaatccagaacaagacttaaagctgacatcagaggaagagtcacaaaggcttaaagtcagtgaaaatagccagccagagaaaatgtctcaagaaccagaaataaataaggactgtgatagagaggttgaagaagaaataaagaagcatggaagtaatcctgtgggattaccagaaaacctgactaatggtgccagtgctggcaatggtgatgatggattaattccacaaaggaagagcagaaaacctgaaaatcagcaatttcctgacactgagaatgaagagtatcacagtgacgaacaaaatgatacccagaaacaactttctgaagaacagaacactggaatatcacaagatgagattctgactaataaacaaaagcagatagaagtggctgaaaaggaaatgaattctgagctttctcttagtcataagaaagaagaagatctcttgcgtgaaaacagcatgttgcgggaagaaattgccatgctaagactggaactagatgaaacaaaacatcagaaccagctaagggaaaataaaattttggaggaaattgaaagtgtaaaagaaaaacttctaaaggctatacaactgaatgaagaagcattaacgaaaaccagtatttaagtacagtggacagcttagg

SEQ ID NO: 103614 - DNA, 1988 bp, Homo sapiens
  Payload ID: 341
  Gene Symbol:
  Gene Name: AC136352.4
  ENST ID: ENST00000620810
  CDS Start-End: 372-1517
agtagctttgcctggtgtttcttgcttggattggcgtttcctccctcgcattcctttgctggacttgaccttttctctgctgggtttggcattcccttgactgggctgggtgtttccttgggagggggggcttggcctttcctggggtgggcgtggggtccccctggtgggcgtgggctttccccgggtgggtgtgggttttccctgggtggggtgggctgggctcccttgctgggcttggcaagttttggctgggattgacctttctcttcaaacagattggaaacccagggtttcctgctagttggtgaaactggttggtagacgcgatctgttcgctactaccggcctcccctggctgttaaaagcagatggtggctgaggtttgttcaatgcccgctgcctctgctgtgaagaagccatttgatctcagaagcaagatgggcaagtggtgccaccaccgcttcccctgctgcagggggagcggcaagagcaacatgggcacttctggagaccacgacgactcctttatgaagacgctcaggagcaagatgggcaagtgttgccatcactgcttcccctgctgcagggggagcggcacgagcaatgtgggcacttctggagaccatgacaactcctttatgaagacactcaggagcaagatgggcaagtggtgctgtcactgcttcccctgctgcagggggagcggcaagagcaacgtgggcacttggggagactacgacgacagcgccttcatggagccgaggtaccacgtccgtcgagaagatctggacaagctccacagagctgcctggtggggtaaagtccccagaaaggatctcatcgtcatgctcagggacactgacatgaacaagagggacaagcaaaagaggactgctctacatttggcctctgccaatggaaattcagaagtagtacaactcctgctggacagacgatgtcaacttaacgtccttgacaacaaaaaaaggacagctctgataaaggccgtacaatgccaggaagatgaatgtgtgttaatgttgctggaacatggcgctgatggaaatattcaagatgagtatggaaataccgctctacactatgctatctacaatgaagataaattaatggccaaagcactgctcttatatggtgctgatattgaatcaaaaaacaagtgtggcctcacaccacttttgcttggcgtacatgaacaaaaacaggaagtggtgaaatttttaatcaagaaaaaagctaatttaaatgcacttgatagatatggaagaactgccctcatacttgctgtatgttgtggatcagcaagtatagtcaatcttctacttgagcaaaatgttgatgtatcttctcaagatctatctggacagacggccagagagtatgctgtttctagtcatcatcatgtaatttgtgaattactttctgactataaagaaaaacagatgctaaaaatctcttctgaaaacagcaatccaggtaaagaagcagaagaataatttttggcaggaggaacatgcaacaagtttgtgtgtttgccagaagaacatctgatgagattgcctgtttggcaggaagagcaacaactgcaaaagacaagatgccgagtgaactttgcagggtttctgagcagttcacttttgctagtaccaaaagtgtgagacaccagagtttgggaatgaggtgaatacttagctaagtgtgaaagccaccatgattatatgtaagcaaacaggcatgactgagctcctataaaactttatttacaaagccaaaaggcagattggatttgtcctgtggcctatagtttgctgggattgatggaagataaccatgtaaagaaaccaggagacaaaggaagcttttgcagtagtcagctatagtttccatgtcacacatccttggactagtatcaatgtattctaaggttttcacctgcccatggtgaaataaagtttggaatctccgtt

SEQ ID NO: 103615 - DNA, 600 bp, Homo sapiens
  Payload ID: 342
  Gene Symbol:
  Gene Name: AC136352.5
  ENST ID: ENST00000621137
  CDS Start-End: 1-600
atggcgctcctgctgcgcttcgtgctcctgtgcagagtcgcggatttcatcagaggttggagtatcactactcctgagcagatgattgaaaaagccaaaggggaaactgcctatctgccatgcaaatttacgcttagtcctgaagaccagggaccactggacatcgagtggctgatatcaccagctgataatcagaaggtggatcaagtgattattttatattctggagacaaaatttatgatgactactatccagatctgaaaggccgagtacattttaagagtaatgatctcaaatctggtgatgcatcaataaatgtaacgaattttcagctgtcagatattggcacagatcagtgcaaagtgaaaagagctcctggtgttgcaaataggaagattcagctggtagttcttgggaagatgtgccgcctccaaagagccgcacgtccactgccagaagctacagcagtaatcattcatccctgggatccatatctccttccaacatggaaggatattccaagactcagtataaacaagtaccaagtgaagactttgaacgcactcctcagagtccgactctcccacctgctaaggtag

SEQ ID NO: 103616 - DNA, 1426 bp, Homo sapiens
  Payload ID: 343
  Gene Symbol:
  Gene Name: AC136612.1
  ENST ID: ENST00000621028
  CDS Start-End: 32-406
ggagagactacaactcccagtatgcaccgcgatgcgcgcctcaccctgcatctcccagcccgcagccagctggcatcctagaccctctgccctgcgaccaacagccgggagcggaccagacaccagaactcccggaacggttgaagacggttccgctccctgtcccgcctttcgcagcccagcagtttcgccctgcggagaggagccttgctgtttccaaatctctcctgctgaagagacattggagctagggcggctagtttcacctggtaattgtgacaccctgtctcctcgagctgcaggcttttatgcttgtcatgttcgaagtttgataccttgcagatcaacaaagggtcggtggcctctcactgcctccgccgcagggttgtcaagtttttcaggttaagtactgcacgactactcgcttctgaaactgatagacactgcctcagctccgtgcagggcagacgcacaagagcagaatctccgtgggacatctctctggagcatcaatattactgcagtatttggaagaaacaaatttaaataagttctaaggtgaagaatggaacatttaagacaagtctggaaagtcatctgcctttaataactgtcgtttgtccttaacgtcagactttctccaagaccaaaactctaagaacttatttccattcttacaaatagtaaaaatgataaatcatatcaagtcaattgaaagtcctgcctgctgctttcctaaatcacaatatggccttggtatggttttatttgtacttttgtgggggattcgtggatctttagattaaaaaaaaaaaataggtttttgaacaatttttgcaagtttgcagctgttagttattgatttatttttgcaacccatctaattcttctgtctctctcctctcctcaggctcaataattccatgggtctctaaggctgtgtttattttctttaaattttgttgatttacttttatactccatttgattttttctatctctcaccttttctcagactcagtcatcccacaggtctgtaaggctctgttcattttctttaaacttttttttttcctctcctcagattggataaattatattgctatgtctctgtttctgaactatagaaaagctcaaaattactatttttatttctcattttttatatggctattttttctctgctgatgtttcacatctattcatttatgagaatattttcctttgccctcatgagcgtgtttataatagctgccttcaaattcttgtctgccgtttacatcttggacatcttggagatggctactgcctgctttttatcttgtgtatttattacattttcacgtgtcttcacgcatctcttgaattggaaattgtgccctggagactgtatacaagactggattaaaaagactggattctgttt

SEQ ID NO: 103617 - DNA, 3571 bp, Homo sapiens
  Payload ID: 344
  Gene Symbol:
  Gene Name: AC136616.1
  ENST ID: ENST00000613216
  CDS Start-End: 279-2183
gccgggccccgccgacgcccgcgcgcccccgggcccctgacacacaggagattcttcaggctcactttcaagtgcttcgtggactgcttctgactgcgccgcctgtgacccgcaccccgccgccctcccgccgccccgtcccccggcccggccgccccccggcccccggccggcccgcgccctcggggccctccccggtgccgccggtgccccgcgcctgaccgcagccccccgcagggtgccgcgaccccagcccggccgtgaggcccgcaggggccatggcgaagaagagcgccgagaacggcatctgtagcgtgtccggcgaccagaagaagggccccctcatcgcgcccgggcctgacggggcccgggccaagggcgacggccccgcgggcctggggacacccggcggtggcctggccgtgccggcgcgcgcgacctggacgcgccagatggacttcatcatgtcgtgtgtgggcttcgccgtggatctgggcaacgtgtggcgcttcccctacctgtgctacaagaatggcggaggtgtgttccttattccctgcatcctgatagccctggtcggaggaatccccattttcttcttggagatctcgctgggccagttcatgaaggccggcagcatcaatgtctggaacatctgtcccttgttcaaaggcctgggctatgcctccatggtgatcgtcttctactgcaacacctactacatcatggtgctggcctggggcttctattacctggtcaagtcctttaccaccacgctgccctgggccacatgtggccacacctggaacactcccgactgtgtggagatcttccgccatgaagactgtgccagtgccagcctggccaacctcacttgtgaccagcttgctgaccgccggtcccctgtcatcgagttctgggagaacaaagtcttgaggctgtctgggggactggaggtgccaggggccctcaactgggaggtgaccctttgtctgctggcctgctgggtgctggtctacttctgtgtcaagggggtcaaatccatgggaaagatcgtgtacttcactgctacattcccctacgtggtcctggtcgtgctgcttgtgcttggagtgctgctgcctggcaccctggacagcatcatttactatctcaagcctgactggtcaaagctggggtcccctcaggtatggatagatgtggggacccagattttcttttcttatgccattggcctgggggccctcacagccctgggcagctacaaccgcttcaacaacaactgctacaaggacgccatcatcctggctgtcatcaacagtgggaccagcttctttgctggcttcgtggtcttctccatcctgggcttcatggctgcagagcagggcatgcacatctccaaggtggcagagtcagggccgggcctggccttcatcgcctacccacaggctgtcacactgatgccagtggccccactctgggctgccctgttcttcttcatgctgttgctgcttggtctcgacagccagtttgtaggtgtggagggcttcatcaccggcctcctcaacctcctcccagcctcctactacttctgtttccaaagggagatctctgtggccctctgttgtgccctccgctttgtcattgatctctccatggtgactgatggtgggatgtatgtcttccagctgtttgactactactcagccagcggcaccaccctgctctggcaggccttttgggagtgcgtggtggtggcctgggtgtatggagctgaccgcttcacggacgacattgcctgtatgatcgggtaccgaccttgcccctggatgaaatggtgctggtccttcttcaccccgctggtttgcatgggcatcttcatcttcaacgttgtgtactacgagccgctggtctacaacaacaccaacgtgtacccgtggtggggtgaggccatgggctgggccttcgtgctgtcctccatgctgtgcatgccactgcacctcctgggctgcctcctcagggccaagggcaccatggctgagtgctggaagcacctgacccagaccatctggggcctccaccacttggagtaccgagctcaggatgcagatgtcaggggcctgaccaccctgaccccagtgtccgagagcagcaaggtcgtcgtggtggagagtgtcatgggacagctcagctcacatcaccagctcacctctggtagccatagcagcccctgcttcatccccaccccacccctccagggggcctgcctttccctgacgcttttggggtctgcctgggagaggaggggagaaagcaccatgagtgctcactaaaacaactttttccatttttaataaaacgccaaaaatatcacaacccaccaaaaatagatgcctctccccctccagtcctagcccagctggtcctaggccccgcctagtgccccacccccacccacagtgctgcactcctcctgcccctgccacgcccaccccctgcccacctctccaggctctgctctgtagcacacccttgggtgacccctcaccccagaagcagcagtggcagcttgggaaatgtgaggaagggaaggagggagagacgggagggaggagagagaggagaagggaggcaagggaggggcagcagaaccaagacaaatatttcagctgggctatacccctctccccatccctgttatagaagcttagagagccagccagcagtggaaccttctggttcctgcgccaatcaccaccaatatcaattgtgtgagcttgggtgcgagtgcacgcgtgcgtgagcacgtagagtatatatagatctctatctcttagcaaaggtgaataccagatgtaaatggtgcctctaggcaaaggaggcttgtattttgcacattttataaaaacttgagagaatgagatttctgcttgtatatttctaaaaagaggaaggagcccaaaccatcctctccttaccactcccattcctgtgagccctaccttacccctctgcccctagcctaggagtgtgaatttatagatctaactttcagaggcaaaacaaaagcttcgagctgttgcatgtgcgagtctgttgtgtggatgtgtgtgtgtggtccccagacccagaatggattggaaaagtgcatggtgggggcctcggggctgtccccacactgtccctttgcccacaggtctgtggggcaagaggctgcaatattccatcctgggtgtctgggctgctaacctggcctgctcaggcttcccaccctgtgccctgggctgggcacacccccgggaagggaccccggacacggctcccacatccaggctcaaggcggatgcacttcctgcacctccagtcttctgtgtagcggctttaacccacgtatgtctgtcacgtccagtcccgagacggctgagtgaccccaagaaaggcttccctgacacccggacagaggctggagggctggggctgcgtgagggtggtgggcctgcggggacattcttactgtgctaaaaagccactgcaaacatagcaataaaaacctgtcattttccaaagcagg

SEQ ID NO: 103618 - DNA, 3120 bp, Homo sapiens
  Payload ID: 344
  Gene Symbol:
  Gene Name: AC136616.1
  ENST ID: ENST00000611339
  CDS Start-End: 173-1732
gaagtgacccagtgatgggtgggaaacagaggtccagagcaaaggcctttgcccaaagttaggagaaggatgctgggacctggagtcaggtgtgttccttattccctgcatcctgatagccctggtcggaggaatccccattttcttcttggagatctcgctgggccagttcatgaaggccggcagcatcaatgtctggaacatctgtcccttgttcaaaggcctgggctatgcctccatggtgatcgtcttctactgcaacacctactacatcatggtgctggcctggggcttctattacctggtcaagtcctttaccaccacgctgccctgggccacatgtggccacacctggaacactcccgactgtgtggagatcttccgccatgaagactgtgccagtgccagcctggccaacctcacttgtgaccagcttgctgaccgccggtcccctgtcatcgagttctgggagaacaaagtcttgaggctgtctgggggactggaggtgccaggggccctcaactgggaggtgaccctttgtctgctggcctgctgggtgctggtctacttctgtgtcaagggggtcaaatccatgggaaagatcgtgtacttcactgctacattcccctacgtggtcctggtcgtgctgcttgtgcttggagtgctgctgcctggcaccctggacagcatcatttactatctcaagcctgactggtcaaagctggggtcccctcaggtatggatagatgtggggacccagattttcttttcttatgccattggcctgggggccctcacagccctgggcagctacaaccgcttcaacaacaactgctacaaggacgccatcatcctggctgtcatcaacagtgggaccagcttctttgctggcttcgtggtcttctccatcctgggcttcatggctgcagagcagggcatgcacatctccaaggtggcagagtcagggccgggcctggccttcatcgcctacccacaggctgtcacactgatgccagtggccccactctgggctgccctgttcttcttcatgctgttgctgcttggtctcgacagccagtttgtaggtgtggagggcttcatcaccggcctcctcaacctcctcccagcctcctactacttctgtttccaaagggagatctctgtggccctctgttgtgccctccgctttgtcattgatctctccatggtgactgatggtgggatgtatgtcttccagctgtttgactactactcagccagcggcaccaccctgctctggcaggccttttgggagtgcgtggtggtggcctgggtgtatggagctgaccgcttcacggacgacattgcctgtatgatcgggtaccgaccttgcccctggatgaaatggtgctggtccttcttcaccccgctggtttgcatgggcatcttcatcttcaacgttgtgtactacgagccgctggtctacaacaacaccaacgtgtacccgtggtggggtgaggccatgggctgggccttcgtgctgtcctccatgctgtgcatgccactgcacctcctgggctgcctcctcagggccaagggcaccatggctgagtgctggaagcacctgacccagaccatctggggcctccaccacttggagtaccgagctcaggatgcagatgtcaggggcctgaccaccctgaccccagtgtccgagagcagcaaggtcgtcgtggtggagagtgtcatgggacagctcagctcacatcaccagctcacctctggtagccatagcagcccctgcttcatccccaccccacccctccagggggcctgcctttccctgacgcttttggggtctgcctgggagaggaggggagaaagcaccatgagtgctcactaaaacaactttttccatttttaataaaacgccaaaaatatcacaacccaccaaaaatagatgcctctccccctccagtcctagcccagctggtcctaggccccgcctagtgccccacccccacccacagtgctgcactcctcctgcccctgccacgcccaccccctgcccacctctccaggctctgctctgtagcacacccttgggtgacccctcaccccagaagcagcagtggcagcttgggaaatgtgaggaagggaaggagggagagacgggagggaggagagagaggagaagggaggcaagggaggggcagcagaaccaagacaaatatttcagctgggctatacccctctccccatccctgttatagaagcttagagagccagccagcagtggaaccttctggttcctgcgccaatcaccaccaatatcaattgtgtgagcttgggtgcgagtgcacgcgtgcgtgagcacgtagagtatatatagatctctatctcttagcaaaggtgaataccagatgtaaatggtgcctctaggcaaaggaggcttgtattttgcacattttataaaaacttgagagaatgagatttctgcttgtatatttctaaaaagaggaaggagcccaaaccatcctctccttaccactcccattcctgtgagccctaccttacccctctgcccctagcctaggagtgtgaatttatagatctaactttcagaggcaaaacaaaagcttcgagctgttgcatgtgcgagtctgttgtgtggatgtgtgtgtgtggtccccagacccagaatggattggaaaagtgcatggtgggggcctcggggctgtccccacactgtccctttgcccacaggtctgtggggcaagaggctgcaatattccatcctgggtgtctgggctgctaacctggcctgctcaggcttcccaccctgtgccctgggctgggcacacccccgggaagggaccccggacacggctcccacatccaggctcaaggcggatgcacttcctgcacctccagtcttctgtgtagcggctttaacccacgtatgtctgtcacgtccagtcccgagacggctgagtgaccccaagaaaggcttccctgacacccggacagaggctggagggctggggctgcgtgagggtggtgggcctgcggggacattcttactgtgctaaaaagccactgcaaacatagcaataaaaacctgtcattttccaaagcagg

SEQ ID NO: 103619 - DNA, 336 bp, Homo sapiens
  Payload ID: 345
  Gene Symbol:
  Gene Name: AC136616.2
  ENST ID: ENST00000612243
  CDS Start-End: 1-336
gctattttaaaaggtgtccagtgtgaggtgcagctggtggagtctgcgggaggcttggtacagcctggggggtcccttagactctcctgtgcagcctctggattcacttgcagtaacgcctggatgagctgggtccgccaggctccagggaaggggctggagtgggttggccgtattaaaagcaaagctaatggtgggacaacagactacgctgcacctgtgaaaggcagattcaccatctcaagagttgattcaaaaaacacgctgtatctgcaaatgaacagcctgaaaaccgaggacacggccgtgtattactgtaccacagggggaggggtc

SEQ ID NO: 103620 - DNA, 225 bp, Homo sapiens
  Payload ID: 345
  Gene Symbol:
  Gene Name: AC136616.2
  ENST ID: ENST00000614110
  CDS Start-End: 1-225
gcctctggattcacttgcagtaacgcctggatgagctgggtccgccaggctccagggaaggggctggagtgggttggccgtattaaaagtactggtggtggcacatactatgcagactccgtgaagggccgattcaccatctccagagacaatgccaagaactccttgtatcttcaaatgaacagcctgagagccgaggacatggctgtgtattactgtgcaaga

SEQ ID NO: 103621 - DNA, 285 bp, Homo sapiens
  Payload ID: 346
  Gene Symbol:
  Gene Name: AC136616.3
  ENST ID: ENST00000619130
  CDS Start-End: 1-285
caggttcagctgttgcagcctggggctgaggtgaagaagcctgggtcctcagtgaaggtctcctgccaggcctctggatacaccttcaccagctacgatattcactgtgtgcgacaggcccctggagggtttgaaaggatgggagggatctactctggcaatggtaagacaggctatgcacagaagtttcagggcagagtcaccatgaccagggacatgtccacgagcacagcctacatggagctgagcagtcagagatctgaggacatagatgtgtactactgt

SEQ ID NO: 103622 - DNA, 72 bp, Homo sapiens
  Payload ID: 347
  Gene Symbol:
  Gene Name: AC138028.1
  ENST ID: ENST00000625951
  CDS Start-End: 1-72
ctgactccagtgggggaagccttcggagactgcagcccatccattccgcccccgtggccccgccccactcgc

SEQ ID NO: 103623 - DNA, 462 bp, Homo sapiens
  Payload ID: 348
  Gene Symbol:
  Gene Name: AC138969.4
  ENST ID: ENST00000331436
  CDS Start-End: 1-462
atggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgagtgtctgctcactccccttccaccctcagctctaccctcagcggatgataatctcaagacacctgccgagtgcctgctctatccccttccaccctcagcggatgataatctcaagacacctcccgagtgtctgctcactccccttccaccctcagctccaccctcagcggatgataatctcaagacacctcctgagtgtgtctgctcactccccttccaccctcagcggatgataatctcaagaaactaa

SEQ ID NO: 103624 - DNA, 1552 bp, Homo sapiens
  Payload ID: 348
  Gene Symbol:
  Gene Name: AC138969.4
  ENST ID: ENST00000381497
  CDS Start-End: 412-1521
acccgctgagcgtcgacacagtcgctgttggcctggtgtccagcgtggttgtctatcccgtctacctggccatcctctttctcttccggatgtcccggagcaaggtggctgggagcccgagccccacacctgccgggcagcaggtgctggacgtcgacagctgcctggactcatccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagaggttgatggacggatggctacatggatgtgatggagatggtttactatcgggaccttccgcatcctgctgatgttttgttgcttaggatatgaatggctgagcggaggctgtaaaacctggcactctgcttgggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaactgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgagtgtctgctcactccccttccaccctcagctctaccctcagcggatgataatctcaagacacctgccgagtgcctgctctatccccttccaccctcagcggatgataatctcaagacacctcccgagtgtctgctcactccccttccaccctcagctccaccctcagcggatgataatctcaagacacctcctgagtgtgtctgctcactccccttccaccctcagcggatgataatctcaagaaactaaggaagaataaataaataatataaaaataaaa

SEQ ID NO: 103625 - DNA, 1141 bp, Homo sapiens
  Payload ID: 348
  Gene Symbol:
  Gene Name: AC138969.4
  ENST ID: ENST00000524823
  CDS Start-End: 1-812
atcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaactgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttggtaactgtgttgcgcaaaaacaccttcatccccacccagtggggcccccatctaatattctaagtatcagaggttccgtatttgtaatagcaaatgggccctgactgtaaattagtgaagagtgaatgtaacttattacccacagggacaattccaaatgagggccttaaatgatgctcagctaagctggttcttgtgtggcctctgtaccttcaaaagctgccgagtcctatgattacacgcgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcag

SEQ ID NO: 103626 - DNA, 470 bp, Homo sapiens
  Payload ID: 348
  Gene Symbol:
  Gene Name: AC138969.4
  ENST ID: ENST00000527703
  CDS Start-End: 1-345
gctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccggtgcacttacaatttggtattacctgggagtgaaaagaaatattacagccatgcctaactgacttcttgaggtcagaatggcggcagtggagcatcgtcattcttcaggattgccctactggccctacctcacagctgaaactttaaaaaacaggatgggccaccagccacctcctccaactc

SEQ ID NO: 103627 - DNA, 699 bp, Homo sapiens
  Payload ID: 348
  Gene Symbol:
  Gene Name: AC138969.4
  ENST ID: ENST00000541593
  CDS Start-End: 1-699
atgttttgttgcttaggatatgaatggctgagcggaggctgtaaaacctggcactctgcttgggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaactgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccggtgcacttacaatttggtattacctgggagtgaaaagaaatattacagccatgcctaa

SEQ ID NO: 103628 - DNA, 288 bp, Homo sapiens
  Payload ID: 349
  Gene Symbol:
  Gene Name: AC141272.1
  ENST ID: ENST00000611746
  CDS Start-End: 1-288
gaggtgcagctggtggagtctggaggaggcttggtacagcctggggggtccctgagactctcctgtgcagcctctggattcaccttcagtaaccactacacgagctgggttcgccaggctccagggaagggactggagtgggtttcatacattagtggtaatagtggttacacaaactacgcagactctgtgaagggccgattcaccatctccagggacaacgccaagaactcactgtatctgcaaatgaacagcctgagagccgaggacacggctgtgtattactgt

SEQ ID NO: 103629 - DNA, 75 bp, Homo sapiens
  Payload ID: 350
  Gene Symbol:
  Gene Name: AC142525.1
  ENST ID: ENST00000625748
  CDS Start-End: 1-75
cagaggagtcctcgctgggaagacagttatccatcagcctgggaaggctttaaggaaaaccagacaggctccctt

SEQ ID NO: 103630 - DNA, 1599 bp, Homo sapiens
  Payload ID: 351
  Gene Symbol:
  Gene Name: AC145212.2
  ENST ID: ENST00000400754
  CDS Start-End: 73-462
ccggaagtgcggatcccagcggcggtcgtgtagctgagcagccctggggcttggttctatgtccctgtggctatgtttccagtgtcctctgggtgtttccaagagcaacaagaaacgaataaatctctgccccgcagcgcctccaccccagagacccggaccaagttcacacaggacaatctgtgccacgcccagcgcgagcgcctggactcggccaacctgtgggtgctggtggactgcatccttcgcgacacctccgaggacctgggactccagtgtgacgccgtgaacctggccttcgggcgccgctgtgaggaactggaggacgcgcggcacaagctgcagcaccacctgcacaagatgctgcgggaaatcacagatcaggaacacaacgtggtggcactgaaggaggccatcaaggacaaggaggaacctctgcacatagcccagacccggctgtagctgctctcacaccggcccaacatgcagctgtgccgcgatgcagcccagttcaggtactgcctgggcctctgaggcagtcccaggtgcccccgtccacctcctcgctgcgaccctctccaataaacactccaatctccacacacacatcccccacaggtgctgagaggggagggagactctgcggccacacacaacatgcaagcacgccttaaacacacagatatagacatgacactgggcaggtcatgggtcgggggcctccccgtgccagggacctgtgcccacgtggtctcaccccaccctgtgctacctcatcttcccgggaggaagctccttcagacaaggtgagctcctggaggccacggggccagagaggccagagagggccattccctgctgccctgagggtgctgtccccacctctggtggaaagtatgacctacgcctgggctacaggcatagatgggccgtccttttgtttcccttgttaacggatgcctggtggccccttctgagcctaagtacctttcttccttccctgcccctcagttccttcaaggaactgggtgcctccttccgtcaaatatcaggaatggaaagaactgagcctggtcggctgaggccagtcctgtcctgtcagggtcgagattgcacgcgggtcactcattcccactcaggtccgcgctccctgggaggaccctcgtaatttatgctctgccctagagccgctttcctggtaggatcctttcatggcgtcttcccaggacctcctgccagctcccattgggagttttgggtcccctccaccccagtaggtgcatacttctgccctccccagccccagctcacaccccccaacacccccaagctggtgagtgaggtggaggagctgtacaagtccatcacagcgctgcgggagaagcttctacaagcggagcagtccctgcgcaacctcaaggacatccacatgagcctggagaaggacgtcaccgccatgaccaacagtgtcttcatcgaccgccagaagtgcatggcccatcgtacttgctaccccaccattctgcagctggctggctaccagtgagcagcggcacggtgcttccccccaatcccccaaataaacagtgcgttagcttt

SEQ ID NO: 103631 - DNA, 2886 bp, Homo sapiens
  Payload ID: 352
  Gene Symbol:
  Gene Name: AC156455.2
  ENST ID: ENST00000628671
  CDS Start-End: 473-604
ccagcctggacgacagagcagactccatctcaaaaaaaaaaaaaatggtcaccccttttgctcctaaatcaccctcaaagtaaaagagaacaagaaacagaagcagaaatccatatttagtgaaataagacaacacctgtagctccaaacctgtagaagcagatcccagagaaaagcaggccagttctctcctggaatcccagaaagtcccaggaattggaggcttcagtgctgcagtagggaggggactaaaaacaaagtctgtatatggagcagtaagacctccgggttctcatcccccatcctgtgtgctctcgggtgactagccctctccctctccaggtttagcttctggagaaattaaatcaaagaggctctagaactggggatggcaggcattgagtgcagggagtgagttgccagaggctgagagcagagagatttagtggcagtgggcagagcaaacagcaaaatgactgccctcttccctggccttgctccagaaactgagcagccagacatacacactcccagaaggcagttggaggtccccccgggcaatcagaaccacccacagagaagacctccagatactgacatttagaagcctctgaccaaagagctgcctggccacccactggcttactcgctgacaggccatgctcctgccgtacacaccgatcctatcagtcatcctcatgggctcctttccagacttctgaggaaagcttccaacatgaagagggagttcaaaacaaacagagagagagagagagagagagagaaaagaaatataaacaatgcagggagcaaaagataacttcaaataaactcaaaatattcttctgggagagatgagacaatattgcatacataaaacaagaagaggatgctatcactaaattttaaaaaaaagtaacagaaagtaagaaagacctctaagaaatgtttctgaaatgaggtataatttttttttttttgagagggagtcttactctgtcacccaggctggagcgcagtggcgtgatctcagctcactgcaacctccgtctcccaggttcaagtgattctcctgcctcagcttcctgagtagctgggattacaggcatgcgccaccatgcctggctaattttgcatttttagtagagacggggtttcaccatgttggccaggctggtctgaaactcccgacctcaggtgatctgcccacctcagcctcccaaagtgctgggattacaggcatgagctaccgtgcctggcctgtgtatttttggagacagagtcttgctctgttgcccaggctggagggcagtggtgcaaactctgcctcccgggttcaagcgattctcgtgcgtcacctcccaagtagctggggctagaggcatgtgccaccatgtctggttactttttatataaaccttcagtttaatcttttagcttactgctgtgtttttcagctttattcactttgctttttttctatattttcgtttcaactcaacttttaaaaaatcatacttgtatatttgtatatttatatttattttccaagacctcatttgcctctttttcataatgggctattattgctccatggtacagaatcttctgttctttcctaaactattagttatttttaaaatatttgttaactttctcccccttgctagttctcaggtacccgctttctcccagagtgctggctttccttaattatttgctgacttgtgctggtgtgtaacccttcatacttaggtatttctatttgtctgactgctgatttgattccaatccagtgtttcttctgattcgtggagaagagacgacaacgctgtgaggctctggttttggtggcttgtctgggtgtgggagctccttgtcatcatgggatttttagctccctgggtcgccatcctacatggccactctcctgccgatgctgcccgctactcagcaggaggggaagtcgagaccacctccttaaccttacagacattgattgtgagcttggagcaccttccgtgactggaccacccatgcagtggtcctttgctttttgcatttttaactgcaattttccccaagagtcttccctaatacagtctcttaggaattgacggtgggattaaacaaggcatgtttctgcactgaatatggtctatgggttgccactttgcaacctcagctttaaggcttatttcctcccaggaaactgatgttaactttttaagttaaaaatgtgtatataagtaatacatgtttattttggaaattagaaaatacaggccaggtgtggtggctcatgcctgtaatcccagcattttgggaggttgaggcaggaggattgcctgagcccaggagtttgagaccagcctgggcaacatagggaaattccatctctacaaaaaaattaaacattagctgggtgtggtggtgcccacctgtggtcacagctactcgggagactgaggtgggaggatagcttgggcaggggaggttgaggctacagtgagccacgatcacaccaatgtgacacagtgagaccctgtctcaaaaaaaaaaaaaaagaaagaaaatataggtaaacacaaagacaaaaaagcagggcatggtggctcacacctgtaattctagcaccttgggaggctgaggcaggaggatcacttgaggtcaggaactcgagacgagaccaggctgggcagcatggcgagaccccatctctataaaaagtacaaaaattagcagggcacggtggtgtgcacctgtggtcctgctacttgggaagttgaggtgggaggatcacctgagccctggaggttgagggtgctgtgagccatgatggcaccactccactccagtccaggtgaaagagccagatcctgtctc

SEQ ID NO: 103632 - DNA, 1343 bp, Homo sapiens
  Payload ID: 353
  Gene Symbol:
  Gene Name: AC171558.1
  ENST ID: ENST00000622674
  CDS Start-End: 1-951
atgaagatagcaaacaacacagtagtgacagaatttatcctccttggtctgactcagtctcaagatattcagctcttggtctttgtgctgatcttaattttctaccttatcatcctccctggaaattttctcattattttcaccataaggtcagaccctgggctcacagcccccctctatttctttctgggcaacttggccttcctggatgcatcctactccttcattgtggctcccaggatgttggtggacttcttctctgagaagaaggtaatctcctacagaggctgcatcactcagctctttttcttgcacttccttggaggaggggagggattactccttgttgtgatggcctttgaccgctacatcgccatctgccggcctctgcactgttcaactgtcatgaaccctagagcctgctatgcaatgatgttggctctgtggcttgggggttttgtccactccattatccaggtggtcctcatcctccgcttgcctttttgtggcccaaaccagctggacaacttcttctgtgatgtccgacaggtcatcaagctggcttgcaccgacatgtttgtggtggagcttctgatggtcttcaacagtggcctgatgacactcctgtgctttctggggcttctggcttcctatgcagtcatcctctgccatgttcgtagggcagcttctgaagggaagaacaaggccatgtccatgtgcaccactcgtgtcattattatacttcttatgtttggacctgctatcttcatctacatgtgccctttcagggccttaccagctgacaagatggtttctctctttcacacagtgatctttccattgatgaatcctatgatttatacccttcgcaaccaggaagtgaaaacttccatgaagaggttattgagtcgacatgtagtctgtcaagtggattttataataagaaactgagaaggaggaattctggctggaattcatatcattcatttaacaagtcctgtttttcactgagtacctcccatttgccaggtaccattgtaggcaatggaggagagttatgcataatgagagaataaacttattatatttaaagaatataaaggaaaccccagagtggttgaagtataatgagtaagtgtgagaaatttaagggttaagttttatgtgactgcaagggtctttcagtctgaggtaagaattttttcatattttaattgtggtaagaacccattttaatgttttaagcaaaggagcagttcatctacaatgctttcctctactggttagagcaacatcagcaagattttaggcagagattaataaactgtaaaatatcaaaaacc

SEQ ID NO: 103633 - DNA, 1084 bp, Homo sapiens
  Payload ID: 354
  Gene Symbol:
  Gene Name: AC171558.2
  ENST ID: ENST00000612882
  CDS Start-End: 99-1040
ttttgaaagcagtgatataactctaggtaaatgctatgtctactaattatagtttcttaattttcatagctatattatgaaaagagtaaattgaagaaatggaaactgcaaattacaccaaggtgacagaatttgttctcactggcctatcccagactccagaggtccaactagtcctatttgttatatttctatccttctatttgttcatcctaccaggaaatatccttatcatttgcaccatcagtctagaccctcatctgacctctcctatgtatttcctgttggctaatctggccttccttgatatttggtactcttccattacagcccctgaaatgctcatagacttctttgtggagaggaagataatttcttttgatggatgcattgcacagctcttcttcttacactttgctggggcttcggagatgttcttgctcacagtgatggcctttgacctctacactgctatctgccgacccctccactatgctaccatcatgaatcaacgtctctgctgtatcctggtggctctctcctggagggggggcttcattcattctatcatacaggtggctctcattgttcgacttcctttctgtgggcccaatgagttagacagttacttctgtgacatcacacaggttgtccggattgcctgtgccaacaccttcccagaggagttagtgatgatctgtagtagtggtctgatctctgtggtgtgtttgattgctctgttaatgtcctatgccttccttctggccttgctcaagaaactttcaggctcaggtgagaataccaacagggccatgtccacctgctattcccacattaccattgtggtgctaatgtttgggccatccatctacatttatgctcgcccatttgactcgttttccctagataaagtggtgtctgtgttcaatactttaatattccctttacgtaatcccattatttacacattgagaaacaaggaagtaaaggcagccatgaggaagttggtcaccaaatatattttgtgtaaagagaagtgaaagataaattatacattttatagttcccctgaggatcattgtcc

SEQ ID NO: 103634 - DNA, 1657 bp, Homo sapiens
  Payload ID: 355
  Gene Symbol: CYP2D6
  Gene Name: AC208162.1
  ENST ID: ENST00000627727
  CDS Start-End: 91-1584
gtgctgagagtgtcctgcctggtcctctgtgcctggtggggtgggggtgccaggtgtgtccagaggagcccatttggtagtgaggcaggtatggggctagaagcactggtgcccctggccgtgatagtggccatcttcctgctcctggtggacctgatgcaccggcgccaacgctgggctgcacgctactcaccaggccccctgccactgcccgggctgggcaacctgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggttttgggccgcgttcccaaggggtgttcctggcgcgctatgggcccgcgtggcgcgagcagaggcgcttctccgtctccaccttgcgcaacttgggcctgggcaagaagtcgctggagcagtgggtgaccgaggaggccgcctgcctttgtgccgccttcgccaaccactccggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaaggccaaggggaaccctgagagcagcttcaatgatgagaacctgcgcatagtggtggctgacctgttctctgccgggatggtgaccacctcgaccacgctggcctggggcctcctgctcatgatcctacatccggatgtgcagcgccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctccgtggccgccggacagccccggcccagccactctcgtgtcgtcagctttctggtgaccccatccccctatgagctttgtgctgtgccccgctagaatggggtacctagtccccagcctgctccctagccagaggctctaatgtacaataaagcaatgtggtagttcc

SEQ ID NO: 103635 - DNA, 1504 bp, Homo sapiens
  Payload ID: 355
  Gene Symbol: CYP2D6
  Gene Name: AC208162.1
  ENST ID: ENST00000625759
  CDS Start-End: 91-1431
gtgctgagagtgtcctgcctggtcctctgtgcctggtggggtgggggtgccaggtgtgtccagaggagcccatttggtagtgaggcaggtatggggctagaagcactggtgcccctggccgtgatagtggccatcttcctgctcctggtggacctgatgcaccggcgccaacgctgggctgcacgctactcaccaggccccctgccactgcccgggctgggcaacctgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggttttgggccgcgttcccaaggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaaggccaaggggaaccctgagagcagcttcaatgatgagaacctgcgcatagtggtggctgacctgttctctgccgggatggtgaccacctcgaccacgctggcctggggcctcctgctcatgatcctacatccggatgtgcagcgccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctccgtggccgccggacagccccggcccagccactctcgtgtcgtcagctttctggtgaccccatccccctatgagctttgtgctgtgccccgctagaatggggtacctagtccccagcctgctccctagccagaggctctaatgtacaataaagcaatgtggtagttcc

SEQ ID NO: 103636 - DNA, 831 bp, Homo sapiens
  Payload ID: 356
  Gene Symbol:
  Gene Name: AC213203.1
  ENST ID: ENST00000612315
  CDS Start-End: 157-687
agaatgctaaccccctggcatgtatctagtcagcggaggcgacggctgctgctaaacaccttacaatccacgggagggcccctcccctaccccgaagtagctattccgcagaggtggagagactcgcgtgtagctcaatgcccacgcacttagccgatgggaaatcacgaattgatgaccagttggctcttggatgtgaggaaaaatctccagagtcagagggaactctcgaagttttgcccggagcaaacggaagggtggcgttgccatcgcctaagatgggaaaatggcaggtgtcacaggttgcaggggaaggtcggagaccagctgagggccccggagccttcctggaaagagtttcccatccagcccgcctcggtttccgcatccgtcttattccttatgacgttgagggtgctggcgtctgggtcctttatgatgcagagggtgcccccgtctcaccccgggcgcctccgcgctcccgcctcctcctggcaacctggtgcgcggctccggatctggcgacccacgaccggctggtcacttgctgccacctcgcaaaggcgcatctctagtccagtggtgagctgcggccgggtcgctgtaactcgctccaggactcgggactcgtggccttggtgtccctcgcggagccctcggtgtgtcgcctgcaggctctttttttgaagaaagcagggagggaatggccttgtgagagactccaggagcaaagagcgaccctcacaaggcccaagtcctcccagagctcagggaagctgtggcttctgacggaagaagggagagaaagctccctcctgtgtgtccctggtg

SEQ ID NO: 103637 - DNA, 252 bp, Homo sapiens
  Payload ID: 357
  Gene Symbol:
  Gene Name: AC231657.1
  ENST ID: ENST00000624556
  CDS Start-End: 1-252
atggagccgcgcacagggggcgccgcgaaccctaaggggagcagaggaaggcctgggcccctcccgcccgcgtgccccagcgcccttccgctcctggcgcggctggacgcgcgccccctggctgcgagggctgcggtcgatgtggcggcgctagtacacagggcgggcgccacattgcgcctgcgccggaaggaggcctttatcgttctgggctgtaaggacaataatgtcatggatagtcgtctgccccac

SEQ ID NO: 103638 - DNA, 351 bp, Homo sapiens
  Payload ID: 358
  Gene Symbol:
  Gene Name: AC233755.1
  ENST ID: ENST00000618003
  CDS Start-End: 1-351
atgaagcacctgtggtttttcctcctgctggtggcagctcccagatgggtcctgtcccaggtgcagctgcaggagtcgggcccaggactggtgaagccttcggagaccctgtccctcacctgcactgtctctggttactccatcagcagtggttactactggggctggatccggcagcccccagggaaggggctggagtggattgggagtatctatcatagtgggagcacctactacaacccgtccctcaagagtcgagtcaccatatcagtagacacgtccaagaaccagttctccctgaagctgagctctgtgaccgccgcagacacggccgtgtattactgtgcgaga

SEQ ID NO: 103639 - DNA, 294 bp, Homo sapiens
  Payload ID: 359
  Gene Symbol:
  Gene Name: AC233755.2
  ENST ID: ENST00000619729
  CDS Start-End: 1-294
gaagtgcagctggtggagtctgggggagtcgtggtacagcctggggggtccctgagactctcctgtgcagcctctggattcacctttgatgattatgccatgcactgggtccgtcaagctccggggaagggtctggagtgggtctctcttattagttgggatggtggtagcacctactatgcagactctgtgaagggtcgattcaccatctccagagacaacagcaaaaactccctgtatctgcaaatgaacagtctgagagctgaggacaccgccttgtattactgtgcaaaa

SEQ ID NO: 103640 - DNA, 303 bp, Homo sapiens
  Payload ID: 360
  Gene Symbol:
  Gene Name: AC234582.1
  ENST ID: ENST00000624572
  CDS Start-End: 1-303
gctgggggggcggtggagcccggggccggcctgctctccggggccgaggtgacaccgtgggctgcgggcgcggtggagcccggggccggcctgctctccggggccgaggtgacaccgtgggctgggggggcggtggagcccggggcgggcctggtgtccggggccgaggtgacaccgtgggctgggggggcggtggagcccggggccggcctggtgtccggggccgaggtgacaccgtgggcttggggggcggtggagcccggggccggcctggtgtccggggccgaggtgacaccgtgggct

SEQ ID NO: 103641 - DNA, 303 bp, Homo sapiens
  Payload ID: 361
  Gene Symbol:
  Gene Name: AC234582.2
  ENST ID: ENST00000623940
  CDS Start-End: 1-303
gctgggggggcggtggagcccggggccggcctggtgtccggggccgaggtgacaccgtgggctgcgggcgcggtggagcccggggacggcctggtgtccggggccgaggtgacaccgtgggctgggggggcggtggagcccggggccggcctggtgtccggggccgaggtgacaccgtgggctgggggggcggtggagcccggggccggcctggtgtccggggccgaggtgacaccgtgggctgggggggcggtggagcccggggccggcctggtgtccggggccgaggtgacaccgtgggct

SEQ ID NO: 103642 - DNA, 1504 bp, Homo sapiens
  Payload ID: 362
  Gene Symbol:
  Gene Name: AC236040.1
  ENST ID: ENST00000606649
  CDS Start-End: 91-1431
gtgctgagagtgtcctgcctggtcctctgtgcctggtggggtgggggtgccaggtgtgtccagaggagcccatttggtagtgaggcaggtatggggctagaagcactggtgcccctggccgtgatagtggccatcttcctgctcctggtggacctgatgcaccggcgccaacgctgggctgcacgctactcaccaggccccctgccactgcccgggctgggcaacctgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggttttgggccgcgttcccaaggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaaggccaaggggaaccctgagagcagcttcaatgatgagaacctgcgcatagtggtggctgacctgttctctgccgggatggtgaccacctcgaccacgctggcctggggcctcctgctcatgatcctacatccggatgtgcagcgccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccaccatggtgtctttgctttcctggtgaccccatccccctatgagctttgtgctgtgccccgctagaatggggtacctagtccccagcctgctccctagccagaggctctaatgtacaataaagcaatgtggtagttcc

SEQ ID NO: 103643 - DNA, 1657 bp, Homo sapiens
  Payload ID: 362
  Gene Symbol:
  Gene Name: AC236040.1
  ENST ID: ENST00000607223
  CDS Start-End: 91-1584
gtgctgagagtgtcctgcctggtcctctgtgcctggtggggtgggggtgccaggtgtgtccagaggagcccatttggtagtgaggcaggtatggggctagaagcactggtgcccctggccgtgatagtggccatcttcctgctcctggtggacctgatgcaccggcgccaacgctgggctgcacgctactcaccaggccccctgccactgcccgggctgggcaacctgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggttttgggccgcgttcccaaggggtgttcctggcgcgctatgggcccgcgtggcgcgagcagaggcgcttctccgtctccaccttgcgcaacttgggcctgggcaagaagtcgctggagcagtgggtgaccgaggaggccgcctgcctttgtgccgccttcgccaaccactccggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaaggccaaggggaaccctgagagcagcttcaatgatgagaacctgcgcatagtggtggctgacctgttctctgccgggatggtgaccacctcgaccacgctggcctggggcctcctgctcatgatcctacatccggatgtgcagcgccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccaccatggtgtctttgctttcctggtgaccccatccccctatgagctttgtgctgtgccccgctagaatggggtacctagtccccagcctgctccctagccagaggctctaatgtacaataaagcaatgtggtagttcc

SEQ ID NO: 103644 - DNA, 1829 bp, Homo sapiens
  Payload ID: 363
  Gene Symbol:
  Gene Name: AC240274.1
  ENST ID: ENST00000612721
  CDS Start-End: 174-1073
aaagtgctgtggggagtgatcacatttttcacaacagtaagttaagaatttcagttactgacatccctcagtcctgatgaaacctatttgatttcaccagtttttaacccatcatatgtttgggtttcttctccccagtccctggctccacctcttctgccacaaacgtcagcatggtggtatcagccggccctttgtccagcgagaaggcagagatgaacattctagaaatgaatgagaaattgcgcccccagctggcagagaagaaacagcagttcagaaacctcaaagagaaatgttttgtaactcaactggcctgcttcctggccaaccagcagaacaaatacaaatatgaagagtgcaaagacctcataaaatctgtgctgaggaatgagcgacagttcaaggaggagaagcttgcagagcagctcaagcaagctgaggagctcaggcaatataaagtcctggttcactctcaggaacgggagctgacccagttaagggagaagttacgggaagggagagatgcctcccgctcattgaatcagcatctccaggccctcctcactccggatgagccagacaagtcccaggggcaggacctccaagaacagctggctgaggggtgtagactggcacagcaacttttccaaaagctcagcccagaaaatgacaatgatcacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattatcccagaaaatgaaagtgatgatgaggaagaggaagaaaaagggccagtgtctcccaggacatcggtgggatcaagtgaaaaaggaggaccaagaggcaacaggtcccaggctcagcagggagctgctggatgagaaagagcctgaagtcttgcaggactccctggatagatgttattcgactccttcaggttatcttgaactgcctgacttaggccagccctacagaagtgctgtttactcattggaggaacagtaccttggcttggctcttgacgtggacagaattaaaaaggaccaggaagaggaagaagaccaaggcccaccatgccccaggctcagcagggagctgctggaggcagtagagcctgaagtcttgcaggactcactggatagatgttattcaactccttccagttgtcttgaacagcctgactcctgcctgccctatggaagttccttttatgcattggaggaaaaacatgttggcttttctcttgacgtgggagaaattgaaaagaaggggaaggggaagaaaagaaggggaagaagatcaacgaagaaaagaaggagaaggggaagaaaagaaggggaagaagatcaaaacccaccatgccccaggctcagcggcatgctgatggaagtggaagagcctgaagtcttgcaggactcactggatagatgttattcgactccgtcaatgtactttgaactacctgactcattccagcactacagaagtgtgttttactcatttgaggaacagcacatcagcttcgcccttgacgtggacaataggtttcttactttgatgggaacaagtctccacctggtcttccagatgggagtcatattcccacagtaagcagcccttactaagccgagagatgt

SEQ ID NO: 103645 - DNA, 2116 bp, Homo sapiens
  Payload ID: 363
  Gene Symbol:
  Gene Name: AC240274.1
  ENST ID: ENST00000612640
  CDS Start-End: 72-2090
aaagtgctgtggggagtgatcacatttttcacaacatccctggctccacctcttctgccacaaacgtcagcatggtggtatcagccggcccttggtccagcgagaaggcagagacgaacattttagaaatcaacgagaaattgcgcccccagctggcagagaacaaacagcagttcagaaacctcaaagagaaatgttttgtaactcaactggccggcttcctggccaaccgacagaagaaatacaagtatgaagagtgtaaagacctcataaaatttatgctgaggaatgagcgacagttcaaggaggagaagcttgcagagcagctcaagcaagctgaggagctcaggcaatataaagtcctggttcactctcaggaacgggagctgacccagttaagggagaagttacgggaagggagagatgcctcccgctcattgaatcagcatctccaggccctcctcactccagatgagccagacaagtcccaggggcaggacctccaagaacagctggctgaggggtgtagactggcacagcaccttgtccaaaagctcagcccagaaaatgacaatgatcacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattatcccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcggcacatttcactcattagaggaacagcaagtctgcatggctgttgacataggcggacatcggtgggatcaagtgaaaaaggaggaccaagaggcaacaggtcccaggctcagcagggagctgctggatgagaaagggcctgaagtcttgcaggactcactggatagatgttattcaactccttcaggttatcttgaactgactgactcatgccagccctacagaagtgccttttacatattggagcaacagcgtgttggctgggctcttgacatggatgaaattgaaaagtaccaagaagtggaagaagaccaagacccatcatgccccaggctcagcagggagctgctggatgagaaagagcctgaagtcttgcaggactccctggatagatgttattcgactccttcaggttatcttgaactgcctgacttaggccagccctacagaagtgctgtttactcattggaggaacagtaccttggcttggctcttgacgtggacagaattaaaaaggaccaggaagaggaagaagaccaaggcccaccatgccccaggctcagcagggagctgctggaggcagtagagcctgaagtcttgcaggactcactggatagatgttattcaactccttccagttgtcttgaacagcctgactcctgcctgccctatggaagttccttttatgcattggaggaaaaacatgttggcttttctcttgacgtgggagaaattgaaaagaaggggaaggggaagaaaagaaggggaagaagatcaacgaagaaaagaaggagaaggggaagaaaagaaggggaagaagatcaaaacccaccatgccccaggctcagcggcatgctgatggaagtggaagagcctgaagtcttgcaggactcactggatagatgttattcgactccgtcaatgtactttgaactacctgactcattccagcactacagaagtgtgttttactcatttgaggaacagcacatcagcttcgcccttgacgtggacaataggtttcttactttgatgggaacaagtctccacctggtcttccagatgggagtcatattcccacagtaagcagcccttactaagccgagagatgt

SEQ ID NO: 103646 - DNA, 2921 bp, Homo sapiens
  Payload ID: 363
  Gene Symbol:
  Gene Name: AC240274.1
  ENST ID: ENST00000616361
  CDS Start-End: 174-2546
aaagtgctgtggggagtgatcacatttttcacaacagtaagttaagaatttcagttactgacatccctcagtcctgatgaaacctatttgatttcaccagtttttaacccatcatatgtttgggtttcttctccccagtccctggctccacctcttctgccacaaacgtcagcatggtggtatcagccggcccttggtccagcgagaaggcagagacgaacattttagaaatcaacgagaaattgcgcccccagctggcagagaacaaacagcagttcagaaacctcaaagagatgttttgtaactcaactggccggcttcctggccaaccgacagaagaaatacagcaatataaagtcctggttcactctcaggaacgggagctgacccagttaagggagaagttacgggaagggagagatgcctcccgctcattgaatcagcatctccaggccctcctcactccagatgagccagacaagtcccaggggcaggacctccaagaacagctggctgaggggtgtagactggcacagcaccttgtccaaaagctcagcccagaaaatgacgaagatgaggatgaagatgttcaagttgaggaggctgagaaagtactggaatcatctgcccccagggaggtgcagaaggctgaagaaagcaaagtccctgaggactcactggaggaatgtgccatcacttgttcaaatagccacggcccttgtgactccaaccagcctcacaagaacatcaacatcacatttgaggaagacaaagtcaactcaactctggttgtagacagagaatcctctcatgatgaatgtcaggatgctgtaaacattctcccagtccctggccccacctcttctgccacaaacgtcagcatggtggtatcagccggccctttgtccagcgagaaggcagagatgaacattctagaaatgaatgagaaattgcgcccccagctggcagagaagaaacagcagttcagaaacctcaaagagaaatgttttgtaactcaactggcctgcttcctggccaaccagcagaacaaatacaaatatgaagagtgcaaagacctcataaaatctgtgctgaggaatgagcgacagttcaaggaggagaagcttgcagagcagctcaagcaagctgaggagctcaggcaatataaagtcctggttcactctcaggaacgggagctgacccagttaagggagaagttacgggaagggagagatgcctcccgctcattgaatcagcatctccaggccctcctcactccggatgagccagacaagtcccaggggcaggacctccaagaacagctggctgaggggtgtagactggcacagcaacttttccaaaagctcagcccagaaaatgacaatgatcacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattatcccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcggcacatttcactcattagaggaacagcaagtctgcatggctgttgacataggcggacatcggtgggatcaagtgaaaaaggaggaccaagaggcaacaggtcccaggctcagcagggagctgctggatgagaaagggcctgaagtcttgcaggactcactggatagatgttattcaactccttcaggttatcttgaactgactgactcatgccagccctacagaagtgccttttacatattggagcaacagcgtgttggctgggctcttgacatggatgaaattgaaaagtaccaagaagtggaagaagaccaagacccatcatgccccaggctcagcagggagctgctggatgagaaagagcctgaagtcttgcaggactccctggatagatgttattcgactccttcaggttatcttgaactgcctgacttaggccagccctacagaagtgctgtttactcattggaggaacagtaccttggcttggctcttgacgtggacagaattaaaaaggaccaggaagaggaagaagaccaaggcccaccatgccccaggctcagcagggagctgctggaggcagtagagcctgaagtcttgcaggactcactggatgttattcaactccttccagttgtcttgaacagcctgactcctgcctgccctatggaagttccttttatgcattggaggaaaaacatgttggcttttctcttgacgtgggagaaattgaaaagaaggggaaggggaagaaaagaaggggaagaagatcaacgaagaaaagaaggagaaggggaagaaaagaaggggaagaagatcaaaacccaccatgccccaggctcagcggcatgctgatggaagtggaagagcctgaagtcttgcaggactcactggatagatgttattcgactccgtcaatgtactttgaactacctgactcattccagcactacagaagtgtgttttactcatttgaggaacagcacatcagcttcgcccttgacgtggacaataggtttcttactttgatgggaacaagtctccacctggtcttccagatgggagtcatattcccacagtaagcagcccttactaagccgagagatg

SEQ ID NO: 103647 - DNA, 3728 bp, Homo sapiens
  Payload ID: 363
  Gene Symbol:
  Gene Name: AC240274.1
  ENST ID: ENST00000614336
  CDS Start-End: 402-2213
gtgccatcacttgttcaaatagccacggcccttgtgactccaaccagcctcacaagaacatcaacatcacatttgaggaagacaaagtcaactcaactctggttgtagacagagaatcctctcatgatgaatgtcaggatgctgtaaacattctcccagtccctggccccacctcttctgccacaaacgtcagcatggtggtatcagccggccctttgtccagcgagaaggcagagatgaacattctagaaatgaatgagaaattgcgcccccagctggcagagaagaaacagcagttcagaaacctcaaagagaaatgttttgtaactcaactggcctgcttcctggccaaccagcagaacaaatacaaatatgaagagtgcaaagacctcataaaatctgtgctgaggaatgagcgacagttcaaggaggagaagcttgcagagcagctcaagcaagctgaggagctcaggcaatataaagtcctggttcactctcaggaacgggagctgacccagttaagggagaagttacgggaagggagagatgcctcccgctcattgaatcagcatctccaggccctcctcactccggatgagccagacaagtcccaggggcaggacctccaagaacagctggctgaggggtgtagactggcacagcaacttttccaaaagctcagcccagaaaatgacaatgatcacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattatcccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcggcacatttcactcattagaggaacagcaagtctgcatggctgttgacataggcggacatcggtgggatcaagtgaaaaaggaggaccaagaggcaacaggtcccaggctcagcagggagctgctggatgagaaagggcctgaagtcttgcaggactcactggatagatgttattcaactccttcaggttatcttgaactgactgactcatgccagccctacagaagtgccttttacatattggagcaacagcgtgttggctgggctcttgacatggatgaaattgaaaagtaccaagaagtggaagaagaccaagacccatcatgccccaggctcagcagggagctgctggatgagaaagagcctgaagtcttgcaggactccctggatagatgttattcgactccttcaggttatcttgaactgcctgacttaggccagccctacagaagtgctgtttactcattggaggaacagtaccttggcttggctcttgacgtggacagaattaaaaaggaccaggaagaggaagaagaccaaggcccaccatgccccaggctcagcagggagctgctggaggcagtagagcctgaagtcttgcaggactcactggatagatgttattcaactccttccagttgtcttgaacagcctgactcctgcctgccctatggaagttccttttatgcattggaggaaaaacatgttggcttttctcttgacgtgggagaaattgaaaagaaggggaaggggaagaaaagaaggggaagaagatcaacgaagaaaagaaggagaaggggaagaaaagaaggggaagaagatcaaaacccaccatgccccaggctcagcggcatgctgatggaagtggaagagcctgaagtcttgcaggactcactggatagatgttattcgactccgtcaatgtactttgaactacctgactcattccagcactacagaagtgtgttttactcatttgaggaacagcacatcagcttcgcccttgacgtggacaataggtttcttactttgatgggaacaagtctccacctggtcttccagatgggagtcatattcccacagtaagcagcccttactaagccgagagatgtcattcctgcaggcaggacctataggcacgtgaagatttgaatgaaactatagttccatttggaagcccagacataggatgggtcagtgggcatggctctattcctattctcagaccatgccagtggcaacctgtgctcagtctgaagacaatggacccaagttaggtgtgacacgttcacataactgtgcagcacatgccgggagtgatcagtcagacattttaatttgaaccacttatctctgggtagctacaaagttcctcagggatttcattttgcagtcatgtctctgagcttctatacctgctcaaggtcagtgtcatctttgtgtttagctcatccaaaggtgttaccctggtttcaatgaacctaacctcattctttgtatcttcagtgttgaattgttttagctgatccatctttaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcgattccatcctgtagagaacaggagtcaggagccgctggcaggagacagcatgtcacccaggactctgccggtgcagaatatgaacaacgccatgttcttgcagaaaacgcttagcctgagtttcataggaggtaattaccagacaactgcagaatgtagaacactgagcaggacaactgacctgtctccttcacatagtccatatcaccacaaatcacacaacaaaaaggagaagagatattttgggttcaaaaaaagtaaaaagataatatagctgcatttctttagttattttgaaccccaaatatttcctcatctttttgttgttgtcattgatggtggtgacatggacttgtttatagaggacaggtcagctctctggctcaatgatctacattctgaagttgtctgaaaatgtcttcatgattaaattcagcctaaacgttttgccgggaacactgcagagacaatgctgtgagtttccaaccttagcccatctgcgggcagagaaggtctagtttgtccatcagcattatcatgatatcaggactggttacttggttaaggaggggtctaggagatctgtcccttttagagacaccttacttataatgaagtatttgggagggtggttttcaaaattagaaatgtcctgtattccaatgatcatcctgtaaacattttatcatttattaatcatccctgcctgtgtctattattatattcatatctctacgctggaaactttctgcctcaatgtttactgtgcctttgtttttgctagtgtgtgttgttgaaaaaaaaaacattctctgcctgagttttaatttttgtccaaagttattttaatctatacaattaaaagcttttgcctatc

SEQ ID NO: 103648 - DNA, 1088 bp, Homo sapiens
  Payload ID: 364
  Gene Symbol:
  Gene Name: AC241377.2
  ENST ID: ENST00000626088
  CDS Start-End: 41-847
ctagagggcggcgaggtctctccgcgcagcgtcccaggggatgcggcgcgcccccgactgggtgcagcggcaggccgcccccggcagcaagtgccgggtgccatggcaacggcgggaatttcccagtcggggcggccggaagcagccccagccgggctcgcggcagcgaaagcaaaatccgatctctctcccgggggagcaaaatggacgaaaggcgaccccccaggcaggggcgctgggtgccttgggaatccgaggaatcccttctctttgccagtcggaggggactagatggagccgaaggggccggagatgggccgagcgctgccccccgggggtcctcggcgccggacgcagcttacgagcgcaacgcagcaggctccattcccggccgccgccgctcagcccattacgcaaacctggcgggtccaaccaaccccgctctgccgccgctgctggaacccatgaggcgtgcttgcaggcttcgggcactacgcggggctggaaataccacgcactgccccttcgcctagacccccgctcgggccacgcgggttctgccctcaaagctggtagctgccccagacttgggggtggggggaggggaaggggcgaggctggcgccccctcccgcttttggctcccgcgttcgttgcagcagctgttgccaaatgaaccccggaatgcggacgtgcaaaccctccaccccacccccagccacacacgtcgcggtcagagaactgggaagggggcgctgggtccgaggttctggaaaagcaagaactcacctgcaaacaggcagtcctcagctctggacttctggatcacgacgtcgatatccttctgaattcggtcttgccttgaacacatccccattaaataaatccttggaaaagaagcagccgctatttccaccccacccccctcgcacgctttcagctttcgtaaatattcagttaaaaatgaaacctctggccgaggcaggggctgaaggccaagtggtttcggaagtgatcctgggtgagaggaggaggaggaggaggaggaggaggtggaggaggagggggaggtcggctttccatttccag

SEQ ID NO: 103649 - DNA, 1088 bp, Homo sapiens
  Payload ID: 365
  Gene Symbol:
  Gene Name: AC241585.2
  ENST ID: ENST00000628937
  CDS Start-End: 41-847
ctagagggcggcgaggtctctccgcgcagcgtccgaggggatgcggcgcgcccccgactgggtgcagcggcaggccgcccccggcagcaagtgccgggtgccatggcaacggcgggaatttcccggtcggggaggccggaagcagccccagccgggctcgcggcagcgaaagcaaaatccgatctctctcccgggggagcaaaatggacgaaaggcgaccccccaggcaggggcgctgggtgccttgggaatccgaggaatcccttctctttgccagtcggaggggactagatggagccgaaggggccggagatgggccgagcgctgccccccgggggtcctcggcgccgggcgcagcttacgagcgcagcgcagcaggctccattcccggccgccgccgctcagcccattacgcaaacctggcgggtccaaccaaccccgctgtgccgccgctgctggaacccaggaggcgtgcttgcaggcttcgggcactacgcggggctggaaataccacgcactgccccttcgcctagacccccgctcgggccacgcgggttctgccctcaaagctggtagctgccccagacttgggggtggggggaggggaaggggcgaggctggcgccccctcccgcttttggctcccgcgttcgttgcagcagctgttgccaaatgaaccccggaatgcggacgtgcaaaccctccaccccacccccagccacacacgtcgcggtcagagaactgggaagggggcgctgggtccgaggttctggaaaagcaagaactcacctgcaaacaggcagtcctcagctctggacttctggatcacgacgtcgatatccttctgaattcggtcttgccttgaacacatccccattaaataaatccttggaaaagaagcagccgctatttccaccccacccccctcgcacgctttcagctttcgtaaatattcagttaaaaatgaaacctctggccgaggcaggggctgaaggccaagtggtttcggaagtgatcctgggtgagaggaggaggaggaggaggaggaagaggtggaggaggagggggaggtcggctttccatttccag

SEQ ID NO: 103650 - DNA, 75 bp, Homo sapiens
  Payload ID: 366
  Gene Symbol:
  Gene Name: AC242988.1
  ENST ID: ENST00000624245
  CDS Start-End: 1-75
atatataatgtaaaaagtacaaggagactggatttgagagaatataaaaacgacagagaccctgaaaaaggatgc

SEQ ID NO: 103651 - DNA, 2042 bp, Homo sapiens
  Payload ID: 367
  Gene Symbol:
  Gene Name: AC243687.1
  ENST ID: ENST00000621228
  CDS Start-End: 622-1425
ccgggatgtgcaggccgggaggtagaggcaggctgatgggggagggaacgagcagcctgtgagacggggtgacggcggctaccagcccgggcgggcaccgggactggaagagttgcctgagcagccggctggtccggcggccaggctagggcgggggcgagcgcccagttgagcctgctggggctggaggagcgagaagggttctcttcacatttcagagcgaaccagacggacagtaaggtttggaggaagggggatcgttggaagtagcaggaagtggagagaatctggcaataggcgagaaaccgaaagaatcagaaagaagtctatgtgagtagctgaaagcattgggtgaccagaaagaaggtcgctgtaagtgaaggaagagtgaggtgtggctggatcaaagggctaagagaagcgggtctgtgtaagtggatgtgagtgaggatcaaggaaaagccgtggaagtggccgggggtcggggccgcagaagtgccagacggggccggaaagcagccgagcggagttcaaatttgagagcgtttggaaattggaagacttggtggcgaacgagggtcaggacctgcatcctgcctcagagttatcgacgtatccggaatgtgggatcagaggctggtgaagttggccctgttgcagcatctgcgggccttctatggtattaaggtgaagggtgtccgtgggcagtgcgatcgcaggagacatgaaacagcagccacggaaatagggggtaaaatatttggagtaccttttaatgcactgccccattctgctgtaccagaatatggacacattccaagctttcttgtcgatgcttgcacatctttagaagaacatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctatactgttgctctcctgtcttctggctgaccacacagttcatgtattaagatacttctttaactttctcaggaatgtttctcttagatccagtgagaataagatggatagcagcaatcttgcagtaatatttgcaccaaatcttcttcagacaagtgaaggacatgaaaagatgtcttctaacgcagaaaagaagggcgtgtaccagactttatcctggaaaagataccagccatgttgggtattgatggtctctgtgctactccatcactggaaggctttgaagaaggtgaatatgaaactcctggtgaatataagagaaagagaagacaacgtgtaggagattttgttagtggagcactaaataaatttaaacctaacagaacaccttctattacacctcaacaagaaagaattgataatgaaacaaccaccatcggttaaatttgatccaaaaatattgcatctaccagcattttcagtggataagttataatttctgaaagaccaagattggaatgactttttgtaacaagtgtgctcgcagatcgactccagtgagaagagctcggggacctcctgagccaagtttaatctcctttgctatttgtgcatggtggctggtcaccaggaggtggccaccaggcttctcctttccccgctgttctaattgctaatccagtatttgcggatagctccaaactgggatatgaccaccattgtatatgcagaccattgactggaacatcatgatctatctgcacatgactgtaaataacaactattggatgtggcacagatggaagctacataaacactctatacaatatggccaattcaccgggctccctgttagtcttgtgagcaattttaaactcttccacgattctttctctgctttggagtgtttcaattaattctccattatattacaatttacatttttattaagccttt

SEQ ID NO: 103652 - DNA, 785 bp, Homo sapiens
  Payload ID: 368
  Gene Symbol:
  Gene Name: AC243756.1
  ENST ID: ENST00000584068
  CDS Start-End: 76-570
actataaagacagtaaaaagatcagtggttatctttgcagacgccaccatcgctgtgagccctgtactatcagccatggtcaactccgtcgtcttttttgacatcaccgtcgacggcaagcccttgggccgcatctccatcaaactgtttgcagacaagattccaaagacagcagaaaactttcgtgctctgagcactggagagaaaggatttcgttataagggttcctgctttcacagaattattccagggtttatgtgtcagggtggtgacttcacacgccctaatggcaccgatgacaagtccatctatggggagaaatttgatgatgagaacctcatccgaaagcatacaggttctggcatcttgtccatggtaaatgctggacccaacacaaatggctcccagttattcatctgcactgccaagactgagtggttggatggcaagcatgtggcctttggcaaggtgaaagaacgtgtgaatattgtggaagccatggagcactttgggtacaggaatagcaagaccagcaagaagatcaccattgctgactgtggacaattctaatgagtttgacttgtgttttattttcaccaccagacccattcattctgtagctcaggagagcacccctccaccacatttgcttgcaatatcctagaatctttgtgctcttgctgcagttccctttgggttccatgttttccttgttcccttccatgcctagctggattgcagagttgagttaagtttatgattatgaaataaaaactaagtaacaa

SEQ ID NO: 103653 - DNA, 399 bp, Homo sapiens
  Payload ID: 369
  Gene Symbol:
  Gene Name: AC243790.2
  ENST ID: ENST00000612769
  CDS Start-End: 1-399
ttcactcagacatataggaggtccaggcagcatgaacagctccctggtcagagacacatggatttgctcactggttactcaaagctgattcaaagccgattaaagctgctgcttcatctggggtcccaacctccagtgggaaaaacattcttcttttcctgctggtgtcacccactgttccacggatccaaaacaacacccaatgtttggtacaaatttagtgaaacagctctttccattcttaactcatgccaagcatctcagcttggggtcaggaaaatgccaggggacatgagctcttctcctagagttagagaattctctgccttagttgcaataaaggaaaagatacacattcttcctacaaatgccaaagtaggctcaaaatttggttcctag

SEQ ID NO: 103654 - DNA, 375 bp, Homo sapiens
  Payload ID: 370
  Gene Symbol:
  Gene Name: AC243945.1
  ENST ID: ENST00000623775
  CDS Start-End: 1-375
atgactcttaacgagcatgctgccttcaagcatctgtttaacaaagcacatcttgcaccgcccttaatccatttaaccctgagtggacacagcacatgtttcagagagcacagggttggggataaggtcacagatcaacaggatcccaaggcagaggaatttttcttagtacagaacaaaatgaaaagtctcccatgtctacttctatccacacagacccggcaaccatctgatttctcaattttttccccacccttcccgcctttctattccacaaaaccgccattgtcatcatggcccatccccaatgagccgctgggcacacctcccagacggggtcgtggccgggcagaggggctcctcacttcccagtag

SEQ ID NO: 103655 - DNA, 288 bp, Homo sapiens
  Payload ID: 371
  Gene Symbol:
  Gene Name: AC245015.1
  ENST ID: ENST00000635354
  CDS Start-End: 1-288
attcctgcacaaagtctgaccagcctattaataaggcttcagggcaggaggttggacatcatcctgacccagacaccaagatccctgttaacatcttttggaaagaggcactcaatcttttatcaagcaactgcccaggtacatggagaaatcagttggttccagatgaaaggacagggatttgcactcgttatatctcatatctctaatgtgcccaaaaatgtcccggcctggttccgtgggaggggaagtggatccaactacatcagcatcagtgggctgcagcct

SEQ ID NO: 103656 - DNA, 306 bp, Homo sapiens
  Payload ID: 371
  Gene Symbol:
  Gene Name: AC245015.1
  ENST ID: ENST00000635147
  CDS Start-End: 1-306
gtgtccccacgtgtcccagagaatgtgtttctactggggactattttgttatgtcttcaaaagactctcatggacatcatcctgacccagacaccaagatccctgttaacatcttttggaaagaggcactcaatcttttatcaagcaactgcccaggtacatggagaaatcagttggttccagatgaaaggacagggatttgcactcgttatatctcatatctctaatgtgcccaaaaatgtcccggcctggttccgtgggaggggaagtggatccaactacatcagcatcagtgggctgcagcct

SEQ ID NO: 103657 - DNA, 1058 bp, Homo sapiens
  Payload ID: 372
  Gene Symbol:
  Gene Name: AC245100.1
  ENST ID: ENST00000629247
  CDS Start-End: 41-847
ctagagggcggcgaggtctctccgcgcagcgtccgaggggatgcggcgcgcccccgactgggtgcagcggcaggccgcccccggcagcaagtgccgggtgccatggcaacggcgggaatttcccggtcggggaggccggaagcagccccagccgggctcgcggcagcgaaagcaaaatccgatctctctcccgggggagcaaaatggacgaacggcgaccccccaggcaggggcgctgggtgccttgggaatccgaggaatcccttctctttgccagtcggaggggactagatggagccgaaggggccggagatgggccgagcgctgccccccgggggtcctcggcgccgggcgcagcttacgagcgcagggcagcaggctccattcccggccgccgccgctcagcccattacgcaaacctggcgggtccaaccaaccccgctctgccgccgctgctggaacccaggaggcgtgcttgcaggcttcgggcactacgcggggctggaaataccacgcactgccccttcgcctagacccccgctcgggccactcgggttctgccttcaaagctagtagctgccccagacttgggggtggggggaggggaaggggcgaggctggcgccccctcccgcttttggctcccgcgttcgttgcagcagctgtcgccaaatgaaccccggaatgcggacgtgcaaaccctccaccccacccccagccacacacgtcgcggtcggagaactgagaagggggcgctgggtccgaggttctggaaaagcaagaactcacctgcaaacaggcagtcctcagctctggacttctggatcacgacgtcgatatccttctgaattcggtcttgccttgaacacatccccattaaataaatccttggaaaagaagcagccgctatttccaccccacccccctcgcacgctttcagctttcgtaaatattcagttaaaaatgaaacctctggccgaggcaggggctgaaggccaactggtttcggaagtgatcctgggtgagaggaggagaaggaggaggaggaggaggaggtgg

SEQ ID NO: 103658 - DNA, 1133 bp, Homo sapiens
  Payload ID: 373
  Gene Symbol:
  Gene Name: AC253572.1
  ENST ID: ENST00000624419
  CDS Start-End: 373-1083
gctgcacacccgagaaagtttcagccaaacttccggcggcggctgaggcggcggccgaggagcggcggactcggggcgcggggagtcgaggcatttgcacctgggcttcggagcgtagcgccagggcctgagcctttgaagcaggaggaggggaggagagagtggggctcctctatcgggaccccctccccatgtggatctgcccaggcggcggcggcggcggcggcggaggaggaggaggaggcgaccgagaagatgcccgccctgcgtcccgctctgctgtgggcgctgctggcgctctggctgtgctgggcggcccccgcgcatgcattgcagtgtcgagatggctatgaaccctgtgtaaataaaggaatgtgtgttacctaccacagtggcacaggatactgcaaatgtccagaaggcttcttgggggaatattgtcaacatcgagacccctgtgagaagaaccgctgccagaatggtgggacttgtgtggcccaggccatgctggggaaagccacgtgccggtgtgcctcagggtttacaggagaggactgccagtactcgacacctcatccatgctttgtgtctcgaccttgcctgaatggcggcacatgccatatgctcagccgggatacctatgagtgcacctgtcaagtcgggtttacaggtaaggagtgccaatggaccgatgcctgcctgtctcatctctgtgcaaatggaagtacctgtaccactgtggccaaccagttctcctgcaaatgcctcacaggcttcacagggcagaagtgtgagactgatgtcaatgagtgtgacattccaggacactgccagcatggtggcacctgcctcaacctgcctggttcctaccagtgccagtgccttcagggcttcacaggccagtactgtgacagactgtatgtgccctgtgcacactcgccttgtgtcaatggaggcacctgtcggcagactggtgacttcacttttgagtgcaactgccttccagaaacagtgagaagaggaacagagctctgggaaagagacaggcaagtctggaatggaaaagaacacgatgagaattagacactggaaaatatgtatgtgtggttaataaagtgctttaaactgaattg

SEQ ID NO: 103659 - DNA, 1657 bp, Homo sapiens
  Payload ID: 374
  Gene Symbol:
  Gene Name: AC254560.1
  ENST ID: ENST00000625749
  CDS Start-End: 91-1584
gtgctgagagtgtcctgcctggtcctctgtgcctggtggggtgggggtgccaggtgtgtccagaggagcccagttggtagtgaggcagccatggggctagaagcactggtgcccctggccatgatagtggccatcttcctgctcctggtggacctgatgcaccggcaccaacgctgggctgcacgctacccgccaggtcccctgccactgcccgggctgggcaacttgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgatggtgacccgcggcgaggacacggccgaccgcccgcctgcgcccatctaccaggtcctgggcttcgggccgcgttcccaaggggtgatcctgtcgcgctatgggcccgcgtggcgcgagcagaggcgcttctccgtgtccaccttgcgcaacttgggcctgggcaagaagtcgctggagcagtgggtgaccgaggaggccgcctgcctttgtgccgccttcgccgaccaagccggacgcccctttcgccccaacggtctcttggacaaagccgtgagcaacgtgatcgcctccctcacctgcgggcgccgcttcgagtacgacgaccctcgcttcctcaggctgctggacctagctcaggagggatcgaaggaggagtcgggcttcctgcgcgaggtgctgaatgctgtccccgtcctcctgcacatcccagcgctggctggcaaggtcctacgcttccaaaaggctttcctgacccagctggatgagctgctaactgagcacaggatgacctgggacccagcccagccaccccgagacctgactgaggccttcctggcaaagaaggagaaggccaaggggagccctgagagcagcttcaatgatgagaacctgcgcatagtggtgggtaacctgttccttgccgggatggtgaccaccttgaccacgctggcctggggcctcctgctcatgatcctacacctggatgtgcagctccgtgtccaacaggagatcgacgacgtgatagggcaggtgcggcgaccagagatgggtgaccaggctcacatgccctacaccactgccgtgattcacgaggtgcagcgctttggggacatcatccccctgagtgtgacccatatgacatcccatgacatcgaagtacagggcttccgcatccctaagggaacgacactcatcaccaacctgtcatcggtgctgaaggatgaggccgtctggaagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctccgtggccgccggacagccccggcccagccactctcgtgtcgtcagctttctggtgaccccatccccctacgagctttgtgctgtgccccgctagaatggggtacctagtccccagcctgctccctagccagaggctctaatgtacaataaagcaatgtggtagttcc

SEQ ID NO: 103660 - DNA, 1408 bp, Homo sapiens
  Payload ID: 374
  Gene Symbol:
  Gene Name: AC254560.1
  ENST ID: ENST00000629176
  CDS Start-End: 1-1335
atggggctagaagcactggtgcccctggccatgatagtggccatcttcctgctcctggtggacctgatgcaccggcaccaacgctgggctgcacgctacccgccaggtcccctgccactgcccgggctgggcaaccttcatgtggacttccagaacacaccatactgcttcgaccagttgcggcgccgcttcggggacgtgttcagcctgcagctggcctggacgccggtggtcgtgctcaatgggctggcggccgtgcgcgaggcgatggtgacccgcggcgaggacacggccgaccgcccgcctgcgcccatctaccaggtcctgggcttcgggccgcgttcccaaggacgcccctttcgccccaacggtctcttggacaaagccgtgagcaacgtgatcgcctccctcacctgcgggcgccgcttcgagtacgacgaccctcgcttcctcaggctgctggacctagctcagggatcgaaggaggagtcgggcttcctgcgcgaggtgctgaatgctgtccccgtcctcctgcacatcccagcgctggctggcaaggtcctacgcttccaaaaggctttcctgacccagctggatgagctgctaactgagcacaggatgacctgggacccagcccagccaccccgagacctgactgaggccttcctggcaaagaaggagaaggccaaggggagccctgagagcagcttcaatgatgagaacctgcgcatagtggtgggtaacctgttccttgccgggatggtgaccaccttgaccacgctggcctggggcctcctgctcatgatcctacacctggatgtgcagctccgtgtccaacaggagatcgacgacgtgatagggcaggtgcggcgaccagagatgggtgaccaggctcacatgccctacaccactgccgtgattcacgaggtgcagcgctttggggacatcatccccctgagtgtgacccatatgacatcccatgacatcgaagtacagggcttccgcatccctaagggaacgacactcatcaccaacctgtcatcggtgctgaaggatgaggccgtctggaagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctccgtggccgccggacagccccggcccagccactctcgtgtcgtcagctttctggtgaccccatccccctacgagctttgtgctgtgccccgctagaatggggtacctagtccccagcctgctccctagccagaggctctaatgtacaataaagcaatgtggtagttcc

SEQ ID NO: 103661 - DNA, 1411 bp, Homo sapiens
  Payload ID: 375
  Gene Symbol:
  Gene Name: AC254788.1
  ENST ID: ENST00000634748
  CDS Start-End: 1-1338
atggggctagaagcactggtgcccctggccatgatagtggccatcttcctgctcctggtggacctgatgcaccggcaccaacgctgggctgcacgctacccgccaggtcccctgccactgcccgggctgggcaaccttcatgtggacttccagaacacaccatactgcttcgaccagttgcggcgccgcttcggggacgtgttcagcctgcagctggcctggacgccggtggtcgtgctcaatgggctggcggccgtgcgcgaggcgatggtgacccgcggcgaggacacggccgaccgcccgcctgcgcccatctaccaggtcctgggcttcgggccgcgttcccaaggacgcccctttcgccccaacggcctcttggacaaagccgtgagcaacgtgatcgcctccctcacctgcgggcgccgcttcgagtacgacgaccctcgcttcctcaggctgctggacctagctcaggagggactgaaggaggagtcgggcttcctgcgcgaggtgctgaatgctgtccccgtcctcccgcacatcccagcgctggctggcaaggtcctacgcttccaaaaggctttcctgacccagctggatgagctgctaactgagcacaggatgacctgggacccagcccagccaccccgagacctgactgaggccttcctggcaaagaaggagaaggccaaggggagccctgagagcagcttcaatgatgagaacctgcgcatagtggtgggtaacctgttccttgccgggatggtgaccacctcgaccacgctggcctggggcctcctgctcatgatcctacacctggatgtgcagctccgtgtccaacaggagatcgacgacgtgatagggcaggtgcggcgaccagagatgggtgaccaggctcacatgccctgcaccactgccgtgattcacgaggtgcagcgctttggggacatcatccccctgagtgtgacccatatgacatcccgtgacatcgaagtacagggcttccgcatccctaagggaacgacactcatcaccaacctgtcatcggtgctgaaggatgaggccgtctggaagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctccgtggccgccggacagccccggcccagccactctcgtgtcgtcagctttctggtgaccccatccccctacgagctttgtgctgtgccccgctagaatggggtacctagtccccagcctgctccctagccagaggctctaatgtacaataaagcaatgtggtagttcc

SEQ ID NO: 103662 - DNA, 1657 bp, Homo sapiens
  Payload ID: 375
  Gene Symbol:
  Gene Name: AC254788.1
  ENST ID: ENST00000634470
  CDS Start-End: 91-1584
gtgccgagagtgtcctgcctggtcctctgtgcctggtggggtgggggtgccaggtgtgtccagaggagcccagttggtagtgaggcagccatggggctagaagcactggtgcccctggccatgatagtggccatcttcctgctcctggtggacctgatgcaccggcaccaacgctgggctgcacgctacccgccaggtcccctgccactgcccgggctgggcaacttgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgatggtgacccgcggcgaggacacggccgaccgcccgcctgcgcccatctaccaggtcctgggcttcgggccgcgttcccaaggggtgatcctgtcgcgctatgggcccgcgtggcgcgagcagaggcgcttctccgtgtccactttgcgcaacttgggcctgggcaagaagtcgctggagcagtgggtgaccgaggaggccgcctgcctttgtgccgccttcgccgaccaagccggacgcccctttcgccccaacggcctcttggacaaagccgtgagcaacgtgatcgcctccctcacctgcgggcgccgcttcgagtacgacgaccctcgcttcctcaggctgctggacctagctcaggagggactgaaggaggagtcgggcttcctgcgcgaggtgctgaatgctgtccccgtcctcccgcacatcccagcgctggctggcaaggtcctacgcttccaaaaggctttcctgacccagctggatgagctgctaactgagcacaggatgacctgggacccagcccagccaccccgagacctgactgaggccttcctggcaaagaaggagaaggccaaggggagccctgagagcagcttcaatgatgagaacctgcgcatagtggtgggtaacctgttccttgccgggatggtgaccacctcgaccacgctggcctggggcctcctgctcatgatcctacacctggatgtgcagctccgtgtccaacaggagatcgacgacgtgatagggcaggtgcggcgaccagagatgggtgaccaggctcacatgccctgcaccactgccgtgattcacgaggtgcagcgctttggggacatcatccccctgagtgtgacccatatgacatcccgtgacatcgaagtacagggcttccgcatccctaagggaacgacactcatcaccaacctgtcatcggtgctgaaggatgaggccgtctggaagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctccgtggccgccggacagccccggcccagccactctcgtgtcgtcagctttctggtgaccccatccccctacgagctttgtgctgtgccccgctagaatggggtacctagtccccagcctgctccctagccagaggctctaatgtacaataaagcaatgtggtagttcc

SEQ ID NO: 103663 - DNA, 1564 bp, Homo sapiens
  Payload ID: 375
  Gene Symbol:
  Gene Name: AC254788.1
  ENST ID: ENST00000635319
  CDS Start-End: 1-1491
atggggctagaagcactggtgcccctggccatgatagtggccatcttcctgctcctggtggacctgatgcaccggcaccaacgctgggctgcacgctacccgccaggtcccctgccactgcccgggctgggcaaccttcatgtggacttccagaacacaccatactgcttcgaccagttgcggcgccgcttcggggacgtgttcagcctgcagctggcctggacgccggtggtcgtgctcaatgggctggcggccgtgcgcgaggcgatggtgacccgcggcgaggacacggccgaccgcccgcctgcgcccatctaccaggtcctgggcttcgggccgcgttcccaaggggtgatcctgtcgcgctatgggcccgcgtggcgcgagcagaggcgcttctccgtgtccactttgcgcaacttgggcctgggcaagaagtcgctggagcagtgggtgaccgaggaggccgcctgcctttgtgccgccttcgccgaccaagccggacgcccctttcgccccaacggcctcttggacaaagccgtgagcaacgtgatcgcctccctcacctgcgggcgccgcttcgagtacgacgaccctcgcttcctcaggctgctggacctagctcaggagggactgaaggaggagtcgggcttcctgcgcgaggtgctgaatgctgtccccgtcctcccgcacatcccagcgctggctggcaaggtcctacgcttccaaaaggctttcctgacccagctggatgagctgctaactgagcacaggatgacctgggacccagcccagccaccccgagacctgactgaggccttcctggcaaagaaggagaaggccaaggggagccctgagagcagcttcaatgatgagaacctgcgcatagtggtgggtaacctgttccttgccgggatggtgaccacctcgaccacgctggcctggggcctcctgctcatgatcctacacctggatgtgcagctccgtgtccaacaggagatcgacgacgtgatagggcaggtgcggcgaccagagatgggtgaccaggctcacatgccctgcaccactgccgtgattcacgaggtgcagcgctttggggacatcatccccctgagtgtgacccatatgacatcccgtgacatcgaagtacagggcttccgcatccctaagggaacgacactcatcaccaacctgtcatcggtgctgaaggatgaggccgtctggaagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctccgtggccgccggacagccccggcccagccactctcgtgtcgtcagctttctggtgaccccatccccctacgagctttgtgctgtgccccgctagaatggggtacctagtccccagcctgctccctagccagaggctctaatgtacaataaagcaatgtggtagttcc

SEQ ID NO: 103664 - DNA, 1657 bp, Homo sapiens; identical to SEQ ID NO: 103634
  Payload ID: 376
  Gene Symbol:
  Gene Name: AC254847.1
  ENST ID: ENST00000634534
  CDS Start-End: 91-1584

SEQ ID NO: 103665 - DNA, 1504 bp, Homo sapiens; identical to SEQ ID NO: 103635
  Payload ID: 376
  Gene Symbol:
  Gene Name: AC254847.1
  ENST ID: ENST00000635122
  CDS Start-End: 91-1431

SEQ ID NO: 103666 - DNA, 1012 bp, Homo sapiens
  Payload ID: 377
  Gene Symbol:
  Gene Name: AC254944.3
  ENST ID: ENST00000633373
  CDS Start-End: 146-949
gggggtcggggccgcagaagtgccagacggggccggaaagcagccgagcggagttcaaatttgagagcgtttggaaattggaagacttggtggcgaacgagggtcaggacctgcatcctgcctcagagttatcgacgtatccggaatgtgggatcagaggctggtgaagttggccctgttgcagcatctgcgggccttctatggtattaaggtgaagggtgtccgtgggcagtgcgatcgcaggagacatgaaacagcagccacggaaatagggggtaaaatatttggagtaccttttaatgcactgccccattctgctgtaccagaatatggacacattccaagctttcttgtcgatgcttgcacatctttagaagaacatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctatactgttgctctcctgtcttctggctgaccacacagttcatgtattaagatacttctttaactttctcaggaatgtttctcttagatccagtgagaataagatggatagcagcaatcttgcagtaatatttgcaccaaatcttcttcagacaagtgaaggacatgaaaagatgtcttctaacgcagaaaagaagggcgtgtaccagactttatcctggaaaagataccagccatgttgggtattgatggtctctgtgctactccatcactggaaggctttgaagaaggtgaatatgaaactcctggtgaatataagagaaagagaagacaacgtgtaggagattttgttagtggagcactaaataaatttaaacctaacagaacaccttctattacacctc

SEQ ID NO: 103667 - DNA, 1408 bp, Homo sapiens
  Payload ID: 378
  Gene Symbol:
  Gene Name: AC254995.1
  ENST ID: ENST00000626205
  CDS Start-End: 1-1335
atggggctagaagcactggtgcccctggccatgatagtggccatcttcctgctcctggtggacctgatgcaccggcaccaacgctgggctgcacgctacccgccaggtcccctgccactgcccgggctgggcaaccttcatgtggacttccagaacacaccatactgcttcgaccagttgcggcgccgcttcggggacgtgttcagcctgcagctggcctggacgccggtggtcgtgctcaatgggctggcggccgtgcgcgaggcgatggtgacccgcggcgaggacacggccgaccgcccgcctgcgcccatctaccaggtcctgggcttcgggccgcgttcccaaggacgcccctttcgccccaacggtctcttggacaaagccgtgagcaacgtgatcgcctccctcacctgcgggcgccgcttcgagtacgacgaccctcgcttcctcaggctgctggacctagctcagggatcgaaggaggagtcgggcttcctgcgcgaggtgctgaatgctgtccccgtcctcccgcacatcccagcgctggctggcaaggtcctacgcttccaaaaggctttcctgacccagctggatgagctgctaactgagcacaggatgacctgggacccagcccagccaccccgagacctgactgaggccttcctggcaaagaaggagaaggccaaggggagccctgagagcagcttcaatgatgagaacctgcgcatagtggtgggtaacctgttccttgccgggatggtgaccaccttgaccacgctggcctggggcctcctgctcatgatcctacacctggatgtgcagctccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctccgtggccgccggacagccccggcccagccactctcgtgtcgtcagctttctggtgaccccatccccctatgagctttgtgctgtgccccgctagaatggggtacctagtccccagcctgctccctagccagaggctctaatgtacaataaagcaatgtggtagttcc

SEQ ID NO: 103668 - DNA, 1657 bp, Homo sapiens
  Payload ID: 378
  Gene Symbol:
  Gene Name: AC254995.1
  ENST ID: ENST00000630405
  CDS Start-End: 91-1584
gtgctgagagtgtcctgcctggtcctctgtgcctggtggggtgggggtgccaggtgtgtccagaggagcccagttggtagtgaggcagccatggggctagaagcactggtgcccctggccatgatagtggccatcttcctgctcctggtggacctgatgcaccggcaccaacgctgggctgcacgctacccgccaggtcccctgccactgcccgggctgggcaacttgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgatggtgacccgcggcgaggacacggccgaccgcccgcctgcgcccatctaccaggtcctgggcttcgggccgcgttcccaaggggtgatcctgtcgcgctatgggcccgcgtggcgcgagcagaggcgcttctccgtgtccaccttgcgcaacttgggcctgggcaagaagtcgctggagcagtgggtgaccgaggaggccgcctgcctttgtgccgccttcgccgaccaagccggacgcccctttcgccccaacggtctcttggacaaagccgtgagcaacgtgatcgcctccctcacctgcgggcgccgcttcgagtacgacgaccctcgcttcctcaggctgctggacctagctcaggagggatcgaaggaggagtcgggcttcctgcgcgaggtgctgaatgctgtccccgtcctcccgcacatcccagcgctggctggcaaggtcctacgcttccaaaaggctttcctgacccagctggatgagctgctaactgagcacaggatgacctgggacccagcccagccaccccgagacctgactgaggccttcctggcaaagaaggagaaggccaaggggagccctgagagcagcttcaatgatgagaacctgcgcatagtggtgggtaacctgttccttgccgggatggtgaccaccttgaccacgctggcctggggcctcctgctcatgatcctacacctggatgtgcagctccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctccgtggccgccggacagccccggcccagccactctcgtgtcgtcagctttctggtgaccccatccccctatgagctttgtgctgtgccccgctagaatggggtacctagtccccagcctgctccctagccagaggctctaatgtacaataaagcaatgtggtagttcc

SEQ ID NO: 103669 - DNA, 3316 bp, Homo sapiens
  Payload ID: 379
  Gene Symbol: AACS
  Gene Name: acetoacetyl-CoA synthetase
  Uniprot ID: Q86V21
  ENST ID: ENST00000316519
  CDS Start-End: 207-2225
ggcctgcggggcggggcctgggccaagcggcccgcaggaggcggcggcggccgttcagtcccttgttccccgccgccgccgtcgctgacccagcccgccaggcgctcctgaccgtcgcttcctccggtcccaggtccccggccctcgcctcagccccggcccctggtccccagccctcgtcgcagccccggccgcccgccgccgccatgtccaaggaggagcgccccggtcgggaggagatcctggagtgccaggtgatgtgggagcctgacagtaagaagaacacgcagatggaccgcttccgggcggctgtgggcgccgcctgcggcctggcgctggagagttatgatgacttgtaccattggtccgttgagtcatattcagacttctgggcagagttctggaaattcagtggaattgtcttctcacgtgtgtatgatgaggttgtggacacatcgaaaggaatcgcagatgtccccgagtggttcaaaggcagtcggctcaactatgcagaaaacctcctgcggcacaaagagaatgacagagttgccctttacattgcaagggaaggcaaagaggaaattgtgaaggtgacttttgaagagctgaggcaagaagtggctttgtttgcagcagcaatgaggaaaatgggtgtgaagaaaggagatcgggttgttggttatttacccaacagtgagcacgctgtcgaggcgatgctggctgcggcaagcattggtgccatctggagctccacgtccccggacttcggtgtgaatggtgtgctggaccggttttctcaaattcagccaaagctcatcttctctgtggaggctgttgtctataatggcaaagagcacaaccacatggaaaagctgcagcaggtggttaaaggcctaccagacttgaagaaagtggtggtgattccttatgtgtcctccagagagaacatagacctttcaaagattccaaacagtgtgtttctggatgactttcttgccaccggcaccagtgagcaggccccgcagctggagttcgagcagctgcccttcagccacccactgttcatcatgttctcatcgggcaccacgggcgcacccaagtgcatggtgcattccgctgggggcaccctcatccagcatctgaaggagcacctgctgcacggcaacatgaccagcagtgacatcctcctgtgctacaccacggtcggctggatgatgtggaactggatggtgtcccttctggccacaggagcggccatggtcttgtacgatggctcccccctggtgcccacgcccaatgtgctctgggacctggttgacaggataggcatcactgtcctggtaactggggccaagtggctgtcagtgctggaagagaaggccatgaagccggtggaaacccacagtctccagatgctccacacgatcctgtccactggctccccactgaaagcccagagctacgagtatgtctacaggtgcatcaagagcagcatcctcctgggctccatctcaggaggcaccgacatcatctcctgcttcatgggccacaatttttctcttcctgtgtataaaggggagattcaggcccggaacctgggcatggccgtggaagcgtggaacgaggaaggaaaggcggtctggggagagagcggcgagctggtgtgtactaagccgatcccttgccagcccacacacttctggaacgatgagaacggcaacaagtacaggaaggcgtatttctccaaattcccaggtatctgggctcatggcgactactgcagaatcaaccccaagaccgggggcatcgtcatgcttggccggagtgacggcaccctcaaccccaacggggtgcggttcggcagctcggaaatctataacattgtggaatccttcgaggaggtggaggacagcctgtgtgtcccccagtataacaagtacagggaggagagggtgatcctcttcctgaagatggcctccgggcacgccttccagcctgacttggttaagaggatccgtgacgccatccgcatgggcttgtctgcgcgacacgtgcccagcctcatcctggaaaccaagggcatcccgtatacgctcaacggcaagaaagtggaagttgccgtcaaacagatcatcgctggaaaagccgtggagcaaggaggtgctttctcgaaccccgagaccctggatctgtaccgggacatccctgagctgcagggcttctgagtcagactggctggcgtgtcactcagccgcacccgtgtgcactgtaacttttgtgtgctcaagaaattatacagaaacctacagctgttgtaaaaggatgctcgcaccaagtgttctgtaggcttggggagggatcgtttctctgttttgttaaatctggtgggtacctggatcttccacacgagtgggattctggccttcagagaccaggagggagtgtctgggccgcaggtgtggcactgtggtgagagtgtgtgtctttgcacacacagtgcagcgggaacggtggggctggctggtgctgaagacagacacactcctgagccaaggtcttgtcttcaacctccccgtcccgttgtcccattttgctctgtgaaggtgcaaatccctttcttcccttcccatctcaggctctcctgttttccctcagggtccagtatgcctttgagctttagctgttagaaaggaacccccgtgacttgacacagctttcacagctggctgctaggaccggcgggctgggtgttcacgtgtgtctgtgtcatggatgcaatgcaggccctggaggactgtgcgtcacccgtcaaccagagcgtgcctccgggccagcttccctccaaggaatgagtggatttcatacaggatctctttattgcacagactgaatggctttacatgtttctaatgtgaattaggcatgtgaagcagtgggtgtccacccgtgtccctcatgggtgagccctccagctgtgagcccaggcagtgtggtcaccgagtgaggaccctcctcaccaggaaccgcatccctgtgctgcctccacctgagagttgctagggggttcttgtcgagatcatgtcatcagcacccctaagtcaagtcacgggtttccatagccaggcagttggtatgtacaattcagttcagcgtatgaacttgtatctctaatctgatgtccatttttatattttttgaaactgagcacaatgaaatcctttcttgaatcattttccttttggattataaaaatatgggggaaagtgctatgatgaattttatgcaataaatgtatacatgtgtgcacatgcaccca

SEQ ID NO: 103670 - DNA, 1235 bp, Homo sapiens
  Payload ID: 379
  Gene Symbol: AACS
  Gene Name: acetoacetyl-CoA synthetase
  ENST ID: ENST00000418937
  CDS Start-End: 152-808
cagtcccttgttccccgccgccgccgtcgctgacccagcccgccaggcgctcctgaccgtcgcttcctccggtcccaggtccccggccctcgcctcagccccggcccctggtccccagccctcgtcgcagccccggccgcccgccgccgccatgtccaaggaggagcgccccggtcgggaggagatcctggagtgccaggtgatgtgggagcctgacagtaagaagaacacgcagatggaccgcttccgggcggctgtgggcgccgcctgcggcctggcgctggagagttatgatgacttgtaccattggtccgttgagtcatattcagacttctgggcagagttctggaaattcagtggaattgtcttctcacgtgtgtatgatgaggttgtggacacatcgaaaggaatcgcagatgtccccgagtggttcaaaggcagtcggctcaactatgcagaaaacctcctgcggcacaaagagaatgacagagttgccctttacattgcaaatcagcacaagaaaccaaaccactggaaacaggcagtgagtggccctgcccaggctacagagcagggcctcccttctgccatcgtgggaaggaccagcagcccctgtgcagttggtaaagatcatggcagtccagttcccaccgagacttactgggacacatcttccggggctggggcccaggcttccatgtattttcaaagcccatgggcacttctgatgcacattcctggtgaagagccatggagcaacgtctcgacgtaccatatggggctggggaaggcaaagaggaaattgtgaaggtgacttttgaagagctgaggcaagaagtggctttgtttgcagcagcaatgaggaaaatgggtgtgaagaaaggagatcgggttgttggttatttacccaacagtgagcacgctgtcgaggcgatgctggctgcggcaagcattggtgccatctggagctccacgtccccggacttcggtgtgaatggtgtgctggaccggttttctcaaattcagccaaagctcatcttctctgtggaggctgttgtctataatggcaaagagcacaaccacatggaaaagctgcagcaggtggttaaaggcctaccagacttgaagaaagtggtggtgattccttatgtgtcctccagagagaacatagacctttcaaagattccaaacagtgtgtttctggatgactttcttgccaccggcaccagtgagca

SEQ ID NO: 103671 - DNA, 2172 bp, Homo sapiens
  Payload ID: 380
  Gene Symbol: ACHE
  Gene Name: acetylcholinesterase (Yt blood group)
  Uniprot ID: P22303
  ENST ID: ENST00000241069
  CDS Start-End: 108-1952
gtcagagtcggctcagcctgcgccggggaacatcggccgcctccagctcccggcgcggcccggcccggcccggctcggccgcctcagacgccgcctgccctgcagccatgaggcccccgcagtgtctgctgcacacgccttccctggcttccccactccttctcctcctcctctggctcctgggtggaggagtgggggctgagggccgggaggatgcagagctgctggtgacggtgcgtgggggccggctgcggggcattcgcctgaagacccccgggggccctgtctctgctttcctgggcatcccctttgcggagccacccatgggaccccgtcgctttctgccaccggagcccaagcagccttggtcaggggtggtagacgctacaaccttccagagtgtctgctaccaatatgtggacaccctatacccaggttttgagggcaccgagatgtggaaccccaaccgtgagctgagcgaggactgcctgtacctcaacgtgtggacaccatacccccggcctacatcccccacccctgtcctcgtctggatctatgggggtggcttctacagtggggcctcctccttggacgtgtacgatggccgcttcttggtacaggccgagaggactgtgctggtgtccatgaactaccgggtgggagcctttggcttcctggccctgccggggagccgagaggccccgggcaatgtgggtctcctggatcagaggctggccctgcagtgggtgcaggagaacgtggcagccttcgggggtgacccgacatcagtgacgctgtttggggagagcgcgggagccgcctcggtgggcatgcacctgctgtccccgcccagccggggcctgttccacagggccgtgctgcagagcggtgcccccaatggaccctgggccacggtgggcatgggagaggcccgtcgcagggccacgcagctggcccaccttgtgggctgtcctccaggcggcactggtgggaatgacacagagctggtagcctgccttcggacacgaccagcgcaggtcctggtgaaccacgaatggcacgtgctgcctcaagaaagcgtcttccggttctccttcgtgcctgtggtagatggagacttcctcagtgacaccccagaggccctcatcaacgcgggagacttccacggcctgcaggtgctggtgggtgtggtgaaggatgagggctcgtattttctggtttacggggccccaggcttcagcaaagacaacgagtctctcatcagccgggccgagttcctggccggggtgcgggtcggggttccccaggtaagtgacctggcagccgaggctgtggtcctgcattacacagactggctgcatcccgaggacccggcacgcctgagggaggccctgagcgatgtggtgggcgaccacaatgtcgtgtgccccgtggcccagctggctgggcgactggctgcccagggtgcccgggtctacgcctacgtctttgaacaccgtgcttccacgctctcctggcccctgtggatgggggtgccccacggctacgagatcgagttcatctttgggatccccctggacccctctcgaaactacacggcagaggagaaaatcttcgcccagcgactgatgcgatactgggccaactttgcccgcacaggggatcccaatgagccccgagaccccaaggccccacaatggcccccgtacacggcgggggctcagcagtacgttagtctggacctgcggccgctggaggtgcggcgggggctgcgcgcccaggcctgcgccttctggaaccgcttcctccccaaattgctcagcgccaccgacacgctcgacgaggcggagcgccagtggaaggccgagttccaccgctggagctcctacatggtgcactggaagaaccagttcgaccactacagcaagcaggatcgctgctcagacctgtgaccccggcgggacccccatgtcctccgctccgcccggccccctagctgtatatactatttatttcagggctgggctataacacagacgagccccagactctgcccatccccaccccaccccgacgtcccccggggctcccggtcctctgcatgtctcaggctgagctccctcccccgcggtgccttcgcccctctgggctgccaataaactgttacagcca

SEQ ID NO: 103672 - DNA, 2956 bp, Homo sapiens
  Payload ID: 380
  Gene Symbol: ACHE
  Gene Name: acetylcholinesterase (Yt blood group)
  Uniprot ID: P22303
  ENST ID: ENST00000302913
  CDS Start-End: 140-1993
ggggtgtgtgcggggggccggaggcggcggctgtcagagtcggctcagcctgcgccggggaacatcggccgcctccagctcccggcgcggcccggcccggcccggctcggccgcctcagacgccgcctgccctgcagccatgaggcccccgcagtgtctgctgcacacgccttccctggcttccccactccttctcctcctcctctggctcctgggtggaggagtgggggctgagggccgggaggatgcagagctgctggtgacggtgcgtgggggccggctgcggggcattcgcctgaagacccccgggggccctgtctctgctttcctgggcatcccctttgcggagccacccatgggaccccgtcgctttctgccaccggagcccaagcagccttggtcaggggtggtagacgctacaaccttccagagtgtctgctaccaatatgtggacaccctatacccaggttttgagggcaccgagatgtggaaccccaaccgtgagctgagcgaggactgcctgtacctcaacgtgtggacaccatacccccggcctacatcccccacccctgtcctcgtctggatctatgggggtggcttctacagtggggcctcctccttggacgtgtacgatggccgcttcttggtacaggccgagaggactgtgctggtgtccatgaactaccgggtgggagcctttggcttcctggccctgccggggagccgagaggccccgggcaatgtgggtctcctggatcagaggctggccctgcagtgggtgcaggagaacgtggcagccttcgggggtgacccgacatcagtgacgctgtttggggagagcgcgggagccgcctcggtgggcatgcacctgctgtccccgcccagccggggcctgttccacagggccgtgctgcagagcggtgcccccaatggaccctgggccacggtgggcatgggagaggcccgtcgcagggccacgcagctggcccaccttgtgggctgtcctccaggcggcactggtgggaatgacacagagctggtagcctgccttcggacacgaccagcgcaggtcctggtgaaccacgaatggcacgtgctgcctcaagaaagcgtcttccggttctccttcgtgcctgtggtagatggagacttcctcagtgacaccccagaggccctcatcaacgcgggagacttccacggcctgcaggtgctggtgggtgtggtgaaggatgagggctcgtattttctggtttacggggccccaggcttcagcaaagacaacgagtctctcatcagccgggccgagttcctggccggggtgcgggtcggggttccccaggtaagtgacctggcagccgaggctgtggtcctgcattacacagactggctgcatcccgaggacccggcacgcctgagggaggccctgagcgatgtggtgggcgaccacaatgtcgtgtgccccgtggcccagctggctgggcgactggctgcccagggtgcccgggtctacgcctacgtctttgaacaccgtgcttccacgctctcctggcccctgtggatgggggtgccccacggctacgagatcgagttcatctttgggatccccctggacccctctcgaaactacacggcagaggagaaaatcttcgcccagcgactgatgcgatactgggccaactttgcccgcacaggggatcccaatgagccccgagaccccaaggccccacaatggcccccgtacacggcgggggctcagcagtacgttagtctggacctgcggccgctggaggtgcggcgggggctgcgcgcccaggcctgcgccttctggaaccgcttcctccccaaattgctcagcgccaccgcctcggaggctcccagcacctgcccaggcttcacccatggggaggctgctccgaggcccggcctccccctgcccctcctcctcctccaccagcttctcctcctcttcctctcccacctccggcggctgtgaacacggcctcttcccctacggccacaggggcccctcctctaatgagtggtcggaccgtggggaagggccccactcagggatctcagacctagtgctcccttcctcctcaaaccgagagactcacactggacagggcaggaggagggggccgtgcctcccacccttctcagggacccccacgcctttgttgtttgaatggaaatggaaaagccagtattcttttataaaattatcttttggaacctgagcctgacattggggggaagtgggaggccccggacggggtagcaccccccattggggctataacggtcaaccatttctgtctcttctttttcccccaacctccccctcctgtcccctctgttcccgtcttccggtcattcttttctcctcctctctccttcctgctgtccttctccggccccgcctctgccctcatcctccctctcgtctttcgcacattctcctgatcctcttgccaccgtcccacgtggtcgcctgcatttctccgtgcgtcctccctgcactcatacccccccttcaacccgcccaaatgtccgatccccgaccttcctcgtgccgtcctcccctcccgcctcgctgggcgccctggccgcagacacgctcgacgaggcggagcgccagtggaaggccgagttccaccgctggagctcctacatggtgcactggaagaaccagttcgaccactacagcaagcaggatcgctgctcagacctgtgaccccggcgggacccccatgtcctccgctccgcccggccccctagctgtatatactatttatttcagggctgggctataacacagacgagccccagactctgcccatccccaccccaccccgacgtcccccggggctcccggtcctctgcatgtctcaggctgagctccctcccccgcggtgccttcgcccctctgggctgccaataaactgttacagcc

SEQ ID NO: 103673 - DNA, 1496 bp, Homo sapiens
  Payload ID: 380
  Gene Symbol: ACHE
  Gene Name: acetylcholinesterase (Yt blood group)
  ENST ID: ENST00000454485
  CDS Start-End: 2-1213
catgaggcccccgcagtgtctgctgcacacgccttccctggcttccccactccttctcctcctcctctggctcctgggtggaggagtgggggctgagggccgggaggatgcagagctgctggtgacggtgcgtgggggccggctgcggggcattcgcctgaagacccccgggggccctgtctctgctttcctgggcatcccctttgcggagccacccatgggaccccgtcgctttctgccaccggagcccaagcagccttggtcaggggtggtagacgctacaaccttccagagtgtctgctaccaatatgtggacaccctatacccaggttttgagggcaccgagatgtggaaccccaaccgtgagctgagcgaggactgcctgtacctcaacgtgtggacaccatacccccggcctacatcccccacccctgtcctcgtctggatctatgggggtggcttctacagtggggcctcctccttggacgtgtacgatggccgcttcttggtacaggccgagaggactgtgctggtgtccatgaactaccgggtgggagcctttggcttcctggccctgccggggagccgagaggccccgggcaatgtgggtctcctggatcagaggctggccctgcagtgggtgcaggagaacgtggcagccttcgggggtgacccgacatcagtgacgctgtttggggagagcgcgggagccgcctcggtgggcatgcacctgctgtccccgcccagccggggcctgttccacagggccgtgctgcagagcggtgcccccaatggaccctgggccacggtgggcatgggagaggcccgtcgcagggccacgcagctggcccaccttgtgggctgtcctccaggcggcactggtgggaatgacacagagctggtagcctgccttcggacacgaccagcgcaggtcctggtgaaccacgaatggcacgtgctgcctcaagaaagcgtcttccggttctccttcgtgcctgtggtagatggagacttcctcagtgacaccccagaggccctcatcaacgcgggagacttccacggcctgcaggtgctggtgggtgtggtgaaggatgagggctcgtattttctggtttacggggccccaggcttcagcaaagacaacgagtctctcatcagccgggccgagttcctggccggggtgcgggtcggggttccccagggatcccaatgagccccgagaccccaaggccccacaatggcccccgtacacggcgggggctcagcagtacgttagtctggacctgcggccgctggaggtgcggcgggggctgcgcgcccaggcctgcgccttctggaaccgcttcctccccaaattgctcagcgccaccgacacgctcgacgaggcggagcgccagtggaaggccgagttccaccgctggagctcctacatggtgcactggaagaaccagttcgaccactacagcaagcaggatcgctgctcagacctgtgaccc

SEQ ID NO: 103674 - DNA, 2218 bp, Homo sapiens
  Payload ID: 380
  Gene Symbol: ACHE
  Gene Name: acetylcholinesterase (Yt blood group)
  Uniprot ID: P22303
  ENST ID: ENST00000412389
  CDS Start-End: 157-2001
ctctcccctcatctttgccaacctgccccacctcctctgcagctgagcgataacccttgggccgacagtgccctaatctcctccctcctggcttctcgaccgacccttcaccctttccctttctttctcccagcagacgccgcctgccctgcagccatgaggcccccgcagtgtctgctgcacacgccttccctggcttccccactccttctcctcctcctctggctcctgggtggaggagtgggggctgagggccgggaggatgcagagctgctggtgacggtgcgtgggggccggctgcggggcattcgcctgaagacccccgggggccctgtctctgctttcctgggcatcccctttgcggagccacccatgggaccccgtcgctttctgccaccggagcccaagcagccttggtcaggggtggtagacgctacaaccttccagagtgtctgctaccaatatgtggacaccctatacccaggttttgagggcaccgagatgtggaaccccaaccgtgagctgagcgaggactgcctgtacctcaacgtgtggacaccatacccccggcctacatcccccacccctgtcctcgtctggatctatgggggtggcttctacagtggggcctcctccttggacgtgtacgatggccgcttcttggtacaggccgagaggactgtgctggtgtccatgaactaccgggtgggagcctttggcttcctggccctgccggggagccgagaggccccgggcaatgtgggtctcctggatcagaggctggccctgcagtgggtgcaggagaacgtggcagccttcgggggtgacccgacatcagtgacgctgtttggggagagcgcgggagccgcctcggtgggcatgcacctgctgtccccgcccagccggggcctgttccacagggccgtgctgcagagcggtgcccccaatggaccctgggccacggtgggcatgggagaggcccgtcgcagggccacgcagctggcccaccttgtgggctgtcctccaggcggcactggtgggaatgacacagagctggtagcctgccttcggacacgaccagcgcaggtcctggtgaaccacgaatggcacgtgctgcctcaagaaagcgtcttccggttctccttcgtgcctgtggtagatggagacttcctcagtgacaccccagaggccctcatcaacgcgggagacttccacggcctgcaggtgctggtgggtgtggtgaaggatgagggctcgtattttctggtttacggggccccaggcttcagcaaagacaacgagtctctcatcagccgggccgagttcctggccggggtgcgggtcggggttccccaggtaagtgacctggcagccgaggctgtggtcctgcattacacagactggctgcatcccgaggacccggcacgcctgagggaggccctgagcgatgtggtgggcgaccacaatgtcgtgtgccccgtggcccagctggctgggcgactggctgcccagggtgcccgggtctacgcctacgtctttgaacaccgtgcttccacgctctcctggcccctgtggatgggggtgccccacggctacgagatcgagttcatctttgggatccccctggacccctctcgaaactacacggcagaggagaaaatcttcgcccagcgactgatgcgatactgggccaactttgcccgcacaggggatcccaatgagccccgagaccccaaggccccacaatggcccccgtacacggcgggggctcagcagtacgttagtctggacctgcggccgctggaggtgcggcgggggctgcgcgcccaggcctgcgccttctggaaccgcttcctccccaaattgctcagcgccaccgacacgctcgacgaggcggagcgccagtggaaggccgagttccaccgctggagctcctacatggtgcactggaagaaccagttcgaccactacagcaagcaggatcgctgctcagacctgtgaccccggcgggacccccatgtcctccgctccgcccggccccctagctgtatatactatttatttcagggctgggctataacacagacgagccccagactctgcccatccccaccccaccccgacgtcccccggggctcccggtcctctgcatgtctcaggctgagctccctcccccgcggtgccttcgcccctctgggctgccaataaactgttacag

SEQ ID NO: 103675 - DNA, 585 bp, Homo sapiens
  Payload ID: 380
  Gene Symbol: ACHE
  Gene Name: acetylcholinesterase (Yt blood group)
  ENST ID: ENST00000441605
  CDS Start-End: 110-585
gtccctgcgtttgtctgtgcctgtcactgcatgaggtcgtccgtctgcgcgtgtctgtctccacgggcttctgtccgtctgtctgtcacacgccgcctgccctgcagccatgaggcccccgcagtgtctgctgcacacgccttccctggcttccccactccttctcctcctcctctggctcctgggtggaggagtgggggctgagggccgggaggatgcagagctgctggtgacggtgcgtgggggccggctgcggggcattcgcctgaagacccccgggggccctgtctctgctttcctgggcatcccctttgcggagccacccatgggaccccgtcgctttctgccaccggagcccaagcagccttggtcaggggtggtagacgctacaaccttccagagtgtctgctaccaatatgtggacaccctatacccaggttttgagggcaccgagatgtggaaccccaaccgtgagctgagcgaggactgcctgtacctcaacgtgtggacaccatacccccggcctacatcccccacccctgtcctcgtctggatctatgggggtggcttctacagtggggcctc

SEQ ID NO: 103676 - DNA, 1194 bp, Homo sapiens
  Payload ID: 380
  Gene Symbol: ACHE
  Gene Name: acetylcholinesterase (Yt blood group)
  ENST ID: ENST00000426415
  CDS Start-End: 2-1194
catgaggcccccgcagtgtctgctgcacacgccttccctggcttccccactccttctcctcctcctctggctcctgggtggaggagtgggggctgagggccgggaggatgcagagctgctggtgacggtgcgtgggggccggctgcggggcattcgcctgaagacccccgggggccctgtctctgctttcctgggcatcccctttgcggagccacccatgggaccccgtcgctttctgccaccggagcccaagcagccttggtcaggggtggtagacgctacaaccttccagagtgtctgctaccaatatgtggacaccctatacccaggttttgagggcaccgagatgtggaaccccaaccgtgagctgagcgaggactgcctgtacctcaacgtgtggacaccatacccccggcctacatcccccacccctgtcctcgtctggatctatgggggtggcttctacagtggggcctcctccttggacgtgtacgatggccgcttcttggtacaggccgagaggactgtgctggtgtccatgaactaccgggtgggagcctttggcttcctggccctgccggggagccgagaggccccgggcaatgtgggtctcctggatcagaggctggccctgcagtgggtgcaggagaacgtggcagccttcgggggtgacccgacatcagtgacgctgtttggggagagcgcgggagccgcctcggtgggcatgcacctgctgtccccgcccagccggggcctgttccacagggccgtgctgcagagcggtgcccccaatggaccctgggccacggtgggcatgggagaggcccgtcgcagggccacgcagctggcccaccttgtgggctgtcctccaggcggcactggtgggaatgacacagagctggtagcctgccttcggacacgaccagcgcaggtcctggtgaaccacgaatggcacgtgctgcctcaagaaagcgtcttccggttctccttcgtgcctgtggtagatggagacttcctcagtgacaccccagaggccctcatcaacgcgggagacttccacggcctgcagacacgctcgacgaggcggagcgccagtggaaggccgagttccaccgctggagctcctacatggtgcactggaagaaccagttcgaccactacagcaagcaggatcgctgctcagacctgtgaccc

SEQ ID NO: 103677 - DNA, 1305 bp, Homo sapiens
  Payload ID: 380
  Gene Symbol: ACHE
  Gene Name: acetylcholinesterase (Yt blood group)
  ENST ID: ENST00000430554
  CDS Start-End: 2-1305
catgaggcccccgcagtgtctgctgcacacgccttccctggcttccccactccttctcctcctcctctggctcctgggtggaggagtgggggctgagggccgggaggatgcagagctgctggtgacggtgcgtgggggccggctgcggggcattcgcctgaagacccccgggggccctgtctctgctttcctgggcatcccctttgcggagccacccatgggaccccgtcgctttctgccaccggagcccaagcagccttggtcaggggtggtagacgctacaaccttccagagtgtctgctaccaatatgtggacaccctatacccaggttttgagggcaccgagatgtggaaccccaaccgtgagctgagcgaggactgcctgtacctcaacgtgtggacaccatacccccggcctacatcccccacccctgtcctcgtctggatctatgggggtggcttctacagtggggcctcctccttggacgtgtacgatggccgcttcttggtacaggccgagaggactgtgctggtgtccatgaactaccgggtgggagcctttggcttcctggccctgccggggagccgagaggccccgggcaatgtgggtctcctggatcagaggctggccctgcagtgggtgcaggagaacgtggcagccttcgggggtgacccgacatcagtgacgctgtttggggagagcgcgggagccgcctcggtgggcatgcacctgctgtccccgcccagccggggcctgttccacagggccgtgctgcagagcggtgcccccaatggaccctgggccacggtgggcatgggagaggcccgtcgcagggccacgcagctggcccaccttgtgggctgtcctccaggcggcactggtgggaatgacacagagctggtagcctgccttcggacacgaccagcgcaggtcctggtgaaccacgaatggcacgtgctgcctcaagaaagcgtcttccggttctccttcgtgcctgtggtagatggagacttcctcagtgacaccccagaggccctcatcaacgcgggagacttccacggcctgcaggtgctggtgggtgtggtgaaggatgagggctcgtattttctggtttacggggccccaggcttcagcaaagacaacgagtctctcatcagccgggccgagttcctggccgggacacgctcgacgaggcggagcgccagtggaaggccgagttccaccgctggagctcctacatggtgcactggaagaaccagttcgaccactacagcaagcaggatcgctgctcagacctgtgaccc

SEQ ID NO: 103678 - DNA, 153 bp, Homo sapiens
  Payload ID: 380
  Gene Symbol: ACHE
  Gene Name: acetylcholinesterase (Yt blood group)
  ENST ID: ENST00000445236
  CDS Start-End: 70-153
cctcgcccagcagccttgcgcgtgctaccacgctgtcctgccttctcagacgccgcctgccctgcagccatgaggcccccgcagtgtctgctgcacacgccttccctggcttccccactccttctcctcctcctctggctcctgggtggagga

SEQ ID NO: 103679 - DNA, 1906 bp, Homo sapiens
  Payload ID: 380
  Gene Symbol: ACHE
  Gene Name: acetylcholinesterase (Yt blood group)
  Uniprot ID: P22303
  ENST ID: ENST00000419336
  CDS Start-End: 106-1686
cagagtcggctcagcctgcgccggggaacatcggccgcctccagctcccggcgcggcccggcccggcccggctcggccgcctcagacgccgcctgccctgcagccatgaggcccccgcagtgtctgctgcacacgccttccctggcttccccactccttctcctcctcctctggctcctgggtggaggagtgggggctgagggccgggaggatgcagagctgctggtgacggtgcgtgggggccggctgcggggcattcgcctgaagacccccgggggccctgtctctgctttcctgggcatcccctttgcggagccacccatgggaccccgtcgctttctgccaccggagcccaagcagccttggtcaggggtggtagacgctacaaccttccagagtgtctgctaccaatatgtggacaccctatacccaggttttgagggcaccgagatgtggaaccccaaccgtgagctgagcgaggactgcctgtacctcaacgtgtggacaccatacccccggcctacatcccccacccctgtcctcgtctggatctatgggggtggcttctacagtggggcctcctccttggacgtgtacgatggccgcttcttggtacaggccgagaggactgtgctggtgtccatgaactaccgggtgggagcctttggcttcctggccctgccggggagccgagaggccccgggcaatgtgggtctcctggatcagaggctggccctgcagtgggtgcaggagaacgtggcagccttcgggggtgacccgacatcagtgacgctgtttggggagagcgcgggagccgcctcggtgggcatgcacctgctgtccccgcccagccggggcctgttccacagggccgtgctgcagagcggtgcccccaatggaccctgggccacggtgggcatgggagaggcccgtcgcagggccacgcagctggcccaccttgtgggctgtcctccaggcggcactggtgggaatgacacagagctggtagcctgccttcggacacgaccagcgcaggtcctggtgaaccacgaatggcacgtgctgcctcaagaaagcgtcttccggttctccttcgtgcctgtggtagatggagacttcctcagtgacaccccagaggccctcatcaacgcgggagacttccacggcctgcagctggctgggcgactggctgcccagggtgcccgggtctacgcctacgtctttgaacaccgtgcttccacgctctcctggcccctgtggatgggggtgccccacggctacgagatcgagttcatctttgggatccccctggacccctctcgaaactacacggcagaggagaaaatcttcgcccagcgactgatgcgatactgggccaactttgcccgcacaggggatcccaatgagccccgagaccccaaggccccacaatggcccccgtacacggcgggggctcagcagtacgttagtctggacctgcggccgctggaggtgcggcgggggctgcgcgcccaggcctgcgccttctggaaccgcttcctccccaaattgctcagcgccaccgacacgctcgacgaggcggagcgccagtggaaggccgagttccaccgctggagctcctacatggtgcactggaagaaccagttcgaccactacagcaagcaggatcgctgctcagacctgtgaccccggcgggacccccatgtcctccgctccgcccggccccctagctgtatatactatttatttcagggctgggctataacacagacgagccccagactctgcccatccccaccccaccccgacgtcccccggggctcccggtcctctgcatgtctcaggctgagctccctcccccgcggtgccttcgcccctctgggctgccaataaactgttacagcca

SEQ ID NO: 103680 - DNA, 2179 bp, Homo sapiens
  Payload ID: 380
  Gene Symbol: ACHE
  Gene Name: acetylcholinesterase (Yt blood group)
  Uniprot ID: P22303
  ENST ID: ENST00000411582
  CDS Start-End: 84-1937
gaacatcggccgcctccagctcccggcgcggcccggcccggcccggctcggccgcctcagcagacgccgcctgccctgcagccatgaggcccccgcagtgtctgctgcacacgccttccctggcttccccactccttctcctcctcctctggctcctgggtggaggagtgggggctgagggccgggaggatgcagagctgctggtgacggtgcgtgggggccggctgcggggcattcgcctgaagacccccgggggccctgtctctgctttcctgggcatcccctttgcggagccacccatgggaccccgtcgctttctgccaccggagcccaagcagccttggtcaggggtggtagacgctacaaccttccagagtgtctgctaccaatatgtggacaccctatacccaggttttgagggcaccgagatgtggaaccccaaccgtgagctgagcgaggactgcctgtacctcaacgtgtggacaccatacccccggcctacatcccccacccctgtcctcgtctggatctatgggggtggcttctacagtggggcctcctccttggacgtgtacgatggccgcttcttggtacaggccgagaggactgtgctggtgtccatgaactaccgggtgggagcctttggcttcctggccctgccggggagccgagaggccccgggcaatgtgggtctcctggatcagaggctggccctgcagtgggtgcaggagaacgtggcagccttcgggggtgacccgacatcagtgacgctgtttggggagagcgcgggagccgcctcggtgggcatgcacctgctgtccccgcccagccggggcctgttccacagggccgtgctgcagagcggtgcccccaatggaccctgggccacggtgggcatgggagaggcccgtcgcagggccacgcagctggcccaccttgtgggctgtcctccaggcggcactggtgggaatgacacagagctggtagcctgccttcggacacgaccagcgcaggtcctggtgaaccacgaatggcacgtgctgcctcaagaaagcgtcttccggttctccttcgtgcctgtggtagatggagacttcctcagtgacaccccagaggccctcatcaacgcgggagacttccacggcctgcaggtgctggtgggtgtggtgaaggatgagggctcgtattttctggtttacggggccccaggcttcagcaaagacaacgagtctctcatcagccgggccgagttcctggccggggtgcgggtcggggttccccaggtaagtgacctggcagccgaggctgtggtcctgcattacacagactggctgcatcccgaggacccggcacgcctgagggaggccctgagcgatgtggtgggcgaccacaatgtcgtgtgccccgtggcccagctggctgggcgactggctgcccagggtgcccgggtctacgcctacgtctttgaacaccgtgcttccacgctctcctggcccctgtggatgggggtgccccacggctacgagatcgagttcatctttgggatccccctggacccctctcgaaactacacggcagaggagaaaatcttcgcccagcgactgatgcgatactgggccaactttgcccgcacaggggatcccaatgagccccgagaccccaaggccccacaatggcccccgtacacggcgggggctcagcagtacgttagtctggacctgcggccgctggaggtgcggcgggggctgcgcgcccaggcctgcgccttctggaaccgcttcctccccaaattgctcagcgccaccgcctcggaggctcccagcacctgcccaggcttcacccatggggaggctgctccgaggcccggcctccccctgcccctcctcctcctccaccagcttctcctcctcttcctctcccacctccggcggctgtgaacacggcctcttcccctacggccacaggggcccctcctctaatgagtggtcggaccgtggggaagggccccactcagggatctcagacctagtgctcccttcctcctcaaaccgagagactcacactggacagggcaggaggagggggccgtgcctcccacccttctcagggacccccacgcctttgttgtttgaatggaaatggaaaagccagtattcttttataaaattatcttttggaa

SEQ ID NO: 103681 - DNA, 1364 bp, Homo sapiens
  Payload ID: 380
  Gene Symbol: ACHE
  Gene Name: acetylcholinesterase (Yt blood group)
  ENST ID: ENST00000440755
  CDS Start-End: 2-1081
catgaggcccccgcagtgtctgctgcacacgccttccctggcttccccactccttctcctcctcctctggctcctgggtggaggagtgggggctgagggccgggaggatgcagagctgctggtgacggtgcgtgggggccggctgcggggcattcgcctgaagacccccgggggccctgtctctgctttcctgggcatcccctttgcggagccacccatgggaccccgtcgctttctgccaccggagcccaagcagccttggtcaggggtggtagacgctacaaccttccagagtgtctgctaccaatatgtggacaccctatacccaggttttgagggcaccgagatgtggaaccccaaccgtgagctgagcgaggactgcctgtacctcaacgtgtggacaccatacccccggcctacatcccccacccctgtcctcgtctggatctatgggggtggcttctacagtggggcctcctccttggacgtgtacgatggccgcttcttggtacaggccgagaggactgtgctggtgtccatgaactaccgggtgggagcctttggcttcctggccctgccggggagccgagaggccccgggcaatgtgggtctcctggatcagaggctggccctgcagtgggtgcaggagaacgtggcagccttcgggggtgacccgacatcagtgacgctgtttggggagagcgcgggagccgcctcggtgggcatgcacctgctgtccccgcccagccggggcctgttccacagggccgtgctgcagagcggtgcccccaatggaccctgggccacggtgggcatgggagaggcccgtcgcagggccacgcagctggcccaccttgtgggctgtcctccaggcggcactggtgggaatgacacagagctggtagcctgccttcggacacgaccagcgcaggtcctggtgaaccacgaatggcacgtgctgcctcaagaaagcgtcttccggttctccttcgtgcctgtggtagatggagacttcctcagtgacaccccagaggccctcatcaacgcgggagacttccacggcctgcagggatcccaatgagccccgagaccccaaggccccacaatggcccccgtacacggcgggggctcagcagtacgttagtctggacctgcggccgctggaggtgcggcgggggctgcgcgcccaggcctgcgccttctggaaccgcttcctccccaaattgctcagcgccaccgacacgctcgacgaggcggagcgccagtggaaggccgagttccaccgctggagctcctacatggtgcactggaagaaccagttcgaccactacagcaagcaggatcgctgctcagacctgtgaccc

SEQ ID NO: 103682 - DNA, 2159 bp, Homo sapiens
  Payload ID: 380
  Gene Symbol: ACHE
  Gene Name: acetylcholinesterase (Yt blood group)
  Uniprot ID: P22303
  ENST ID: ENST00000428317
  CDS Start-End: 95-1939
tctactccgccgctgcaggtctttgggtcgcgtctgtcactgcgctctgtcgtcggtcggcgtctggcactggaacgccgcctgccctgcagccatgaggcccccgcagtgtctgctgcacacgccttccctggcttccccactccttctcctcctcctctggctcctgggtggaggagtgggggctgagggccgggaggatgcagagctgctggtgacggtgcgtgggggccggctgcggggcattcgcctgaagacccccgggggccctgtctctgctttcctgggcatcccctttgcggagccacccatgggaccccgtcgctttctgccaccggagcccaagcagccttggtcaggggtggtagacgctacaaccttccagagtgtctgctaccaatatgtggacaccctatacccaggttttgagggcaccgagatgtggaaccccaaccgtgagctgagcgaggactgcctgtacctcaacgtgtggacaccatacccccggcctacatcccccacccctgtcctcgtctggatctatgggggtggcttctacagtggggcctcctccttggacgtgtacgatggccgcttcttggtacaggccgagaggactgtgctggtgtccatgaactaccgggtgggagcctttggcttcctggccctgccggggagccgagaggccccgggcaatgtgggtctcctggatcagaggctggccctgcagtgggtgcaggagaacgtggcagccttcgggggtgacccgacatcagtgacgctgtttggggagagcgcgggagccgcctcggtgggcatgcacctgctgtccccgcccagccggggcctgttccacagggccgtgctgcagagcggtgcccccaatggaccctgggccacggtgggcatgggagaggcccgtcgcagggccacgcagctggcccaccttgtgggctgtcctccaggcggcactggtgggaatgacacagagctggtagcctgccttcggacacgaccagcgcaggtcctggtgaaccacgaatggcacgtgctgcctcaagaaagcgtcttccggttctccttcgtgcctgtggtagatggagacttcctcagtgacaccccagaggccctcatcaacgcgggagacttccacggcctgcaggtgctggtgggtgtggtgaaggatgagggctcgtattttctggtttacggggccccaggcttcagcaaagacaacgagtctctcatcagccgggccgagttcctggccggggtgcgggtcggggttccccaggtaagtgacctggcagccgaggctgtggtcctgcattacacagactggctgcatcccgaggacccggcacgcctgagggaggccctgagcgatgtggtgggcgaccacaatgtcgtgtgccccgtggcccagctggctgggcgactggctgcccagggtgcccgggtctacgcctacgtctttgaacaccgtgcttccacgctctcctggcccctgtggatgggggtgccccacggctacgagatcgagttcatctttgggatccccctggacccctctcgaaactacacggcagaggagaaaatcttcgcccagcgactgatgcgatactgggccaactttgcccgcacaggggatcccaatgagccccgagaccccaaggccccacaatggcccccgtacacggcgggggctcagcagtacgttagtctggacctgcggccgctggaggtgcggcgggggctgcgcgcccaggcctgcgccttctggaaccgcttcctccccaaattgctcagcgccaccgacacgctcgacgaggcggagcgccagtggaaggccgagttccaccgctggagctcctacatggtgcactggaagaaccagttcgaccactacagcaagcaggatcgctgctcagacctgtgaccccggcgggacccccatgtcctccgctccgcccggccccctagctgtatatactatttatttcagggctgggctataacacagacgagccccagactctgcccatccccaccccaccccgacgtcccccggggctcccggtcctctgcatgtctcaggctgagctccctcccccgcggtgccttcgcccctctgggctgccaataaactgttacagcca

SEQ ID NO: 103683 - DNA, 1472 bp, Homo sapiens
  Payload ID: 380
  Gene Symbol: ACHE
  Gene Name: acetylcholinesterase (Yt blood group)
  ENST ID: ENST00000442452
  CDS Start-End: 2-169
catgaggcccccgcagtgtctgctgcacacgccttccctggcttccccactccttctcctcctcctctggctcctgggtggaggagtgggggctgagggccgggaggatgcagagctgctggtgacggttttgagggcaccgagatgtggaaccccaaccgtgagctgagcgaggactgcctgtacctcaacgtgtggacaccatacccccggcctacatcccccacccctgtcctcgtctggatctatgggggtggcttctacagtggggcctcctccttggacgtgtacgatggccgcttcttggtacaggccgagaggactgtgctggtgtccatgaactaccgggtgggagcctttggcttcctggccctgccggggagccgagaggccccgggcaatgtgggtctcctggatcagaggctggccctgcagtgggtgcaggagaacgtggcagccttcgggggtgacccgacatcagtgacgctgtttggggagagcgcgggagccgcctcggtgggcatgcacctgctgtccccgcccagccggggcctgttccacagggccgtgctgcagagcggtgcccccaatggaccctgggccacggtgggcatgggagaggcccgtcgcagggccacgcagctggcccaccttgtgggctgtcctccaggcggcactggtgggaatgacacagagctggtagcctgccttcggacacgaccagcgcaggtcctggtgaaccacgaatggcacgtgctgcctcaagaaagcgtcttccggttctccttcgtgcctgtggtagatggagacttcctcagtgacaccccagaggccctcatcaacgcgggagacttccacggcctgcagactggctgcatcccgaggacccggcacgcctgagggaggccctgagcgatgtggtgggcgaccacaatgtcgtgtgccccgtggcccagctggctgggcgactggctgcccagggtgcccgggtctacgcctacgtctttgaacaccgtgcttccacgctctcctggcccctgtggatgggggtgccccacggctacgagatcgagttcatctttgggatccccctggacccctctcgaaactacacggcagaggagaaaatcttcgcccagcgactgatgcgatactgggccaactttgcccgcacaggggatcccaatgagccccgagaccccaaggccccacaatggcccccgtacacggcgggggctcagcagtacgttagtctggacctgcggccgctggaggtgcggcgggggctgcgcgcccaggcctgcgccttctggaaccgcttcctccccaaattgctcagcgccaccgacacgctcgacgaggcggagcgccagtggaaggccgagttccaccgctggagctcctacatggtgcactggaagaaccagttcgaccactacagcaagcaggatcgctgctcagacctgtgaccc

SEQ ID NO: 103684 - DNA, 1761 bp, Homo sapiens
  Payload ID: 381
  Gene Symbol: ACAT1
  Gene Name: acetyl-CoA acetyltransferase 1
  Uniprot ID: P24752
  ENST ID: ENST00000265838
  CDS Start-End: 92-1375
gcggtgcccgcgccgggccgctaggggtgcggggttggggaggaggccgctagtctacgcctgtggagccgatactcagccctctgcgaccatggctgtgctggcggcacttctgcgcagcggcgcccgcagccgcagccccctgctccggaggctggtgcaggaaataagatatgtggaacggagttatgtatcaaaacccactttgaaggaagtggtcatagtaagtgctacaagaacacccattggatcttttttaggcagcctttccttgctgccagccactaagcttggttccattgcaattcagggagccattgaaaaggcagggattccaaaagaagaagtgaaagaagcatacatgggtaatgttctacaaggaggtgaaggacaagctcctacaaggcaggcagtattgggtgcaggcttacctatttctactccatgtaccaccataaacaaagtttgtgcttcaggaatgaaagccatcatgatggcctctcaaagtcttatgtgtggacatcaggatgtgatggtggcaggtgggatggagagcatgtccaatgttccatatgtaatgaacagaggatcaacaccatatggtggggtaaagcttgaagatttgattgtaaaagacgggctaactgatgtctacaataaaattcatatgggcagctgtgctgagaatacagcaaagaagctgaatattgcacgaaatgaacaggacgcttatgctattaattcttataccagaagtaaagcagcatgggaagctgggaaatttggaaatgaagttattcctgtcacagttacagtaaaaggtcaaccagatgtagtggtgaaagaagatgaagaatataaacgtgttgattttagcaaagttccaaagctgaagacagttttccagaaagaaaatggcacagtaacagctgccaatgccagtacactgaatgatggagcagctgctctggttctcatgacggcagatgcagcgaagaggctcaatgttacaccactggcaagaatagtagcatttgctgacgctgctgtagaacctattgattttccaattgctcctgtatatgctgcatctatggttcttaaagatgtgggattgaaaaaagaagatattgcaatgtgggaagtaaatgaagcctttagtctggttgtactagcaaacattaaaatgttggagattgatccccaaaaagtgaatatcaatggaggagctgtttctctgggacatccaattgggatgtctggagccaggattgttggtcatttgactcatgccttgaagcaaggagaatacggtcttgccagtatttgcaatggaggaggaggtgcttctgccatgctaattcagaagctgtagacaacctctgctatttaaggagacaaccctatgtgaccagaaggcctgctgtaatcagtgtgactactgtgggtcagcttatattcagataagctgtttcattttttattattttctatgttaacttttaaaaatcaaaatgatgaaatcccaaaacattttgaaattaaaaataaatttcttcttctgcttttttcttggtaaccttgaaaagtttgatacatttttgcattctgagtctatacttatcgaaatatggtagaaataccaatgtgtaatattagtgacttacataagtagctagaagtttccatttgtgagaacacatttatatttttgaggattgttaaaggtcaagtgaatgctctttataggtaatttacatt

SEQ ID NO: 103685 - DNA, 1345 bp, Homo sapiens
  Payload ID: 381
  Gene Symbol: ACAT1
  Gene Name: acetyl-CoA acetyltransferase 1
  Uniprot ID: P24752
  ENST ID: ENST00000299355
  CDS Start-End: 41-529
agtctacgcctgtggagccgatactcagccctctgcgaccatggctgtgctggcggcacttctgcgcagcggcgcccgcagccgcagccccctgctccggaggctggtgcaggaaataagatatgtggaacggagttatgtatcaaaacccactttgaaggaagtggtcatagtaagtgctacaagaacacccattggatcttttttaggcagcctttccttgctgccagccactaagcttggttccattgcaattcagggagccattgaaaaggcagggattccaaaagaagaagtgaaagaagcatacatgggtaatgttctacaaggaggtgaaggacaagctcctacaaggcaggcagtattgggtgcaggcttacctatttctactccatgtaccaccataaacaaagtttgtgcttcaggaatgaaagccatcatgatggcctctcaaagtcttatgtgtggacatcagatcaagcaagagacaggctccttagcaaaaatatgctgtcatgtcaggaggtgagacctggacacacagaagaatcaagattctctcagatctgagcccttcatttttcagatgaagatttttttcagtgtgtctgagacagccacagagttacagggctgagcatctgccatgtgacagtcattggaaatagagtggtgaacaaaacatttaaaaaaatctgtacatgtgcaggtctctgttggaaaaatgcctaaaagaaatgctgagtcaggatttgaacattttggtatttgcaaatgctttccataaaagttgtaccagttagactttccaaaaattgtgtgacttgtctggatctgcaccaccactgggtggtaccaaacccttgtcaaactggtaggtgaaaaacggtcaccagatttagtttcagaactgtttgtcatggaaagttttgtcttaattgaagtattgtggttctctagcaaatgccatttgtactatattgaaatactttcatttaatattattttattcatttgtggatatatacagtgacttataggcattcttggaagtgctttgttttgaatatttatgaccttagaaaacagtcagttttactttataatgaagaattgataccttattttctgtcacttattattgccatcacccccagtaaaaagtacaagtgaataaaacttagatgagaactgattaagaatttctctatttcggaataggcaaaatatttatgtttctttggtatagagcttgcttgtctgtatgcctgattaaagactgtaagaagatattattggctttatgtttacattaatgttttatattaaactgtttttaactagc

SEQ ID NO: 103686 - DNA, 493 bp, Homo sapiens
  Payload ID: 381
  Gene Symbol: ACAT1
  Gene Name: acetyl-CoA acetyltransferase 1
  ENST ID: ENST00000527942
  CDS Start-End: 330-493
aggacagtcacgcgacgggttctggtccaaaaaccgcctaagtgctccgataacacccagggactcgcctatttttacagcgcgtttctacttccaaggtctcggcgtaatcatcttaatgagcgttactggaaataagatatgtggaacggagttatgtatcaaaacccactttgaaggaagtggtcatagtaagtgctacaagaacacccattggatcttttttaggcagcctttccttgctgccagccactaagcttggttccattgcaattcagggagccattgaaaaggcagggattccaaaagaagaagtgaaagaagcatacatgggtaatgttctacaaggaggtgaaggacaagctcctacaaggcaggcagtattgggtgcaggcttacctatttctactccatgtaccaccataaacaaagtttgtgcttcaggaatgaaagccatcatgatggcctctcaaagtcttatgtgtggacatca

SEQ ID NO: 103687 - DNA, 2258 bp, Homo sapiens
  Payload ID: 381
  Gene Symbol: ACAT1
  Gene Name: acetyl-CoA acetyltransferase 1
  ENST ID: ENST00000531813
  CDS Start-End: 24-449
ccgatactcagccctctgcgaccatggctgtgctggcggcacttctgcgcagcggcgcccgcagccgcagccccctgctccggaggctggtgcaggaaataagatatgtggaacggagttatgtatcaaaacccactttgaaggaagtggtcatagtaagtgctacaagaacacccattggatcttttttaggcagcctttccttgctgccagccactaagcttggttccattgcaattcagggagccattgaaaaggcagggattccaaaagaagaagtgaaagaagcatacatgggtaatgttctacaaggaggtgaaggacaagctcctacaaggcaggcagtattgggtgcaggatgtgatggtggcaggtgggatggagagcatgtccaatgttccatatgtaatgaacagaggatcaacaccatatggtggggtaaagcttgaagatttgattgtaaaagacgggctaactgatgtctacaataaaattcatatgggcagctgtgctgagaatacagcaaagaagctgaatattgcacgaaatgaacaggacgcttatgctattaattcttataccagaagtaaagcagcatgggaagctgggaaatttggaaatgaagttattcctgtcacagttacagtaaaaggtcaaccagatgtagtggtgaaagaagatgaagaatataaacgtgttgattttagcaaagttccaaagctgaagacagttttccagaaagaaaatggcacagtaacagctgccaatgccagtacactgaatgatggagcagctgctctggttctcatgacggcagatgcagcgaagaggctcaatgttacaccactggcaagaatagtaggtaaggccaggcgaggtggctcacacctgtaatcccagcactttcggaggttgaggtgggaggattgcttgagccccggagttcgaaatcagcctgggcaatatagtgagacttcgtctctacaaaaagttaaaaaattagctgagcatggtggcatgtgcctgtactaccatctactcgggaagctgaggtgggaggatgccttgagcccaggagtttgaggttgcagtgaactgagattgtaccactgcactccagcctgggtgacagagcgagaccctgtcttaaaaaaaaataaggtttctaaacatctataagctcttcatgaaattgagtttacttgttagatatagccaactccaatattaagtattactacctaggttgtacttgtggcagaatttaattgatacatatttcaattgagatagaagctcctttaatattttcattatactttatataagattaagctttaagggctgggcacagtggttcacgcctgtaaccccagcattttgggaggataaggcaggattgcttgaggcctggagtttgagaccagcctgggcaacacagtgagaccccacctctgaaagaaaaaaattagccaggtgtggtagcatgcctgtagtcccagttacgtaggaggctaaggctgacgatcatttgagcccaagatgtcaaagctgcagccagcctaggcaacagagcaagatcttgtctctttttctttttttttaaattaagctttaaaaaacttcctgtcctgtatgataaatagcagaaaataaagtacatgcattttcctacagaggcagctatgtaggaaaaaaagaatatgggattaggagtccagaaatacaaaatttacatgtgtggtgttttagtatttattaactctgtggccttgggcaagttctcaatgtccttaagccgatttttagctgcagaaatctgtcttgccttcttcctaaggacttaacagatgctattttgttactttataaaaagccttataacttcattttttttcttagcttagatcatggtttcttaacctcagcactattgacttttgcactaagtaattctttgttgtagggactgttctatgcattgtagatgtttagcagaatccttagtctttacccagtggcatctgaactattctgacaaccaaaaacatctctaggtggtgccaatgttcctagaggcaaatacccccaaactcccccccaatgaaaatcagtgtcttagattactggagtaattttataaagtgtagaatcctagaaaaggaagacatatatttacatatattaaaggggctaggaaatgtgcatttaatgggctaaacttggcttgtgcatattctatacagtaaaaaaaaaaa

SEQ ID NO: 103688 - DNA, 508 bp, Homo sapiens
  Payload ID: 381
  Gene Symbol: ACAT1
  Gene Name: acetyl-CoA acetyltransferase 1
  ENST ID: ENST00000528370
  CDS Start-End: 1-409
taagcttggttccattgcaattcagggagccattgaaaaggcagggattccaaaagaagaagtgaaagaagcatacatgggtaatgttctacaaggaggtgaaggacaagctcctacaaggcaggcagtattgggtgcaggcttacctatttctactccatgtaccaccataaacaaagtttgtgcttcaggaatgaaagccatcatgatggcctctcaaagtcttatgtgtggacatcaggatgtgatggtggcaggtgggatggagagcatgtccaatgttccatatgtaatgaacagaggatcaacaccatatggtggggtaaagcttgaagatttgattgtaaaagacgggctaactgatgtctacaataaaattcatatggtaaatgtgatttttagtggataaatgctatctaatgtccaatactgtttgatttttcttactctatgtactttacaaactgaactgaaagatgggctctataaatgttgattttagccgtgt

SEQ ID NO: 103689 - DNA, 3180 bp, Homo sapiens
  Payload ID: 382
  Gene Symbol: ACAT2
  Gene Name: acetyl-CoA acetyltransferase 2
  Uniprot ID: Q9BWD1
  ENST ID: ENST00000367048
  CDS Start-End: 1761-2954
ggtgtgatctcggctcactgaaacctctgcctcctaggttcaagcgattttcccatgtcagcctccccagtagctgggattacaggcgcacggcaccacgcccggctaatttttctattttatggtagaaacgggatatcaccatgttggccaggctggtgtcaaactgctgacctcaaatgatccgccctcctcggcctcccaaagtgctgggattacaggtgtgagccaaggtgcccgacctgatgtgcttgtaagaatttaaatgaagagggtcagtcagcttaggagacgaggttagatgtaaggatttcagacttgtcagtatacaggtggtgattgatgccgtaggaatgactggtattacccagggagctggtgcaaagtaggagccttggggaacatgttaaggggatgtgagagtaagcccacaaagactcagaagtggccagggagtaaggggaaaatgggatagaatagagcaaaagccacgggaggcattccttgaattccttggactcagatatgttaggggacaggaaacacattgaagacaactgaagagacttcagtgtgctgctgagttcttagcagagtagacagctgatttcaccactattccagaccctaaagatttctcctgaaattgcactgttatgcaatttttttccttctctattgccccacctctggggcctacactctttaccttctctgatttatctgacccatccgcatatctctgcaaagtcttaatgtaggtttccaggatttaatgattctttcaatcaactttaaagttcttcaggaagattctccaggtccgtcaacagttttccccttcatgactttgtgacaaagctttcttgttccactatccaggtgttcccaacaagttgctgtaacggtggcccctcataagcttgcctggaaaccctagaaagctcagaaaaattatgaactttgcccagtaagaggctgggaagtcagaaagggttttaaacaaaactgaccccacttgttacatgctcctttcactgtccaaacgtcaaccaaaggaacttttgtgacgctaagacgctcccggcgtcctcacccgttcacagccagagttgatcttagaaggcagggggctcgcaccgagacgctcctagcaagcccctcacgcgagcgaatgactggcgccaggagaaacgcataggacctcccgaagccgccgagagcaaaaggacccatcagagctgtgctgagacccgccgcgggccgggctcgcactcgagattctcgcccgtgggattccagtcctgagctgaacgagagataagtctttgtcaccccccagtctttactgtttcgagaaaccctaagattttttaaaaaaaagcccaagacgtcaagtcggggaactccaacattggggtgtccagaaacactggggtttcaggcgctctgtaaatgcgtccgaggtccgcggttctgcccgcaagcccagaccccggcctcacttccgccccgcgccccgcgccccggcctcacttccgccccgcgccccgcgccccgcgccccgcgcgcctccgcccgcccctgctccggccttgcgcctgcgcacagtgggatgcgcggggaggtggtgcgcggggaggtggagggcgaggggcggggctacctcaggtcccgcccgcggcaggcctgtgggctgcgaggaggagctttgcctagcttgcaggcagcgcagggcagacggcggcaggagaagcaagatgaatgcaggctcagatcctgtggtcatcgtctcggcggcgcggaccatcataggttccttcaatggtgccttagctgctgttcctgtccaggacctgggctccactgtcatcaaagaagtcttgaagagggccactgtggctccggaagatgtgtctgaggtcatctttggacatgtcttggcagcaggctgtgggcagaatcctgttagacaagccagtgtgggtgcaggaattccctactctgttccagcatggagctgccagatgatctgtgggtcaggcctaaaagctgtgtgccttgcagtccagtcaatagggataggagactccagcattgtggttgcaggaggcatggaaaatatgagcaaggctcctcacttggcttacttgagaacaggagtaaagataggtgagatgccactgactgacagtatactctgtgatggtcttacagatgcatttcacaactgtcatatgggtattacagctgaaaatgtagccaaaaaatggcaagtgagtagagaagatcaggacaaggttgcagttctgtcccagaacaggacagagaatgcacagaaagctggccattttgacaaagagattgtaccagttttggtgtcaactagaaaaggtcttattgaagttaaaacagatgagtttcctcgccatgggagcaacatagaagccatgtccaagctaaagccttactttcttactgatggaacgggaacagtcaccccagccaatgcttcaggaataaatgatggtgctgcagctgtcgttcttatgaagaagtcagaagctgataaacgtgggcttacacctttagcacggatagtttcctggtcccaagtgggtgtggagccttccattatgggaataggaccaattccagccataaagcaagctgttacaaaagcaggttggtcactggaagatgttgacatatttgaaatcaatgaagcctttgcagctgtctctgctgcaatagttaaagaacttggattaaacccagagaaggtcaatattgaaggaggggctatagccttgggccaccctcttggagcatctggctgtcgaattcttgtgaccctgttacacacactggagagaatgggcagaagtcgtggtgttgcagccctgtgcattgggggtgggatgggaatagcaatgtgtgttcagagagaatgaattgcttaaactttgaacaacctcaatttctttttaaactaataaagtactaggttgcaatatgtgaaatcagaggaccaaagtacagatggaaaccatttcctacatcacaaaaacccaagtttacagcttgtactttactttaatgtgtaatactcaactcaaggtacaagacaattgcatttaacattgttataaataaaaggaacatcagatcaatcattaa

SEQ ID NO: 103690 - DNA, 1540 bp, Homo sapiens
  Payload ID: 383
  Gene Symbol: ACAA1
  Gene Name: acetyl-CoA acyltransferase 1
  Uniprot ID: P09110
  ENST ID: ENST00000301810
  CDS Start-End: 208-1203
gggttcccaggccgactctccttgtggttggctgaggctggaggtggacgggacttttggagggtcgctcgcgtctgttcgcagagctgtgggcggagttgaggccttggaggctgagatgtggttctgcgcgtgtgcggacggctgtctgttaactccgcggtcagttcccggactggtggctggtctgcagggttgacctgcgcaatgcagaggctgcaggtagtgctgggccacctgaggggtccggccgattccggctggatgccgcaggccgcgccttgcctgagcggtgccccgcaggcctcggccgcggacgtggtggtggtgcacgggcggcgcacggccatctgccgggcgggccgcggcggcttcaaggacaccacccccgacgagcttctctcggcagtcatgaccgcggttctcaaggacgtgaatctgaggccggaacagctgggggacatctgtgtcggaaatgtgctgcagcctggggccggggcaatcatggcccgaatcgcccagtttctgagtgacatcccggagactgtgcctttgtccactgtcaatagacagtgttcgtcggggctacaggcagtggccagcatagcaggtggcatcagaaatgggtcttatgacattggcatggcctgtgggataacctctgagaatgtggctgagcggtttggcatttcacgggagaagcaggatacctttgccctggcttcccagcagaaggcagcaagagcccagagcaagggctgtttccaagctgagattgtgcctgtgaccaccacggtccatgatgacaagggcaccaagaggagcatcactgtgacccaggatgagggtatccgccccagcaccaccatggagggcctggccaaactgaagcctgccttcaagaaagatggttctaccacagctgggctgacagtgagtgacgtggacatcttcgagatcaatgaggcctttgcaagccaggctgcctactgtgtggagaagctacgactcccccctgagaaggtgaaccccctggggggtgcagtggccttagggcacccactgggctgcactggggcacgacaggtcatcacgctgctcaatgagctgaagcgccgtgggaagagggcatacggagtggtgtccatgtgcatcgggactggaatgggagccgctgccgtctttgaataccctgggaactgagtgaggtcccaggctggaggcgctacgcagacagtcctgctgctctagcagcaaggcagtaacaccacaaaagcaaaaccacatgggaaaactcagcactggtggtggtggcagtggacagatcaaggcacttcaactcatttggaaaatgtgaacactgatgacatggtataggagtgggtggggtgttgagccacccatcagaccctctttagctgtgcaagataaaagcagcctgggtcacccaggccacaaggccatggttaattcttaaggcaaggcaaatccatggatgagaagtgcaatgggcatagtaaaagtgcatgaatttatctta

SEQ ID NO: 103691 - DNA, 1785 bp, Homo sapiens
  Payload ID: 383
  Gene Symbol: ACAA1
  Gene Name: acetyl-CoA acyltransferase 1
  Uniprot ID: P09110
  ENST ID: ENST00000333167
  CDS Start-End: 174-1448
aggctggaggtggacgggacttttggagggtcgctcgcgtctgttcgcagagctgtgggcggagttgaggccttggaggctgagatgtggttctgcgcgtgtgcggacggctgtctgttaactccgcggtcagttcccggactggtggctggtctgcagggttgacctgcgcaatgcagaggctgcaggtagtgctgggccacctgaggggtccggccgattccggctggatgccgcaggccgcgccttgcctgagcggtgccccgcaggcctcggccgcggacgtggtggtggtgcacgggcggcgcacggccatctgccgggcgggccgcggcggcttcaaggacaccacccccgacgagcttctctcggcagtcatgaccgcggttctcaaggacgtgaatctgaggccggaacagctgggggacatctgtgtcggaaatgtgctgcagcctggggccggggcaatcatggcccgaatcgcccagtttctgagtgacatcccggagactgtgcctttgtccactgtcaatagacagtgttcgtcggggctacaggcagtggccagcatagcaggtggcatcagaaatgggtcttatgacattggcatggcctgtggggtggagtccatgtccctggctgacagagggaaccctggaaatattacttcgcgcttgatggagaaggagaaggccagagattgcctgattcctatggggataacctctgagaatgtggctgagcggtttggcatttcacgggagaagcaggatacctttgccctggcttcccagcagaaggcagcaagagcccagagcaagggctgtttccaagctgagattgtgcctgtgaccaccacggtccatgatgacaagggcaccaagaggagcatcactgtgacccaggatgagggtatccgccccagcaccaccatggagggcctggccaaactgaagcctgccttcaagaaagatggttctaccacagctggaaactctagccaggtgagtgatggggcagctgccatcctgctggcccggaggtccaaggcagaagagttgggccttcccatccttggggtcctgaggtcttatgcagtggttggggtcccacctgacatcatgggcattggacctgcctatgccatcccagtagctttgcaaaaagcagggctgacagtgagtgacgtggacatcttcgagatcaatgaggcctttgcaagccaggctgcctactgtgtggagaagctacgactcccccctgagaaggtgaaccccctggggggtgcagtggccttagggcacccactgggctgcactggggcacgacaggtcatcacgctgctcaatgagctgaagcgccgtgggaagagggcatacggagtggtgtccatgtgcatcgggactggaatgggagccgctgccgtctttgaataccctgggaactgagtgaggtcccaggctggaggcgctacgcagacagtcctgctgctctagcagcaaggcagtaacaccacaaaagcaaaaccacatgggaaaactcagcactggtggtggtggcagtggacagatcaaggcacttcaactcatttggaaaatgtgaacactgatgacatggtataggagtgggtggggtgttgagccacccatcagaccctctttagctgtgcaagataaaagcagcctgggtcacccaggccacaaggccatggttaattcttaaggcaaggcaaatccatggatgagaagtgcaatgggcatagtaaaagtgcatgaatttatctta

SEQ ID NO: 103692 - DNA, 1328 bp, Homo sapiens
  Payload ID: 383
  Gene Symbol: ACAA1
  Gene Name: acetyl-CoA acyltransferase 1
  ENST ID: ENST00000440176
  CDS Start-End: 62-427
gtctgttaactccgcggtcagttcccggactggtggctggtctgcagggttgacctgcgcaatgcagaggctgcaggtagtgctgggccacctgaggggtccggccgattccggctggatgccgcaggccgcgccttgcctgagcggtgccccgcaggcctcggccgcggacgtggtggtggtgcacgggcggcgcacggccatctgccgggcgggccgcggcggcttcaaggacaccacccccgacgagcttctctcggcagtcatgaccgcggttctcaaggacgtgaatctgaggccggaacagctgggggacatctgtgtcgatcaacatggagtttcttatgtcttccttttctacatacacacggaaatgtgctgcagcctggggccggggcaatcatggcccgaatcgcccagtttctgagtgacatcccggagactgtgcctttgtccactgtcaatagacagtgttcgtcggggctacaggcagtggccagcatagcagggtggagtccatgtccctggctgacagagggaaccctggaaatattacttcgcgcttgatggagaaggagaaggccagagattgcctgattcctatggggataacctctgagaatgtggctgagcggtttggcatttcacgggagaagcaggatacctttgccctggcttcccagcagaaggcagcaagagcccagagcaagggctgtttccaagctgagattgtgcctgtgaccaccacggtccatgatgacaagggcaccaagaggagcatcactgtgacccaggatgagggtatccgccccagcaccaccatggagggcctggccaaactgaagcctgccttcaagaaagatggttctaccacagctggtgagactggtccggggtaggggtatgagaaagcaggccatggccatgctgggtgctgtactctgggaacctggaatagaccaggcccctctgcaaagtagaagtgggagggctgggatctcctcatccccaccccgatgccttcttaccccaacagtttgcccctaggaaactctagccaggtgagtgatggggcagctgccatcctgctggcccggaggtccaaggcagaagagttgggccttcccatccttggggtcctgaggtcttatgcagtggttggggtcccacctgacatcatgggcattggacctgcctatgccatcccagtagctttgcaaaaagcaggtaaggtggctccttcatatagtatctgggtcccacctggatcctgcagctgccctgcatgctgttgccaggggcatgagggtggtcctgtgggtgctgca

SEQ ID NO: 103693 - DNA, 927 bp, Homo sapiens
  Payload ID: 383
  Gene Symbol: ACAA1
  Gene Name: acetyl-CoA acyltransferase 1
  ENST ID: ENST00000452171
  CDS Start-End: 1-713
aggcagtggccagcatagcaggtggcatcagaaatgggtcttatgacattggcatggcctgtggggtggagtccatgtccctggctgacagagggaaccctggaaatattacttcgcgcttgatggagaaggagaaggccagagattgcctgattcctatggggataacctctgagaatgtggctgagcggtttggcatttcacgggagaagcaggatacctttgccctggcttcccagcagaaggcagcaagagcccagagcaagggctgtttccaagctgagattgtgcctgtgaccaccacggtccatgatgacaagggcaccaagaggagcatcactgtgacccaggatgagggtatccgccccagcaccaccatggagggcctggccaaactgaagcctgccttcaagaaagatggttctaccacagctgggctgacagtgagtgacgtggacatcttcgagatcaatgaggcctttgcaagccaggctgcctactgtgtggagaagctacgactcccccctgagaaggtgaaccccctggggggtgcagtggccttagggcacccactgggctgcactggggcacgacaggtcatcacgctgctcaatgagctgaagcgccgtgggaagagggcatacggagtggtgtccatgtgcatcgggactggaatgggagccgctgccgtctttgaataccctgggaactgagtgaggtcccaggctggaggcgctacgcagacagtcctgctgctctagcagcaaggcagtaacaccacaaaagcaaaaccacatgggaaaactcagcactggtggtggtggcagtggacagatcaaggcacttcaactcatttggaaaatgtgaacactgatgacatggtataggagtgggtggggtgttgagccacccatcagaccctcttta

SEQ ID NO: 103694 - DNA, 1570 bp, Homo sapiens
  Payload ID: 383
  Gene Symbol: ACAA1
  Gene Name: acetyl-CoA acyltransferase 1
  ENST ID: ENST00000450296
  CDS Start-End: 91-1242
gatgtggttctgcgcgtgtgcggacggctgtctgttaactccgcggtcagttcccggactggtggctggtctgcagggttgacctgcgcaatgcagaggctgcaggtagtgctgggccacctgaggggtccggccgattccggctggatgccgcaggccgcgccttgcctgagcggtgccccgcaggcctcggccgcggacgtggtggtggtgcacgggcggcgcacggccatctgccgggcgggccgcggcggcttcaaggacaccacccccgacgagcttctctcggcagtcatgaccgcggttctcaaggacgtgaatctgaggccggaacagctgggggacatctgtgtcggaaatgtgctgcagcctggggccggggcaatcatggcccgaatcgcccagtttctgagggtggagtccatgtccctggctgacagagggaaccctggaaatattacttcgcgcttgatggagaaggagaaggccagagattgcctgattcctatggggataacctctgagaatgtggctgagcggtttggcatttcacgggagaagcaggatacctttgccctggcttcccagcagaaggcagcaagagcccagagcaagggctgtttccaagctgagattgtgcctgtgaccaccacggtccatgatgacaagggcaccaagaggagcatcactgtgacccaggatgagggtatccgccccagcaccaccatggagggcctggccaaactgaagcctgccttcaagaaagatggttctaccacagctggaaactctagccaggtgagtgatggggcagctgccatcctgctggcccggaggtccaaggcagaagagttgggccttcccatccttggggtcctgaggtcttatgcagtggttggggtcccacctgacatcatgggcattggacctgcctatgccatcccagtagctttgcaaaaagcagggctgacagtgagtgacgtggacatcttcgagatcaatgaggcctttgcaagccaggctgcctactgtgtggagaagctacgactcccccctgagaaggtgaaccccctggggggtgcagtggccttagggcacccactgggctgcactggggcacgacaggtcatcacgctgctcaatgagctgaagcgccgtgggaagagggcatacggagtggtgtccatgtgcatcgggactggaatgggagccgctgccgtctttgaataccctgggaactgagtgaggtcccaggctggaggcgctacgcagacagtcctgctgctctagcagcaaggcagtaacaccacaaaagcaaaaccacatgggaaaactcagcactggtggtggtggcagtggacagatcaaggcacttcaactcatttggaaaatgtgaacactgatgacatggtataggagtgggtggggtgttgagccacccatcagaccctctttagctgtgcaagataaaagcagcctgggtcacccaggccacaaggccatggttaattcttaaggcaaggcaaatccatggatgagaagtgcaatgggcatagtaaaagtgcatgaa

SEQ ID NO: 103695 - DNA, 877 bp, Homo sapiens
  Payload ID: 383
  Gene Symbol: ACAA1
  Gene Name: acetyl-CoA acyltransferase 1
  ENST ID: ENST00000423611
  CDS Start-End: 103-444
cttggaggctgagatgtggttctgcgcgtgtgcggacggctgtctgttaactccgcggtcagttcccggactggtggctggtctgcagggttgacctgcgcaatgcagaggctgcaggtagtgctgggccacctgaggggtccggccgattccggctggatgccgcaggccgcgccttgcctgagcggtgccccgcaggcctcggccgcggacgtggtggtggtgcacgggcggcgcacggccatctgccgggcgggccgcggcggcttcaaggacaccacccccgacgagcttctctcggcagtcatgaccgcggttctcaaggacgtgaatctgaggccggaacagctgggggacatctgtgtcgtgacatcccggagactgtgcctttgtccactgtcaatagacagtgttcgtcggggctacaggcagtggccagcatagcagggtggagtccatgtccctggctgacagagggaaccctggaaatattacttcgcgcttgatggagaaggagaaggccagagattgcctgattcctatggggataacctctgagaatgtggctgagcggtttggcatttcacgggagaagcaggatacctttgccctggcttcccagcagaaggcagcaagagcccagagcaagggctgtttccaagctgagattgtgcctgtgaccaccacggtccatgatgacaagggcaccaagaggagcatcactgtgacccaggatgagggtatccgccccagcaccaccatggagggcctggccaaactgaagcctgccttcaagaaagatggttctaccacagctggtgagactggtccggggtaggggtatgagaaagcaggccatggccatgctgggtgctgt

SEQ ID NO: 103696 - DNA, 869 bp, Homo sapiens
  Payload ID: 383
  Gene Symbol: ACAA1
  Gene Name: acetyl-CoA acyltransferase 1
  ENST ID: ENST00000421218
  CDS Start-End: 1-869
tgaggccggaacagctgggggacatctgtgtcggaaatgtgctgcagcctggggccggggcaatcatggcccgaatcgcccagtttctgagtgacatcccggagactgtgcctttgtccactgtcaatagacagtgttcgtcggggctacaggcagtggccagcatagcaggtggcatcagaaatgggtcttatgacattggcatggcctgtgggataacctctgagaatgtggctgagcggtttggcatttcacgggagaagcaggatacctttgccctggcttcccagcagaaggcagcaagagcccagagcaagggctgtttccaagctgagattgtgcctgtgaccaccacggtccatgatgacaagggcaccaagaggagcatcactgtgacccaggatgagggtatccgccccagcaccaccatggagggcctggccaaactgaagcctgccttcaagaaagatggttctaccacagctggaaactctagccaggtgagtgatggggcagctgccatcctgctggcccggaggtccaaggcagaagagttgggccttcccatccttggggtcctgaggtcttatgcagtggttggggtcccacctgacatcatgggcattggacctgcctatgccatcccagtagctttgcaaaaagcagggctgacagtgagtgacgtggacatcttcgagatcaatgaggcctttgcaagccaggctgcctactgtgtggagaagctacgactcccccctgagaaggtgaaccccctggggggtgcagtggccttagggcacccactgggctgcactggggcacgacaggtcatcacgctgctcaatgagctgaagcgccgtgggaagagg

SEQ ID NO: 103697 - DNA, 737 bp, Homo sapiens
  Payload ID: 383
  Gene Symbol: ACAA1
  Gene Name: acetyl-CoA acyltransferase 1
  ENST ID: ENST00000418880
  CDS Start-End: 58-399
gttaactccgcggtcagttcccggactggtggctggtctgcagggttgacctgcgcaatgcagaggctgcaggtagtgctgggccacctgaggggtccggccgattccggctggatgccgcaggccgcgccttgcctgagcggtgccccgcaggcctcggccgcggacgtggtggtggtgcacgggcggcgcacggccatctgccgggcgggccgcggcggcttcaaggacaccacccccgacgagcttctctcggcagtcatgaccgcggttctcaaggacgtgaatctgaggccggaacagctgggggacatctgtgtcgtgacatcccggagactgtgcctttgtccactgtcaatagacagtgttcgtcggggctacaggcagtggccagcatagcagggtggagtccatgtccctggctgacagagggaaccctggaaatattacttcgcgcttgatggagaaggagaaggccagagattgcctgattcctatggggataacctctgagaatgtggctgagcggtttggcatttcacgggagaagcaggatacctttgccctggcttcccagcagaagtgagtgctgattggggaggaatgtttaaagggctggagagtgaggttttgagtctatctaagtggtctgaagtggcaccatttcgtggttactgctgggcagtgagtgctttccaggccttgtgccacccaggttgggggtgggaagtaggaag

SEQ ID NO: 103698 - DNA, 915 bp, Homo sapiens
  Payload ID: 383
  Gene Symbol: ACAA1
  Gene Name: acetyl-CoA acyltransferase 1
  ENST ID: ENST00000447223
  CDS Start-End: 38-403
ccggactggtggctggtctgcagggttgacctgcgcaatgcagaggctgcaggtagtgctgggccacctgaggggtccggccgattccggctggatgccgcaggccgcgccttgcctgagcggtgccccgcaggcctcggccgcggacgtggtggtggtgcacgggcggcgcacggccatctgccgggcgggccgcggcggcttcaaggacaccacccccgacgagcttctctcggcagtcatgaccgcggttctcaaggacgtgaatctgaggccggaacagctgggggacatctgtgtcgatcaacatggagtttcttatgtcttccttttctacatacacacggaaatgtgctgcagcctggggccggggcaatcatggcccgaatcgcccagtttctgagtgacatcccggagactgtgcctttgtccactgtcaatagacagtgttcgtcggggctacaggcagtggccagcatagcaggtggcatcagaaatgggtcttatgacattggcatggcctgtggggtggagtccatgtccctggctgacagagggaaccctggaaatattacttcgcgcttgatggagaaggagaaggccagagattgcctgattcctatggggataacctctgagaatgtggctgagcggtttggcatttcacgggagaagcaggatacctttgccctggcttcccagcagaaggcagcaagagcccagagcaagggctgtttccaagctgagattgtgcctgtgaccaccacggtccatgatgacaagggcaccaagaggagcatcactgtgacccaggatgagggtatccgccccagcaccaccatggagggcctggccaaactgaagcctgccttcaagaaagatggttctaccacagctggtgagactggtccgggg

SEQ ID NO: 103699 - DNA, 1944 bp, Homo sapiens
  Payload ID: 383
  Gene Symbol: ACAA1
  Gene Name: acetyl-CoA acyltransferase 1
  ENST ID: ENST00000411549
  CDS Start-End: 208-669
gggttcccaggccgactctccttgtggttggctgaggctggaggtggacgggacttttggagggtcgctcgcgtctgttcgcagagctgtgggcggagttgaggccttggaggctgagatgtggttctgcgcgtgtgcggacggctgtctgttaactccgcggtcagttcccggactggtggctggtctgcagggttgacctgcgcaatgcagaggctgcaggtagtgctgggccacctgaggggtccggccgattccggctggatgccgcaggccgcgccttgcctgagcggtgccccgcaggcctcggccgcggacgtggtggtggtgcacgggcggcgcacggccatctgccgggcgggccgcggcggcttcaaggacaccacccccgacgagcttctctcggcagtcatgaccgcggttctcaaggacgtgaatctgaggccggaacagctgggggacatctgtgtcggaaatgtgctgcagcctggggccggggcaatcatggcccgaatcgcccagtttctgagtgacatcccggagactgtgcctttgtccactgtcaatagacagtgttcgtcggggctacaggcagtggccagcatagcagggtggagtccatgtccctggctgacagagggaaccctggaaatattacttcgcgcttgatggagaaggagaaggccagagattgcctgattcctatggggataacctctgagaatgtggctgagcggtttggcatttcacgggagaagcaggatacctttgccctggcttcccagcagaaggcagcaagagcccagagcaagggctgtttccaagctgagattgtgcctgtgaccaccacggtccatgatgacaagggcaccaagaggagcatcactgtgacccaggatgagggtatccgccccagcaccaccatggagggcctggccaaactgaagcctgccttcaagaaagatggttctaccacagctggtgagactggtccggggtaggggtatgagaaagcaggccatggccatgctgggtgctgtactctgggaacctggaatagaccaggcccctctgcaaagtagaagtgggagggctgggatctcctcatccccaccccgatgccttcttaccccaacagtttgcccctaggaaactctagccaggtgagtgatggggcagctgccatcctgctggcccggaggtccaaggcagaagagttgggccttcccatccttggggtcctgaggtcttatgcagtggttggggtcccacctgacatcatgggcattggacctgcctatgccatcccagtagctttgcaaaaagcagggctgacagtgagtgacgtggacatcttcgagatcaatgaggcctttgcaagccaggctgcctactgtgtggagaagctacgactcccccctgagaaggtgaaccccctggggggtgcagtggccttagggcacccactgggctgcactggggcacgacaggtcatcacgctgctcaatgagctgaagcgccgtgggaagagggcatacggagtggtgtccatgtgcatcgggactggaatgggagccgctgccgtctttgaataccctgggaactgagtgaggtcccaggctggaggcgctacgcagacagtcctgctgctctagcagcaaggcagtaacaccacaaaagcaaaaccacatgggaaaactcagcactggtggtggtggcagtggacagatcaaggcacttcaactcatttggaaaatgtgaacactgatgacatggtataggagtgggtggggtgttgagccacccatcagaccctctttagctgtgcaagataaaagcagcctgggtcacccaggccacaaggccatggttaattcttaaggcaaggcaaatccatggatgagaagtgcaatgggcatagtaaaagtgcatgaatttatctta

SEQ ID NO: 103700 - DNA, 1760 bp, Homo sapiens
  Payload ID: 383
  Gene Symbol: ACAA1
  Gene Name: acetyl-CoA acyltransferase 1
  ENST ID: ENST00000625927
  CDS Start-End: 208-549
gggttcccaggccgactctccttgtggttggctgaggctggaggtggacgggacttttggagggtcgctcgcgtctgttcgcagagctgtgggcggagttgaggccttggaggctgagatgtggttctgcgcgtgtgcggacggctgtctgttaactccgcggtcagttcccggactggtggctggtctgcagggttgacctgcgcaatgcagaggctgcaggtagtgctgggccacctgaggggtccggccgattccggctggatgccgcaggccgcgccttgcctgagcggtgccccgcaggcctcggccgcggacgtggtggtggtgcacgggcggcgcacggccatctgccgggcgggccgcggcggcttcaaggacaccacccccgacgagcttctctcggcagtcatgaccgcggttctcaaggacgtgaatctgaggccggaacagctgggggacatctgtgtcgtgacatcccggagactgtgcctttgtccactgtcaatagacagtgttcgtcggggctacaggcagtggccagcatagcaggtggcatcagaaatgggtcttatgacattggcatggcctgtggggtggagtccatgtccctggctgacagagggaaccctggaaatattacttcgcgcttgatggagaaggagaaggccagagattgcctgattcctatggggataacctctgagaatgtggctgagcggtttggcatttcacgggagaagcaggatacctttgccctggcttcccagcagaaggcagcaagagcccagagcaagggctgtttccaagctgagattgtgcctgtgaccaccacggtccatgatgacaagggcaccaagaggagcatcactgtgacccaggatgagggtatccgccccagcaccaccatggagggcctggccaaactgaagcctgccttcaagaaagatggttctaccacagctggaaactctagccaggtgagtgatggggcagctgccatcctgctggcccggaggtccaaggcagaagagttgggccttcccatccttggggtcctgaggtcttatgcagtggttggggtcccacctgacatcatgggcattggacctgcctatgccatcccagtagctttgcaaaaagcagggctgacagtgagtgacgtggacatcttcgagatcaatgaggcctttgcaagccaggctgcctactgtgtggagaagctacgactcccccctgagaaggtgaaccccctggggggtgcagtggccttagggcacccactgggctgcactggggcacgacaggtcatcacgctgctcaatgagctgaagcgccgtgggaagagggcatacggagtggtgtccatgtgcatcgggactggaatgggagccgctgccgtctttgaataccctgggaactgagtgaggtcccaggctggaggcgctacgcagacagtcctgctgctctagcagcaaggcagtaacaccacaaaagcaaaaccacatgggaaaactcagcactggtggtggtggcagtggacagatcaaggcacttcaactcatttggaaaatgtgaacactgatgacatggtataggagtgggtggggtgttgagccacccatcagaccctctttagctgtgcaagataaaagcagcctgggtcacccaggccacaaggccatggttaattcttaaggcaaggcaaatccatggatgagaagtgcaatgggcatagtaaaagtgcatgaatttatctt

SEQ ID NO: 103701 - DNA, 1862 bp, Homo sapiens
  Payload ID: 383
  Gene Symbol: ACAA1
  Gene Name: acetyl-CoA acyltransferase 1
  ENST ID: ENST00000627515
  CDS Start-End: 208-573
gggttcccaggccgactctccttgtggttggctgaggctggaggtggacgggacttttggagggtcgctcgcgtctgttcgcagagctgtgggcggagttgaggccttggaggctgagatgtggttctgcgcgtgtgcggacggctgtctgttaactccgcggtcagttcccggactggtggctggtctgcagggttgacctgcgcaatgcagaggctgcaggtagtgctgggccacctgaggggtccggccgattccggctggatgccgcaggccgcgccttgcctgagcggtgccccgcaggcctcggccgcggacgtggtggtggtgcacgggcggcgcacggccatctgccgggcgggccgcggcggcttcaaggacaccacccccgacgagcttctctcggcagtcatgaccgcggttctcaaggacgtgaatctgaggccggaacagctgggggacatctgtgtcgatcaacatggagtttcttatgtcttccttttctacatacacacggaaatgtgctgcagcctggggccggggcaatcatggcccgaatcgcccagtttctgagtgacatcccggagactgtgcctttgtccactgtcaatagacagtgttcgtcggggctacaggcagtggccagcatagcaggtggcatcagaaatgggtcttatgacattggcatggcctgtggggtggagtccatgtccctggctgacagagggaaccctggaaatattacttcgcgcttgatggagaaggagaaggccagagattgcctgattcctatggggataacctctgagaatgtggctgagcggtttggcatttcacgggagaagcaggatacctttgccctggcttcccagcagaaggcagcaagagcccagagcaagggctgtttccaagctgagattgtgcctgtgaccaccacggtccatgatgacaagggcaccaagaggagcatcactgtgacccaggatgagggtatccgccccagcaccaccatggagggcctggccaaactgaagcctgccttcaagaaagatggttctaccacagctggaaactctagccaggtgagtgatggggcagctgccatcctgctggcccggaggtccaaggcagaagagttgggccttcccatccttggggtcctgaggtcttatgcagtggttggggtcccacctgacatcatgggcattggacctgcctatgccatcccagtagctttgcaaaaagcagggctgacagtgagtgacgtggacatcttcgagatcaatgaggcctttgcaagccaggctgcctactgtgtggagaagctacgactcccccctgagaaggtgaaccccctggggggtgcagtggccttagggcacccactgggctgcactggggcacgacaggtcatcacgctgctcaatgagctgaagcgccgtgggaagagggcatacggagtggtgtccatgtgcatcgggactggaatgggagccgctgccgtctttgaataccctgggaactgagtgaggtcccaggctggaggcgctacgcagacagtcctgctgctctagcagcaaggcagtaacaccacaaaagcaaaaccacatgggaaaactcagcactggtggtggtggcagtggacagatcaaggcacttcaactcatttggaaaatgtgaacactgatgacatggtataggagtgggtggggtgttgagccacccatcagaccctctttagctgtgcaagataaaagcagcctgggtcacccaggccacaaggccatggttaattcttaaggcaaggcaaatccatggatgagaagtgcaatgggcatagtaaaagtgcatgaatttatctt

SEQ ID NO: 103702 - DNA, 3350 bp, Homo sapiens
  Payload ID: 384
  Gene Symbol: ACAA2
  Gene Name: acetyl-CoA acyltransferase 2
  Uniprot ID: P42765
  ENST ID: ENST00000285093
  CDS Start-End: 477-1670
acaggacgttcggtcccgcccccagctggcggccgcggccgcccgcgcgccaagttcctcagcccttggctcctgcccagtgtttagggtgttggcggagacaaaggggaagagtcatcgcctgtcggggctaggatatgatgggtgagaggtgtcaaaccaaattctctcggtttggaaacggagaaaatctaaaaatgaggatgtgaggaaagagtccgctctcaaggcgcgttgtggtctatccgagccccgtcccctgggctccctcgggctggggtgaggcgggcagcgctacgcgtggggtaggaccatcttacgctgggaccccgccaaggagccccaggaagtaggtgaaagggcaggggcgtggctctcggggcgccacccacgctcttgaaatctgggtgattgcgagcggccgctcagcgtcccccacaccacagacccgcgccgccgacgacccagcagccgccatggctctgctccgaggtgtgtttgtagttgctgctaagcgaacgccctttggagcttacggaggccttctgaaagacttcactgctactgacttgtctgaatttgctgccaaggctgccttgtctgctggcaaagtctcacctgaaacagttgacagtgtgattatgggcaatgtcctgcagagttcttcagatgctatatatttggcaaggcatgttggtttgcgtgtgggaatcccaaaggagaccccagctctcacgattaataggctctgtggttctggttttcagtccattgtgaatggatgtcaggaaatttgtgttaaagaagctgaagttgttttatgtggaggaaccgaaagcatgagccaagctccctactgtgtcagaaatgtgcgttttggaaccaagcttggatcagatatcaagctggaagattctttatgggtatcattaacagatcagcatgtccagctccccatggcaatgactgcagagaatcttgctgtaaaacacaaaataagcagagaagaatgtgacaaatatgccctgcagtcacagcagagatggaaagctgctaatgatgctggctactttaatgatgaaatggcaccaattgaagtgaagacaaagaaaggaaaacagacaatgcaggtagacgagcatgctcggccccaaaccaccctggaacagttacagaaacttcctccagtattcaagaaagatggaactgttactgcagggaatgcatcgggtgtagctgatggtgctggagctgttatcatagctagtgaagatgctgttaagaaacataacttcacaccactggcaagaattgtgggctactttgtatctggatgtgatccctctatcatgggtattggtcctgtccctgctatcagtggggcactgaagaaagcaggactgagtcttaaggacatggatttggtagaggtgaatgaagcttttgctccccagtacttggctgttgagaggagtttggatcttgacataagtaaaaccaatgtgaatggaggagccattgctttgggtcacccactgggaggatctggatcaagaattactgcacacctggttcacgaattaaggcgtcgaggtggaaaatatgccgttggatcagcttgcattggaggtggccaaggtattgctgtcatcattcagagcacagcctgaagagaccagtgagctcactgtgacccatccttactctacttggccaggccacagtaaaacaagtgaccttcagagcagctgccacaactggccatgccctgccattgaaacagtgattaagtttgatcaagccatggtgacacaaaaatgcattgatcatgaataggagcccatgctagaagtacattctctcagatttgaaccagtgaaatatgatgtatttctgagctaaaactcaactatagaagacattaaaagaaatcgtattcttgccaagtaaccaccacttctgccttagataatatgattataaggaaatcaaataaatgttgccttaacttcagttaatattttcctgtcatttatatttttaaaaattttaaattgtgataagatacacattacataaactttaccatcttaacccttttttagcgtacaattcactggtattaagtacattcacatttttatacaaacatccccactttttatcaacagaactttttcagtcaccacacatggaaacaataactcctgattctcccatcccccatcccctgacaaccaccagtgtattttgtttctataaatttgatgactcgaggtacctcataagtgaaattataaatatctgtcctttcgtgactggcttattttactttactttatataatgttctcaagattcatccaccttatggtgtagcatgtgtcagaatttccttctttttaaaggctgaataatattctgctgtgtgtataaaccttacttccttcttcccagcttaaaggccatctttcatcctttattttctccctttaaaatgcccccacaacacttccattgctttatttgtctgttctaagactggatatctagtagggcaaggccctattcttgttaacttcatcaaagagccactggaaattttaattaagattaaattgaatttatgggttatacatttattggggggaaatttttttttttttttttgagacagagtctcgctctgtcctccaggctggagtgcagtggcgcgatctcagcttactgcaagctccgcctcctgggttcatgccattctcctgcctcagcctccccagtagctgggactacaggcgcctgccactacgcccggctaattttttgtatttttagtagagatggggtttcaccgtgttagccaggatggtctcgatctcctgacctcgtgatccacccgcctcggcctcccaaagaagtgctgggattacaggcgtgagccactgcacccggccttttttttttttttttgagatagcatcttgctctgtcacccaggcagaattgcagtggcacagtcatggctcactgaataatagatgttaaataatactagatgttaaataatagtatcataagtacctacactgtttcctcaaccctttgcttatatggtttccttcatttgattaaaaagctgaagtggcacatacatccccctttctgtcatagagaggcagatgacaagcggcctacccacggtttgggataatggactagtggcaacaggcaagtccagcttttattgtttgggatccttactgagaagcagcaggcttcctctactgtcataaaaatattaaaaagtaagagccctgtataatttctcataataaaacaatgttttgcaga

SEQ ID NO: 103703 - DNA, 727 bp, Homo sapiens
  Payload ID: 384
  Gene Symbol: ACAA2
  Gene Name: acetyl-CoA acyltransferase 2
  ENST ID: ENST00000586485
  CDS Start-End: 356-727
agctggcggccgcggccgcccgcgcgccaagttcctcagcccttggctcctgcccagtgtttagggtgttggcggagacaaaggggaagagtcatcgcctgtcggggctaggatatgatgggtgagaggtgtcaaaccaaattctctcggtttggaaacggagaaaatctaaaaatgaggatgtgaggaaagagtccgctctcaaggtgtgtttgtagttgctgctaagcgaacgccctttggagcttacggaggccttctgaaagacttcactgctactgacttgtctgaatttgctgccaaggctgccttgtctgctggcaaagtctcacctgaaacagttgacagtgtgattatgggcaatgtcctgcagagttcttcagatgctatatatttggcaaggcatgttggtttgcgtgtgggaatcccaaaggagaccccagctctcacgattaataggctctgtggttctggttttcagtccattgtgaatggatgtcaggaaatttgtgttaaagaagctgaagttgttttatgtggaggaaccgaaagcatgagccaagctccctactgtgtcagaaatgtgcgttttggaaccaagcttggatcagatatcaagctggaagattctttatgggtatcattaacagatcagcatgtccagctccccatggcaatgactgcagagaatcttgctgtaaaacacaaaataagcagagaagaatgt

SEQ ID NO: 103704 - DNA, 538 bp, Homo sapiens
  Payload ID: 384
  Gene Symbol: ACAA2
  Gene Name: acetyl-CoA acyltransferase 2
  ENST ID: ENST00000585948
  CDS Start-End: 286-538
tcagtcaacaagaagaaccggctcctaggtttttattagcacccatcccagtacttggcaggaggttttcgctcgacagatcatagctctcctactgctcctagctttgttgggaatgtttgtgtattttttcaaggtgtgtttgtagttgctgctaagcgaacgccctttggagcttacggaggccttctgaaagacttcactgctactgacttgtctgaatttgctgccaaggctgccttgtctgctggcaaagtctcacctgaaacagttgacagtgtgattatgggcaatgtcctgcagagttcttcagatgctatatatttggcaaggcatgttggtttgcgtgtgggaatcccaaaggagaccccagctctcacgattaataggctctgtggttctggttttcagtccattgtgaatggatgtcaggaaatttgtgttaaagaagctgaagttgttttatgtggaggaaccgaaagcatgagccaagctccctactgtgtcagaaatgtgcgttttggaaccaagcttggat

SEQ ID NO: 103705 - DNA, 1657 bp, Homo sapiens
  Payload ID: 384
  Gene Symbol: ACAA2
  Gene Name: acetyl-CoA acyltransferase 2
  ENST ID: ENST00000587994
  CDS Start-End: 131-1315
gttcggtcccgcccccagctggcggccgcggccgcccgcgcgccaagttcctcagcccttggctcctgcccagtgtttagggtgttggcggagacaaaggggaagagtcatcgcctgtcggggctaggatatgatgggtgtgtttgtagttgctgctaagcgaacgccctttggagcttacggaggccttctgaaagacttcactgctactgacttgtctgaatttgctgccaaggctgccttgtctgctggcaaagtctcacctgaaacagttgacagtgtgattatgggcaatgtcctgcagagttcttcagatgctatatatttggcaaggcatgttggtttgcgtgtgggaatcccaaaggagaccccagctctcacgattaataggctctgtggttctggttttcagtccattgtgaatggatgtcaggaaatttgtgttaaagaagctgaagttgttttatgtggaggaaccgaaagcatgagccaagctccctactgtgtcagaaatgtgcgttttggaaccaagcttggatcagatatcaagctggaagattctttatgggtatcattaacagatcagcatgtccagctccccatggcaatgactgcagagaatcttgctgtaaaacacaaaataagcagagaagaatgtgacaaatatgccctgcagtcacagcagagatggaaagctgctaatgatgctggctactttaatgatgaaatggcaccaattgaagtgaagacaaagaaaggaaaacagacaatgcaggtagacgagcatgctcggccccaaaccaccctggaacagttacagaaacttcctccagtattcaagaaagatggaactgttactgcagggaatgcatcgggtgtagctgatggtgctggagctgttatcatagctagtgaagatgctgttaagaaacataacttcacaccactggcaagaattgtgggctactttgtatctggatgtgatccctctatcatgggtattggtcctgtccctgctatcagtggggcactgaagaaagcaggactgagtcttaaggacatggatttggtagaggtgaatgaagcttttgctccccagtacttggctgttgagaggagtttggatcttgacataagtaaaaccaatgtgaatggaggagccattgctttgggtcacccactgggaggatctggatcaagaattactgcacacctggttcacgaattaaggcgtcgaggtggaaaatatgccgttggatcagcttgcattggaggtggccaaggtattgctgtcatcattcagagcacagcctgaagagaccagtgagctcactgtgacccatccttactctacttggccaggccacagtaaaacaagtgaccttcagagcagctgccacaactggccatgccctgccattgaaacagtgattaagtttgatcaagccatggtgacacaaaaatgcattgatcatgaataggagcccatgctagaagtacattctctcagatttgaaccagtgaaatatgatgtatttctgagctaaaactcaactatagaagacattaaaagaaatcgtattcttgccaagtaaccaccacttctgccttagataatatgattataaggaaatcaaataaatgttgccttaacttc

SEQ ID NO: 103706 - DNA, 1840 bp, Homo sapiens
  Payload ID: 384
  Gene Symbol: ACAA2
  Gene Name: acetyl-CoA acyltransferase 2
  ENST ID: ENST00000589432
  CDS Start-End: 468-1496
gatggagaggcctgcagaaatggtagctggtgttctgctggaagacctgccctgctcccatttcccttctgttgctttagattagagcggtcactctatacctaagttctagggttatgaacttgtttaaaacaactgtgtaataaactcccttttcaaaacaagtgggcacagtcaatggaatcttactttaaggatgtacgagtcgaagaacattgaggtggaatacatatcgaggccctgagacaggaaaaagcttggcaggatctaagaaccaagcattttggtgctccagggccctgtgggctctgtaagaaggtgtgtttgtagttgctgctaagcgaacgccctttggagcttacggaggccttctgaaagacttcactgctactgacttgtctgaatttgctgccaaggctgccttgtctgctggcaaagtctcacctgaaacagttgacagtgtgattatgggcaatgtcctgcagagttcttcagatgctatatatttggcaaggcatgttggtttgcgtgtgggaatcccaaaggagaccccagctctcacgattaataggctctgtggttctggttttcagtccattgtgaatggatgtcaggaaatttgtgttaaagaagctgaagttgttttatgtggaggaaccgaaagcatgagccaagctccctactgtgtcagaaatgtgcgttttggaaccaagcttggatcagatatcaagctggaagattctttatgggtatcattaacagatcagcatgtccagctccccatggcaatgactgcagagaatcttgctgtaaaacacaaaataagcagagaagaatgtgacaaatatgccctgcagtcacagcagagatggaaagctgctaatgatgctggctactttaatgatgaaatggcaccaattgaagtgaagacaaagaaaggaaaacagacaatgcaggtagacgagcatgctcggccccaaaccaccctggaacagttacagaaacttcctccagtattcaagaaagatggaactgttactgcagggaatgcatcgggtgtagctgatggtgctggagctgttatcatagctagtgaagatgctgttaagaaacataacttcacaccactggcaagaattgtgggctactttgtatctggatgtgatccctctatcatgggtattggtcctgtccctgctatcagtggggcactgaagaaagcaggactgagtcttaaggacatggatttggtagaggtgaatgaagcttttgctccccagtacttggctgttgagaggagtttggatcttgacataagtaaaaccaatgtgaatggaggagccattgctttgggtcacccactgggaggatctggatcaagaattactgcacacctggttcacgaattaaggcgtcgaggtggaaaatatgccgttggatcagcttgcattggaggtggccaaggtattgctgtcatcattcagagcacagcctgaagagaccagtgagctcactgtgacccatccttactctacttggccaggccacagtaaaacaagtgaccttcagagcagctgccacaactggccatgccctgccattgaaacagtgattaagtttgatcaagccatggtgacacaaaaatgcattgatcatgaataggagcccatgctagaagtacattctctcagatttgaaccagtgaaatatgatgtatttctgagctaaaactcaactatagaagacattaaaagaaatcgtattcttgccaagtaaccaccacttctgccttagataatatgattataaggaaatcaaataaatgttgccttaacttcag

SEQ ID NO: 103707 - DNA, 639 bp, Homo sapiens
  Payload ID: 384
  Gene Symbol: ACAA2
  Gene Name: acetyl-CoA acyltransferase 2
  ENST ID: ENST00000586100
  CDS Start-End: 422-639
gttcggtcccgcccccagctggcggccgcggccgcccgcgcgccaagttcctcagcccttggctcctgcccagtgtttagggtgttggcggagacaaaggggaagagtcatcgcctgtcggggctaggatatgatgggtgagaggtgtcaaaccaaattctctcggtttggaaacggagaaaatctaaaaatgaggatgtgaggaaagagtccgctctcaaggcgcgttgtggtctatccgagccccgtcccctgggctccctcgggctggggtgtgtttgtagttgctgctaagcgaacgccctttggagcttacggaggccttctgaaagacttcactgctactgacttgtctgaatttgctgccaaggctgccttgtctgctggcaaagtctcacctgaaacagttgacagtgtgattatgggcaatgtcctgcagagttcttcagatgctatatatttggcaaggcatgttggtttgcgtgtgggaatcccaaaggagaccccagctctcacgattaataggctctgtggttctggttttcagtccattgtgaatggatgtcaggaaatttgtgttaaagaagctgaagttgttttatgtggaggaaccgaaagcatgagccaagctccctactg

SEQ ID NO: 103708 - DNA, 1626 bp, Homo sapiens
  Payload ID: 385
  Gene Symbol: ACACA
  Gene Name: acetyl-CoA carboxylase alpha
  ENST ID: ENST00000616352
  CDS Start-End: 1267-1626
gccctcttggccttttcccggtccccgccgcgcgcctgctgctgtccccgtgcccgaggactgggaggatggggctgagccgcttgcctgacttttgatccgaccagtaatcactttgcccgtgtggcgcgtggcccgttgcctgaggcttcctggcgcgtggggctgtttggtcccctccggagtgcggtgaggcgggccgagccgggactgcctgggtttggggataacgttcccatctccacccctgttgcagcaagggaaattgaggctgagggaactgggcccagggacggcgagccgtggcgcctctccagtccgggccccgaagggctgctcgtggatgaaccagactgattttaaggggtgaagagggtgcgtttcaatcagatgctcctggaacgtcgaaattgtcttctttggaaagaaccatcccctctttgggcttcagaggcccaaattgaggcgcaatgatgagaggatgtggtggtctactctgatgtcaatcttgagggctagggtcttgctatgtcacccagcctggagtggaattgtgtgatcaagactcactgaagcctccaactcctgggctcaagcaatcctcccacctcagccacccaagtagctgggactacaggctggagtgcaatggcatgatcttggctcactgcaacctccgcctcccggattcaacggattctcctgcctcagcctcctgagtagctgggattataggtgcctgccacaacacccaggaccagacttatgaagtggccttcctgaggagattttctgaccttatggtatgaagttccttcaggctcttaattctggataaactggagtgattaacaagagcaaagagacatagtattcagataaggactttgtgtcttatttttcttttatatcacaactggagccacagttgtgggcaaggcactgactttcttgatgaattctgtccatctgtaaagcagctatatatcccactggaggctttgcctctcagagacaacgtgaagacggataagcaggcatcaggagcagagtggcctctcagctggtcagattctccgaagaaggatcctctaggctgggcacggtggctcacacctataatcccagcactttgggaggccgaggcaggtggatcacgaggtcaggagttcgaggccagcctggccaatatggtctttttggaagtggatatctactcagacagtaagaattataagagctgtaagagctcattttggaggaataatggatgaaccatctcccttggcccaacctctggagctgaaccagcactctcgattcataataggttctgtgtctgaagataactcagaggatgagatcagcaacctggtgaagttggacctactggaggagaaggagggctccttgtcacctgcttctgttggctcagatacactctctgatttggggatctctagcctacaggatggcttggccttgcacataaggtccagcatgtctggcttgcacctagtaaagcagggccgagacagaaagaaaatagattctcaacgagatttcactgtggcttctccagcagaatttgttactcgctttgggggaaataaagtgattgagaag

SEQ ID NO: 103709 - DNA, 9554 bp, Homo sapiens
  Payload ID: 385
  Gene Symbol: ACACA
  Gene Name: acetyl-CoA carboxylase alpha
  Uniprot ID: Q13085
  ENST ID: ENST00000614428
  CDS Start-End: 192-7232
cggcctggtgctgcacgcctgtcagccatcgcccgagccgccggcgtctcctcccgcccagcagttcctccacgcaggggctccggaatcgcccgaccgcacacgttgccaccctgaggtctttttggaagtggatatctactcagacagtaagaattataagagctgtaagagctcattttggaggaataatggatgaaccatctcccttggcccaacctctggagctgaaccagcactctcgattcataataggttctgtgtctgaagataactcagaggatgagatcagcaacctggtgaagttggacctactggaggagaaggagggctccttgtcacctgcttctgttggctcagatacactctctgatttggggatctctagcctacaggatggcttggccttgcacataaggtccagcatgtctggcttgcacctagtaaagcagggccgagacagaaagaaaatagattctcaacgagatttcactgtggcttctccagcagaatttgttactcgctttgggggaaataaagtgattgagaaggttcttattgctaacaatggcattgcagcagtgaaatgcatgcggtctatccgtaggtggtcttatgaaatgtttcgaaatgaacgtgcaattagattcgttgtcatggtcacacctgaagaccttaaagccaatgcagaatacattaagatggcagatcactatgtgccagtgcctggaggaccaaacaacaacaactatgcaaatgtggaattaattcttgatattgctaaaaggatcccagtacaagcagtgtgggctggctggggtcatgcttctgagaatcccaaactaccggaacttctcttgaaaaatggcattgccttcatgggtcctccaagccaggccatgtgggctttaggggataagattgcatcttccatagtggctcaaactgcaggtatcccaactcttccctggagcggcagtggtcttcgtgtggactggcaggaaaatgatttttcaaaacgtatcttaaatgttccccaggagctatatgaaaaaggttatgtgaaagatgtggatgatgggctacaggcagctgaggaagttggatatccagtaatgatcaaggcctcagagggaggaggagggaagggaattagaaaagtcaacaatgcagatgacttccctaatctcttcagacaggttcaagctgaagttcctggatctcccatatttgtgatgagactagccaaacaatctcgtcatctggaggtgcagatcttagcggaccaatatggcaatgctatctctttgtttggtcgtgattgctctgtacaacgcaggcatcagaagattattgaagaagcacctgctactattgctactccagcagtatttgaacacatggaacagtgtgcggtgaaacttgccaaaatggtgggttatgtgagtgctgggactgtggaatacctgtacagccaggatggcagcttctactttctggaattgaatcctcggctgcaggtagagcacccttgtacagagatggtggctgatgtcaatctccctgcagcacagctccagattgccatggggattcctctatatagaatcaaggatatccgtatgatgtatggggtatctccctggggtgattctcccattgattttgaagattctgcacacgttccttgtccaaggggccatgttattgctgctcggatcactagtgaaaatccagatgagggttttaagcccagctcaggaacagttcaggagctaaatttccgcagcaataagaatgtttggggatatttcagtgttgctgctgcagggggacttcatgaatttgctgattctcagtttggtcactgcttttcttggggagaaaacagagaagaggcaatttcaaacatggtggtggctttgaaggagctgtctattcggggtgactttcgaactacagttgaatacctgatcaaattgttagagactgaaagctttcagatgaacagaattgatactggctggctggacagactgatagcagaaaaagtacaggctgagcgacctgacaccatgttgggggttgtgtgtggtgccctccacgtggcagatgtgagcctgcggaatagcgtctctaacttccttcactccttagaaaggggtcaagtccttcctgctcatacacttctgaatacagtagatgttgaacttatctatgagggagtcaagtatgtacttaaggtgactcgacagtcccccaactcctatgtggtgatcatgaatggctcatgtgtagaagtagatgtacatcggctgagtgacggtggactgctcttgtcctatgatggcagcagttatactacgtatatgaaagaggaagtggatagatatcgcatcacaattggcaataaaacctgtgtgtttgagaaggaaaatgacccatcggtgatgcgctcaccttctgctgggaagttaatccagtacattgtagaagatggaggtcatgtgtttgccggccagtgctatgctgagattgaggtaatgaagatggtaatgaccttaacagctgtggagtctggctgtatccattacgtcaagcgacctggagcagctcttgaccctggctgtgtactagccaaaatgcaactggacaaccccagcaaggttcagcaggctgaacttcacacaggtagtctgccacggatccagagcacggcactcagaggcgagaaactccatcgagtgttccattatgtcctggataatctggtcaatgtaatgaatggatactgccttccagatcctttctttagcagcaaggtaaaagactgggtagagcgattgatgaaaaccctcagagatccctccctgcctctcctagaattgcaagatattatgaccagtgtgtctggccgcattccccccaatgtggagaagtctatcaagaaggaaatggctcagtatgctagcaacatcacatcagtcctctgtcagtttcccagccagcagattgcaaacatcctagatagccatgcagctacattgaaccggaaatctgaacgggaagtcttctttatgaatactcagagcattgttcagctggtacagaggtaccgaagtggcatccgaggccacatgaaggctgtggtgatggatctgctccggcagtacctgcgagtagagacacaattccagaatggtcactatgacaaatgtgtattcgccctccgagaagagaataaaagtgacatgaacactgtactgaactacatcttctctcacgctcaagtcaccaagaagaatcttctggtcacaatgcttattgatcagttgtgtggccgggaccctactctcactgatgagctgctgaatattctcacagagctaactcaactcagtaagaccaccaatgccaaagtagcacttcgagcacgccaggttcttattgcctcccatttgccatcatatgagcttcgccataaccaagtagagtctatcttcctatcagctattgacatgtatggacatcaattttgcattgagaacctgcagaaactcatcctatcagaaacatctatttttgatgtcctaccaaacttcttctatcacagcaaccaagtagtgaggatggcagctctggaggtgtatgttcgaagggcttatattgcctatgaacttaacagcgtacaacaccgccagcttaaggacaacacctgtgtggtggaattccagttcatgctgcccacatctcatccaaacagagggaacatccctacgctaaacagaatgtccttctcctccaacctcaaccactatggcatgacccatgtagctagtgtcagcgatgtactgttggacaactcattcactccaccttgtcagcggatgggcggaatggtctcttttcggacttttgaagattttgtcaggatctttgatgaagtgatgggctgcttctctgactccccaccccagagtcccacattccctgaggcaggtcacacgtctctttatgatgaggataaggttcccagggatgaaccaattcacattctcaatgtggctatcaagactgactgtgatattgaggatgacaggctggcagctatgttcagagaatttacccagcaaaataaagctaccctggttgaccatgggatccggcgccttactttcctggttgcacaaaaggatttcagaaagcaggtcaactatgaggtggatcggagatttcatagagaattccctaaattttttacattccgagcaagggataagtttgaggaggatcgtatctatcgtcatctggagcctgctctggctttccagttagagctgaaccggatgagaaattttgacctcactgccattccatgtgctaatcacaagatgcacctgtatctcggggcagccaaggtggaagtgggcacagaagtgacagactacaggttctttgttcgtgcaatcatcaggcattctgatctggtcaccaaggaagcttcttttgaatatctgcaaaatgaaggggagcggctactcctggaagccatggatgagttggaagttgcttttaacaatacaaatgtccgcactgactgtaaccacatcttcctcaactttgtgcccacggttatcatggacccatcaaagattgaggaatccgtgcggagcatggtaatgcggtatggaagtcgcctgtggaaattgcgcgtcctccaggcagaactgaaaatcaacattcgcctgacgccaactggaaaagcaattcccatccgcctcttcctgacaaacgagtctggctattacttggatatcagcctatacaaggaagtgactgactccaggacagcacagatcatgtttcaggcatatggagacaaacagggaccactgcatggaatgttaatcaatactccatatgtgaccaaagacctgctgcaatcaaagaggttccaggcacaatccttagggacaacatacatatatgatatcccagagatgtttcggcagtccctgatcaaactctgggagtctatgtccactcaagcatttcttccatctccccctctgccttctgacatgctgacttacactgaactggtactggatgatcaaggtcagctggtccacatgaacaggcttccaggaggaaatgagattggcatggtagcttggaaaatgacctttaaaagtcctgaatatccagaaggccgagatatcattgttattggcaatgacatcacataccgaattgggtcctttgggcctcaagaggatttgttatttctcagagcttccgaacttgctagggcagaaggtattccacgcatctatgtatcagccaacagtggagcaagaatcggactggcagaagaaattcgccatatgtttcatgtggcctgggtagatcctgaggatccttacaagggatacaggtatttatatctgactcctcaagattataagagagtcagtgctctcaactctgtccattgtgaacacgtggaagatgaaggagaatccaggtacaagataacagatattattgggaaagaagagggaattggacccgagaaccttcgaggttctggaatgattgctggagaatcctcattggcctataatgagatcattaccatcagcctggtgacgtgccgggccattgggattggggcttaccttgtccggctgggacagagaaccatccaggttgagaattctcacttaattctaacaggagctggagccctcaacaaagtcctcgggcgggaagtgtacacctccaataaccagctggggggcatccagattatgcacaacaatggggtgacccactgcactgtgtgtgatgactttgaaggggttttcactgtcctgcactggctgtcttacatgcccaagagcgtgcacagttcagttcctcttctgaactcaaaggatcctatagacagaatcatcgagtttgttcccacaaagaccccatacgatcctcgatggatgctagcaggccgtcctcacccaacccaaaaaggtcagtggttgagtggcttttttgactatggatctttctcagagattatgcagccctgggcacagactgtggtggttggtagagccaggctaggaggaatacctgtgggagttgttgctgtagaaacccgaacagtagaactaagtatcccagctgatccagcaaacctggattctgaagccaagataatccagcaggctggccaggtttggttcccagattctgcgtttaagacgtatcaggccatcaaggacttcaaccgggaagggctgcctctgatggtctttgccaactggagaggcttctctggtggaatgaaagatatgtacgaccaagtgctgaagtttggtgcttacattgtggatggcttgagggagtgctgccagcctgtgctggtttacattcctccccaggctgagctgcggggtggctcctgggtggtgattgactcctccatcaacccccggcacatggagatgtatgctgaccgagaaagcaggggatctgttctggagccagaagggacagtagaaatcaaattccgcagaaaggatctggtgaaaaccatgcgtcgggtggacccagtctacatccacttggctgagcgattggggaccccagagctaagcacagctgagcggaaggagttggagaacaagttgaaggagcgggaggaattcctaattcccatttaccatcaggtagccgtgcagtttgctgacttgcacgacacaccaggccggatgcaggagaagggtgttattagcgatatcctggattggaaaacatcccgtaccttcttctactggcggctgaggcgtcttctgctggaggacctggtcaagaagaaaatccacaatgccaaccctgagctgactgatggccagattcaagccatgttaaggcgctggtttgtggaagtggaaggaacagtgaaggcttatgtttgggacaataataaggatctggcggagtggctagagaaacagctgacagaggaggatggtgttcactcggtaatagaggaaaacatcaaatgcatcagcagagactacgtcctcaagcaaatccgcagcttggtccaggccaatccagaggttgccatggattccatcatccatatgacgcagcacatatcacccactcagcgagcagaagtcatacggatcctctccacaatggattccccttccacgtaggaagagcttcctgcctgtccctgccctgtctctggagaaaagggctagagctgccttttacaactgtaaccactgtaatgagaaggcacaggagacccagcactggagtcaaatggcattttacttcctctcgtttcaggttatgcatgacatcctgggatgtaagatcacagaatccccctccagcccaccagtcacacctaccccattcagtatttattaccctggccaggcctagtcctccactccctgcacaggactgagaaggcaatgaaaggtacaaacatgtaccatgaggtcttactaaccaaagtagggctgcccctcctgtcctgacagccccttggcctcccagcatggggaagcgtgaggagttgcccagcagtgagcagcccccctcactcctggccccatgagccgcagccacaggcagcagaggagggctaaggagaggaggaagcctcaagtccattgtttattaccccgactcttagcccagcacacagtaggcactggagaggaatgattcccagtttaaccacactacggtaccttttatgaagaaaaattagagcataaaatctactacaagctccataggaactcaaagatgagggcaaaactgtgagccaagaagcagagaaagaaaatagaaccagttattcttgatttaggggacctcaaccttgggttcagtctctgaggacaaagggaaaggtagttgttggcctgcctctcgcctgcacgtcactgctggactagctgtcgcatgtggctgggagctgcaaggccagtgcttgaggggccccagcagttccacaggtggtgaagcctgagttggcagaggaggagccagaagagaactgccctttctgcactggtggaaactagttatttatgccatgtggagagccagtgagatagatagatagtctgtttgttttgaggacttggaaagttgttcctatgaagcctggagcttggatggttttgagaggttaatggtgcctccacactcactcttccctagttccaggattactgtcctagcagctaacggttctactctcttccccagagtgtagacaggcagcaggtctccccacagctctgaaaggaccctggtgacagctacaccctcagcaccaggagctggccttcctgatgagggaggcttccaggaaacacagaatccacatgaccttaagattatttacaactcagtcatggtgctgctgtcctccaggcttactggcccctcctgactggcatcaggggcttcctcaggtggtggagagagtttactttcaacaactagtttattcaagaaaagaacttactgattcctctgttcctaaagcaagagtggcaggtgatcagggctggtgtagcatccggttcctttagtgcagctaactgcatttgtcactgatgaccaaggaggaaatcactaagacatttgagaagcagtggtatgaacgttcttggacaagccacagttctgagccttaaccctgtagtttgcacacaagaacgagctccacctccccttcttcaggaggaatctgtgcggatagattggctggacttttcaatggttctgggttgcaggtgggcactgtatggctgggtatggagcggacagcccccaggagtcagagcctcagcccggctgccctggtggaaggtacaggtgttcagcaccttcagaaaagggcataaagtggtgggggacaattctcagtccaggaaaatgcattgaccattgctggctatttgcttacctagtaagaattggattcatttttgaccagattattcttctatgcttttttgcaataaatcaaatcccacatatctacaagtggtatgaagtcctgcaccccccaggaggcctgtccaggcatgtcttcagaggcagggtgggttacactcatttacctcccctctccccaccaaattatgacacaaacgagtatgtttcctctctagaaccctgtaatgcctcctcccccatccccagagctccttactgtaggtcttaccctggacaaggattttttcaagttggaggcacagaacatgagcaatctgacattcccacagcccctcaaacatgcaaggctactaaggcaggaggagtataaatgatggatattgaccaagacctgcttggacggagaccgccatattatctgttctcttcgttcacaaaacagccttcacttgtctcagaatttgatggacacatactgtgatgagcaggagcttcagatgcactctttacacattttgttgaaataaacctctacatttgtagaa

SEQ ID NO: 103710 - DNA, 9962 bp, Homo sapiens
  Payload ID: 385
  Gene Symbol: ACACA
  Gene Name: acetyl-CoA carboxylase alpha
  Uniprot ID: Q13085
  ENST ID: ENST00000619487
  CDS Start-End: 483-7634
gccctcttggccttttcccggtccccgccgcgcgcctgctgctgtccccgtgcccgaggactgggaggatggggctgagccgcttgcctgacttttgatccgaccagtaatcactttgcccgtgtggcgcgtggcccgttgcctgaggcttcctggcgcgtggggctgtttggtcccctccggagtgcggtgaggcgggccgagccgggactgcctgggtttggggataacgttcccatctccacccctgttgcagcaagggaaattgaggctgagggaactgggcccagggacggcgagccgtggctgcctctccagtccgggccccgaagggctgctcgtggatgaaccagactgattttaaggggtgaagagggtgcgtttcaatcagatgcttctggaacgtcgaaattgtcttctttggaaagaaccatcccctctttgggcttcagaggcccaaattgaggcgcaatgatgagaggatgtggtggtctactctgatgtcaatcttgagggctaggtctttctggaagtggatatctactcagacagtaagaattataagagctgtaagagctcattttggaggaataatggatgaaccatctcccttggcccaacctctggagctgaaccagcactctcgattcataataggttctgtgtctgaagataactcagaggatgagatcagcaacctggtgaagttggacctactggaggagaaggagggctccttgtcacctgcttctgttggctcagatacactctctgatttggggatctctagcctacaggatggcttggccttgcacataaggtccagcatgtctggcttgcacctagtaaagcagggccgagacagaaagaaaatagattctcaacgagatttcactgtggcttctccagcagaatttgttactcgctttgggggaaataaagtgattgagaaggttcttattgctaacaatggcattgcagcagtgaaatgcatgcggtctatccgtaggtggtcttatgaaatgtttcgaaatgaacgtgcaattagattcgttgtcatggtcacacctgaagaccttaaagccaatgcagaatacattaagatggcagatcactatgtgccagtgcctggaggaccaaacaacaacaactatgcaaatgtggaattaattcttgatattgctaaaaggatcccagtacaagcagtgtgggctggctggggtcatgcttctgagaatcccaaactaccggaacttctcttgaaaaatggcattgccttcatgggtcctccaagccaggccatgtgggctttaggggataagattgcatcttccatagtggctcaaactgcaggtatcccaactcttccctggagcggcagtggtcttcgtgtggactggcaggaaaatgatttttcaaaacgtatcttaaatgttccccaggagctatatgaaaaaggttatgtgaaagatgtggatgatgggctacaggcagctgaggaagttggatatccagtaatgatcaaggcctcagagggaggaggagggaagggaattagaaaagtcaacaatgcagatgacttccctaatctcttcagacaggttcaagctgaagttcctggatctcccatatttgtgatgagactagccaaacaatctcgtcatctggaggtgcagatcttagcggaccaatatggcaatgctatctctttgtttggtcgtgattgctctgtacaacgcaggcatcagaagattattgaagaagcacctgctactattgctactccagcagtatttgaacacatggaacagtgtgcggtgaaacttgccaaaatggtgggttatgtgagtgctgggactgtggaatacctgtacagccaggatggcagcttctactttctggaattgaatcctcggctgcaggtagagcacccttgtacagagatggtggctgatgtcaatctccctgcagcacagctccagattgccatggggattcctctatatagaatcaaggatatccgtatgatgtatggggtatctccctggggtgattctcccattgattttgaagattctgcacacgttccttgtccaaggggccatgttattgctgctcggatcactagtgaaaatccagatgagggttttaagcccagctcaggaacagttcaggagctaaatttccgcagcaataagaatgtttggggatatttcagtgttgctgctgcagggggacttcatgaatttgctgattctcagtttggtcactgcttttcttggggagaaaacagagaagaggcaatttcaaacatggtggtggctttgaaggagctgtctattcggggtgactttcgaactacagttgaatacctgatcaaattgttagagactgaaagctttcagatgaacagaattgatactggctggctggacagactgatagcagaaaaagtacaggctgagcgacctgacaccatgttgggggttgtgtgtggtgccctccacgtggcagatgtgagcctgcggaatagcgtctctaacttccttcactccttagaaaggggtcaagtccttcctgctcatacacttctgaatacagtagatgttgaacttatctatgagggagtcaagtatgtacttaaggtgactcgacagtcccccaactcctatgtggtgatcatgaatggctcatgtgtagaagtagatgtacatcggctgagtgacggtggactgctcttgtcctatgatggcagcagttatactacgtatatgaaagaggaagtggatagatatcgcatcacaattggcaataaaacctgtgtgtttgagaaggaaaatgacccatcggtgatgcgctcaccttctgctgggaagttaatccagtacattgtagaagatggaggtcatgtgtttgccggccagtgctatgctgagattgaggtaatgaagatggtaatgaccttaacagctgtggagtctggctgtatccattacgtcaagcgacctggagcagctcttgaccctggctgtgtactagccaaaatgcaactggacaaccccagcaaggttcagcaggctgaacttcacacaggtagtctgccacggatccagagcacggcactcagaggcgagaaactccatcgagtgttccattatgtcctggataatctggtcaatgtaatgaatggatactgccttccagatcctttctttagcagcaaggtaaaagactgggtagagcgattgatgaaaaccctcagagatccctccctgcctctcctagaattgcaagatattatgaccagtgtgtctggccgcattccccccaatgtggagaagtctatcaagaaggaaatggctcagtatgctagcaacatcacatcagtcctctgtcagtttcccagccagcagattgcaaacatcctagatagccatgcagctacattgaaccggaaatctgaacgggaagtcttctttatgaatactcagagcattgttcagctggtacagaggtaccgaagtggcatccgaggccacatgaaggctgtggtgatggatctgctccggcagtacctgcgagtagagacacaattccagaatggtcactatgacaaatgtgtattcgccctccgagaagagaataaaagtgacatgaacactgtactgaactacatcttctctcacgctcaagtcaccaagaagaatcttctggtcacaatgcttattgatcagttgtgtggccgggaccctactctcactgatgagctgctgaatattctcacagagctaactcaactcagtaagaccaccaatgccaaagtagcacttcgagcacgccaggttcttattgcctcccatttgccatcatatgagcttcgccataaccaagtagagtctatcttcctatcagctattgacatgtatggacatcaattttgcattgagaacctgcagaaactcatcctatcagaaacatctatttttgatgtcctaccaaacttcttctatcacagcaaccaagtagtgaggatggcagctctggaggtgtatgttcgaagggcttatattgcctatgaacttaacagcgtacaacaccgccagcttaaggacaacacctgtgtggtggaattccagttcatgctgcccacatctcatccaaacagagggaacatccctacgctaaacagaatgtccttctcctccaacctcaaccactatggcatgacccatgtagctagtgtcagcgatgtactgttggacaactcattcactccaccttgtcagcggatgggcggaatggtctcttttcggacttttgaagattttgtcaggatctttgatgaagtgatgggctgcttctctgactccccaccccagagtcccacattccctgaggcaggtcacacgtctctttatgatgaggataaggttcccagggatgaaccaattcacattctcaatgtggctatcaagactgactgtgatattgaggatgacaggctggcagctatgttcagagaatttacccagcaaaataaagctaccctggttgaccatgggatccggcgccttactttcctggttgcacaaaaggatttcagaaagcaggtcaactatgaggtggatcggagatttcatagagaattccctaaattttttacattccgagcaagggataagtttgaggaggatcgtatctatcgtcatctggagcctgctctggctttccagttagagctgaaccggatgagaaattttgacctcactgccattccatgtgctaatcacaagatgcacctgtatctcggggcagccaaggtggaagtgggcacagaagtgacagactacaggttctttgttcgtgcaatcatcaggcattctgatctggtcaccaaggaagcttcttttgaatatctgcaaaatgaaggggagcggctactcctggaagccatggatgagttggaagttgcttttaacaatacaaatgtccgcactgactgtaaccacatcttcctcaactttgtgcccacggttatcatggacccatcaaagattgaggaatccgtgcggagcatggtaatgcggtatggaagtcgcctgtggaaattgcgcgtcctccaggcagaactgaaaatcaacattcgcctgacgccaactggaaaagcaattcccatccgcctcttcctgacaaacgagtctggctattacttggatatcagcctatacaaggaagtgactgactccaggacagcacagatcatgtttcaggcatatggagacaaacagggaccactgcatggaatgttaatcaatactccatatgtgaccaaagacctgctgcaatcaaagaggttccaggcacaatccttagggacaacatacatatatgatatcccagagatgtttcggcagtccctgatcaaactctgggagtctatgtccactcaagcatttcttccatctccccctctgccttctgacatgctgacttacactgaactggtactggatgatcaaggtcagctggtccacatgaacaggcttccaggaggaaatgagattggcatggtagcttggaaaatgacctttaaaagtcctgaatatccagaaggccgagatatcattgttattggcaatgacatcacataccgaattgggtcctttgggcctcaagaggatttgttatttctcagagcttccgaacttgctagggcagaaggtattccacgcatctatgtatcagccaacagtggagcaagaatcggactggcagaagaaattcgccatatgtttcatgtggcctgggtagatcctgaggatccttacaagggatacaggtatttatatctgactcctcaagattataagagagtcagtgctctcaactctgtccattgtgaacacgtggaagatgaaggagaatccaggtacaagataacagatattattgggaaagaagagggaattggacccgagaaccttcgaggttctggaatgattgctggagaatcctcattggcctataatgagatcattaccatcagcctggtgacgtgccgggccattgggattggggcttaccttgtccggctgggacagagaaccatccaggttgagaattctcacttaattctaacaggagctggagccctcaacaaagtcctcgggcgggaagtgtacacctccaataaccagctggggggcatccagattatgcacaacaatggggtgacccactgcactgtgtgtgatgactttgaaggggttttcactgtcctgcactggctgtcttacatgcccaagagcgtgcacagttcagttcctcttctgaactcaaaggatcctatagacagaatcatcgagtttgttcccacaaagaccccatacgatcctcgatggatgctagcaggccgtcctcacccaacccaaaaaggtcagtggttgagtggcttttttgactatggatctttctcagagattatgcagccctgggcacagactgtggtggttggtagagccaggctaggaggaatacctgtgggagttgttgctgtagaaacccgaacagtagaactaagtatcccagctgatccagcaaacctggattctgaagccaagataatccagcaggctggccaggtttggttcccagattctgcgtttaagacgtatcaggccatcaaggacttcaaccgggaagggctgcctctgatggtctttgccaactggagaggcttctctggtggaatgaaagatatgtacgaccaagtgctgaagtttggtgcttacattgtggatggcttgagggagtgctgccagcctgtgctggtttacattcctccccaggctgagctgcggggtggctcctgggtggtgattgactcctccatcaacccccggcacatggagatgtatgctgaccgagaaagcaggggatctgttctggagccagaagggacagtagaaatcaaattccgcagaaaggatctggtgaaaaccatgcgtcgggtggacccagtctacatccacttggctgagcgattggggaccccagagctaagcacagctgagcggaaggagttggagaacaagttgaaggagcgggaggaattcctaattcccatttaccatcaggtagccgtgcagtttgctgacttgcacgacacaccaggccggatgcaggagaagggtgttattagcgatatcctggattggaaaacatcccgtaccttcttctactggcggctgaggcgtcttctgctggaggacctggtcaagaagaaaatccacaatgccaaccctgagctgactgatggccagattcaagccatgttaaggcgctggtttgtggaagtggaaggaacagtgaaggcttatgtttgggacaataataaggatctggcggagtggctagagaaacagctgacagaggaggatggtgttcactcggtaatagaggaaaacatcaaatgcatcagcagagactacgtcctcaagcaaatccgcagcttggtccaggccaatccagaggttgccatggattccatcatccatatgacgcagcacatatcacccactcagcgagcagaagtcatacggatcctctccacaatggattccccttccacgtaggaagagcttcctgcctgtccctgccctgtctctggagaaaagggctagagctgccttttacaactgtaaccactgtaatgagaaggcacaggagacccagcactggagtcaaatggcattttacttcctctcgtttcaggttatgcatgacatcctgggatgtaagatcacagaatccccctccagcccaccagtcacacctaccccattcagtatttattaccctggccaggcctagtcctccactccctgcacaggactgagaaggcaatgaaaggtacaaacatgtaccatgaggtcttactaaccaaagtagggctgcccctcctgtcctgacagccccttggcctcccagcatggggaagcgtgaggagttgcccagcagtgagcagcccccctcactcctggccccatgagccgcagccacaggcagcagaggagggctaaggagaggaggaagcctcaagtccattgtttattaccccgactcttagcccagcacacagtaggcactggagaggaatgattcccagtttaaccacactacggtaccttttatgaagaaaaattagagcataaaatctactacaagctccataggaactcaaagatgagggcaaaactgtgagccaagaagcagagaaagaaaatagaaccagttattcttgatttaggggacctcaaccttgggttcagtctctgaggacaaagggaaaggtagttgttggcctgcctctcgcctgcacgtcactgctggactagctgtcgcatgtggctgggagctgcaaggccagtgcttgaggggccccagcagttccacaggtggtgaagcctgagttggcagaggaggagccagaagagaactgccctttctgcactggtggaaactagttatttatgccatgtggagagccagtgagatagatagatagtctgtttgttttgaggacttggaaagttgttcctatgaagcctggagcttggatggttttgagaggttaatggtgcctccacactcactcttccctagttccaggattactgtcctagcagctaacggttctactctcttccccagagtgtagacaggcagcaggtctccccacagctctgaaaggaccctggtgacagctacaccctcagcaccaggagctggccttcctgatgagggaggcttccaggaaacacagaatccacatgaccttaagattatttacaactcagtcatggtgctgctgtcctccaggcttactggcccctcctgactggcatcaggggcttcctcaggtggtggagagagtttactttcaacaactagtttattcaagaaaagaacttactgattcctctgttcctaaagcaagagtggcaggtgatcagggctggtgtagcatccggttcctttagtgcagctaactgcatttgtcactgatgaccaaggaggaaatcactaagacatttgagaagcagtggtatgaacgttcttggacaagccacagttctgagccttaaccctgtagtttgcacacaagaacgagctccacctccccttcttcaggaggaatctgtgcggatagattggctggacttttcaatggttctgggttgcaggtgggcactgtatggctgggtatggagcggacagcccccaggagtcagagcctcagcccggctgccctggtggaaggtacaggtgttcagcaccttcagaaaagggcataaagtggtgggggacaattctcagtccaggaaaatgcattgaccattgctggctatttgcttacctagtaagaattggattcatttttgaccagattattcttctatgcttttttgcaataaatcaaatcccacatatctacaagtggtatgaagtcctgcaccccccaggaggcctgtccaggcatgtcttcagaggcagggtgggttacactcatttacctcccctctccccaccaaattatgacacaaacgagtatgtttcctctctagaaccctgtaatgcctcctcccccatccccagagctccttactgtaggtcttaccctggacaaggattttttcaagttggaggcacagaacatgagcaatctgacattcccacagcccctcaaacatgcaaggctactaaggcaggaggagtataaatgatggatattgaccaagacctgcttggacggagaccgccatattatctgttctcttcgttcacaaaacagccttcacttgtctcagaatttgatggacacatactgtgatgagcaggagcttcagatgcactctttacacattttgttgaaataaacctctacatttgtagaagagtta

SEQ ID NO: 103711 - DNA, 1064 bp, Homo sapiens
  Payload ID: 385
  Gene Symbol: ACACA
  Gene Name: acetyl-CoA carboxylase alpha
  ENST ID: ENST00000615918
  CDS Start-End: 483-827
gccctcttggccttttcccggtccccgccgcgcgcctgctgctgtccccgtgcccgaggactgggaggatggggctgagccgcttgcctgacttttgatccgaccagtaatcactttgcccgtgtggcgcgtggcccgttgcctgaggcttcctggcgcgtggggctgtttggtcccctccggagtgcggtgaggcgggccgagccgggactgcctgggtttggggataacgttcccatctccacccctgttgcagcaagggaaattgaggctgagggaactgggcccagggacggcgagccgtggctgcctctccagtccgggccccgaagggctgctcgtggatgaaccagactgattttaaggggtgaagagggtgcgtttcaatcagatgcttctggaacgtcgaaattgtcttctttggaaagaaccatcccctctttgggcttcagaggcccaaattgaggcgcaatgatgagaggatgtggtggtctactctgatgtcaatcttgagggctaggtctttctggaagtggatatctactcagacagtaagaattataagagctgtaagagctcattttggaggaataatggatgaaccatctcccttggcccaacctctggagctgaaccagcactctcgattcataataggttctgtgtctgaagataactcagaggatgagatcagcaacctggtgaagttggacctactggaggagaaggagggctccttgtcacctgcttctgttggctcagatacactctctgatttggggatctctagcctacaggatggcttggccttgcacataagactttgaaatactcgtgggatatgaagtggaggtgcctagagggttgaagataatgaggacagatgaagaaatgtttgattgtgccatacttacagttgctgattttcaaggtccagcatgtctggcttgcacctagtaaagcagggccgagacagaaagaaaatagattctcaacgagatttcactgtggcttctccagcagaatttgttactcgctttgggggaaataaagtgattgagaag

SEQ ID NO: 103712 - DNA, 662 bp, Homo sapiens
  Payload ID: 385
  Gene Symbol: ACACA
  Gene Name: acetyl-CoA carboxylase alpha
  ENST ID: ENST00000614789
  CDS Start-End: 537-662
cggcctggtgctgcacgcctgtcagccatcgcccgagccgccggcgtctcctcccgcccagcagttcctccacgcaggggctccggaatcgcccgaccgcacacgttgccaccctgaggtctttttggaagtggatatctactcagacagtaagaattataagagctgtaagagctcattttggaggaataatggatgaaccatctcccttggcccaacctctggagctgaaccagcactctcgattcataataggttctgtgtctgaagataactcagaggatgagatcagcaacctggtgaagttggacctactggaggagaaggagggctccttgtcacctgcttctgttggctcagatacactctctgatttggggatctctagcctacaggatggcttggccttgcacataagactttgaaatactcgtgggatatgaagtggaggtgcctagagggttgaagataatgaggacagatgaagaaatgtttgattgtgccatacttacagttgctgattttcaaggtccagcatgtctggcttgcacctagtaaagcagggccgagacagaaagaaaatagattctcaacgagatttcactgtggcttctccagcagaatttgttactcgctttgggggaaataaagtgattgagaag

SEQ ID NO: 103713 - DNA, 9624 bp, Homo sapiens
  Payload ID: 385
  Gene Symbol: ACACA
  Gene Name: acetyl-CoA carboxylase alpha
  Uniprot ID: Q13085
  ENST ID: ENST00000611803
  CDS Start-End: 436-7302
ggcagccaggagaggcagtggagcttttctccgttgactgtcagaagaaagtgactgttgttgaaaatgtttgctgcaactaaaggagagctgctaagatctactttctagttaaacaagcttttatatttctccccggctcctctcagttcccttgggaaatcaactaattgtgtgtgtaagctaagtgtgtggaggagagaagatgcaaaaaggaagagaaaggtggggaaagaaggaaattgggaacaattagacaaaaagactatagtttgaggccatcaggagtattctagtctgactgaagccaggcagaaggcacagtatctcttgtcctcctgggttttaagcagctgcaacaggaggaggaactgcggcttgtgtttacaaggccgaaatctgaagaaaaagcttccattcttttcccatcttgatatggagggttctccagaggaaaataaggaaatgagatattacatgcttcaaaggtccagcatgtctggcttgcacctagtaaagcagggccgagacagaaagaaaatagattctcaacgagatttcactgtggcttctccagcagaatttgttactcgctttgggggaaataaagtgattgagaaggttcttattgctaacaatggcattgcagcagtgaaatgcatgcggtctatccgtaggtggtcttatgaaatgtttcgaaatgaacgtgcaattagattcgttgtcatggtcacacctgaagaccttaaagccaatgcagaatacattaagatggcagatcactatgtgccagtgcctggaggaccaaacaacaacaactatgcaaatgtggaattaattcttgatattgctaaaaggatcccagtacaagcagtgtgggctggctggggtcatgcttctgagaatcccaaactaccggaacttctcttgaaaaatggcattgccttcatgggtcctccaagccaggccatgtgggctttaggggataagattgcatcttccatagtggctcaaactgcaggtatcccaactcttccctggagcggcagtggtcttcgtgtggactggcaggaaaatgatttttcaaaacgtatcttaaatgttccccaggagctatatgaaaaaggttatgtgaaagatgtggatgatgggctacaggcagctgaggaagttggatatccagtaatgatcaaggcctcagagggaggaggagggaagggaattagaaaagtcaacaatgcagatgacttccctaatctcttcagacaggttcaagctgaagttcctggatctcccatatttgtgatgagactagccaaacaatctcgtcatctggaggtgcagatcttagcggaccaatatggcaatgctatctctttgtttggtcgtgattgctctgtacaacgcaggcatcagaagattattgaagaagcacctgctactattgctactccagcagtatttgaacacatggaacagtgtgcggtgaaacttgccaaaatggtgggttatgtgagtgctgggactgtggaatacctgtacagccaggatggcagcttctactttctggaattgaatcctcggctgcaggtagagcacccttgtacagagatggtggctgatgtcaatctccctgcagcacagctccagattgccatggggattcctctatatagaatcaaggatatccgtatgatgtatggggtatctccctggggtgattctcccattgattttgaagattctgcacacgttccttgtccaaggggccatgttattgctgctcggatcactagtgaaaatccagatgagggttttaagcccagctcaggaacagttcaggagctaaatttccgcagcaataagaatgtttggggatatttcagtgttgctgctgcagggggacttcatgaatttgctgattctcagtttggtcactgcttttcttggggagaaaacagagaagaggcaatttcaaacatggtggtggctttgaaggagctgtctattcggggtgactttcgaactacagttgaatacctgatcaaattgttagagactgaaagctttcagatgaacagaattgatactggctggctggacagactgatagcagaaaaagtacaggctgagcgacctgacaccatgttgggggttgtgtgtggtgccctccacgtggcagatgtgagcctgcggaatagcgtctctaacttccttcactccttagaaaggggtcaagtccttcctgctcatacacttctgaatacagtagatgttgaacttatctatgagggagtcaagtatgtacttaaggtgactcgacagtcccccaactcctatgtggtgatcatgaatggctcatgtgtagaagtagatgtacatcggctgagtgacggtggactgctcttgtcctatgatggcagcagttatactacgtatatgaaagaggaagtggatagatatcgcatcacaattggcaataaaacctgtgtgtttgagaaggaaaatgacccatcggtgatgcgctcaccttctgctgggaagttaatccagtacattgtagaagatggaggtcatgtgtttgccggccagtgctatgctgagattgaggtaatgaagatggtaatgaccttaacagctgtggagtctggctgtatccattacgtcaagcgacctggagcagctcttgaccctggctgtgtactagccaaaatgcaactggacaaccccagcaaggttcagcaggctgaacttcacacaggtagtctgccacggatccagagcacggcactcagaggcgagaaactccatcgagtgttccattatgtcctggataatctggtcaatgtaatgaatggatactgccttccagatcctttctttagcagcaaggtaaaagactgggtagagcgattgatgaaaaccctcagagatccctccctgcctctcctagaattgcaagatattatgaccagtgtgtctggccgcattccccccaatgtggagaagtctatcaagaaggaaatggctcagtatgctagcaacatcacatcagtcctctgtcagtttcccagccagcagattgcaaacatcctagatagccatgcagctacattgaaccggaaatctgaacgggaagtcttctttatgaatactcagagcattgttcagctggtacagaggtaccgaagtggcatccgaggccacatgaaggctgtggtgatggatctgctccggcagtacctgcgagtagagacacaattccagaatggtcactatgacaaatgtgtattcgccctccgagaagagaataaaagtgacatgaacactgtactgaactacatcttctctcacgctcaagtcaccaagaagaatcttctggtcacaatgcttattgatcagttgtgtggccgggaccctactctcactgatgagctgctgaatattctcacagagctaactcaactcagtaagaccaccaatgccaaagtagcacttcgagcacgccaggttcttattgcctcccatttgccatcatatgagcttcgccataaccaagtagagtctatcttcctatcagctattgacatgtatggacatcaattttgcattgagaacctgcagaaactcatcctatcagaaacatctatttttgatgtcctaccaaacttcttctatcacagcaaccaagtagtgaggatggcagctctggaggtgtatgttcgaagggcttatattgcctatgaacttaacagcgtacaacaccgccagcttaaggacaacacctgtgtggtggaattccagttcatgctgcccacatctcatccaaacagagggaacatccctacgctaaacagaatgtccttctcctccaacctcaaccactatggcatgacccatgtagctagtgtcagcgatgtactgttggacaactcattcactccaccttgtcagcggatgggcggaatggtctcttttcggacttttgaagattttgtcaggatctttgatgaagtgatgggctgcttctctgactccccaccccagagtcccacattccctgaggcaggtcacacgtctctttatgatgaggataaggttcccagggatgaaccaattcacattctcaatgtggctatcaagactgactgtgatattgaggatgacaggctggcagctatgttcagagaatttacccagcaaaataaagctaccctggttgaccatgggatccggcgccttactttcctggttgcacaaaaggatttcagaaagcaggtcaactatgaggtggatcggagatttcatagagaattccctaaattttttacattccgagcaagggataagtttgaggaggatcgtatctatcgtcatctggagcctgctctggctttccagttagagctgaaccggatgagaaattttgacctcactgccattccatgtgctaatcacaagatgcacctgtatctcggggcagccaaggtggaagtgggcacagaagtgacagactacaggttctttgttcgtgcaatcatcaggcattctgatctggtcaccaaggaagcttcttttgaatatctgcaaaatgaaggggagcggctactcctggaagccatggatgagttggaagttgcttttaacaatacaaatgtccgcactgactgtaaccacatcttcctcaactttgtgcccacggttatcatggacccatcaaagattgaggaatccgtgcggagcatggtaatgcggtatggaagtcgcctgtggaaattgcgcgtcctccaggcagaactgaaaatcaacattcgcctgacgccaactggaaaagcaattcccatccgcctcttcctgacaaacgagtctggctattacttggatatcagcctatacaaggaagtgactgactccaggacagcacagatcatgtttcaggcatatggagacaaacagggaccactgcatggaatgttaatcaatactccatatgtgaccaaagacctgctgcaatcaaagaggttccaggcacaatccttagggacaacatacatatatgatatcccagagatgtttcggcagtccctgatcaaactctgggagtctatgtccactcaagcatttcttccatctccccctctgccttctgacatgctgacttacactgaactggtactggatgatcaaggtcagctggtccacatgaacaggcttccaggaggaaatgagattggcatggtagcttggaaaatgacctttaaaagtcctgaatatccagaaggccgagatatcattgttattggcaatgacatcacataccgaattgggtcctttgggcctcaagaggatttgttatttctcagagcttccgaacttgctagggcagaaggtattccacgcatctatgtatcagccaacagtggagcaagaatcggactggcagaagaaattcgccatatgtttcatgtggcctgggtagatcctgaggatccttacaagggatacaggtatttatatctgactcctcaagattataagagagtcagtgctctcaactctgtccattgtgaacacgtggaagatgaaggagaatccaggtacaagataacagatattattgggaaagaagagggaattggacccgagaaccttcgaggttctggaatgattgctggagaatcctcattggcctataatgagatcattaccatcagcctggtgacgtgccgggccattgggattggggcttaccttgtccggctgggacagagaaccatccaggttgagaattctcacttaattctaacaggagctggagccctcaacaaagtcctcgggcgggaagtgtacacctccaataaccagctggggggcatccagattatgcacaacaatggggtgacccactgcactgtgtgtgatgactttgaaggggttttcactgtcctgcactggctgtcttacatgcccaagagcgtgcacagttcagttcctcttctgaactcaaaggatcctatagacagaatcatcgagtttgttcccacaaagaccccatacgatcctcgatggatgctagcaggccgtcctcacccaacccaaaaaggtcagtggttgagtggcttttttgactatggatctttctcagagattatgcagccctgggcacagactgtggtggttggtagagccaggctaggaggaatacctgtgggagttgttgctgtagaaacccgaacagtagaactaagtatcccagctgatccagcaaacctggattctgaagccaagataatccagcaggctggccaggtttggttcccagattctgcgtttaagacgtatcaggccatcaaggacttcaaccgggaagggctgcctctgatggtctttgccaactggagaggcttctctggtggaatgaaagatatgtacgaccaagtgctgaagtttggtgcttacattgtggatggcttgagggagtgctgccagcctgtgctggtttacattcctccccaggctgagctgcggggtggctcctgggtggtgattgactcctccatcaacccccggcacatggagatgtatgctgaccgagaaagcaggggatctgttctggagccagaagggacagtagaaatcaaattccgcagaaaggatctggtgaaaaccatgcgtcgggtggacccagtctacatccacttggctgagcgattggggaccccagagctaagcacagctgagcggaaggagttggagaacaagttgaaggagcgggaggaattcctaattcccatttaccatcaggtagccgtgcagtttgctgacttgcacgacacaccaggccggatgcaggagaagggtgttattagcgatatcctggattggaaaacatcccgtaccttcttctactggcggctgaggcgtcttctgctggaggacctggtcaagaagaaaatccacaatgccaaccctgagctgactgatggccagattcaagccatgttaaggcgctggtttgtggaagtggaaggaacagtgaaggcttatgtttgggacaataataaggatctggcggagtggctagagaaacagctgacagaggaggatggtgttcactcggtaatagaggaaaacatcaaatgcatcagcagagactacgtcctcaagcaaatccgcagcttggtccaggccaatccagaggttgccatggattccatcatccatatgacgcagcacatatcacccactcagcgagcagaagtcatacggatcctctccacaatggattccccttccacgtaggaagagcttcctgcctgtccctgccctgtctctggagaaaagggctagagctgccttttacaactgtaaccactgtaatgagaaggcacaggagacccagcactggagtcaaatggcattttacttcctctcgtttcaggttatgcatgacatcctgggatgtaagatcacagaatccccctccagcccaccagtcacacctaccccattcagtatttattaccctggccaggcctagtcctccactccctgcacaggactgagaaggcaatgaaaggtacaaacatgtaccatgaggtcttactaaccaaagtagggctgcccctcctgtcctgacagccccttggcctcccagcatggggaagcgtgaggagttgcccagcagtgagcagcccccctcactcctggccccatgagccgcagccacaggcagcagaggagggctaaggagaggaggaagcctcaagtccattgtttattaccccgactcttagcccagcacacagtaggcactggagaggaatgattcccagtttaaccacactacggtaccttttatgaagaaaaattagagcataaaatctactacaagctccataggaactcaaagatgagggcaaaactgtgagccaagaagcagagaaagaaaatagaaccagttattcttgatttaggggacctcaaccttgggttcagtctctgaggacaaagggaaaggtagttgttggcctgcctctcgcctgcacgtcactgctggactagctgtcgcatgtggctgggagctgcaaggccagtgcttgaggggccccagcagttccacaggtggtgaagcctgagttggcagaggaggagccagaagagaactgccctttctgcactggtggaaactagttatttatgccatgtggagagccagtgagatagatagatagtctgtttgttttgaggacttggaaagttgttcctatgaagcctggagcttggatggttttgagaggttaatggtgcctccacactcactcttccctagttccaggattactgtcctagcagctaacggttctactctcttccccagagtgtagacaggcagcaggtctccccacagctctgaaaggaccctggtgacagctacaccctcagcaccaggagctggccttcctgatgagggaggcttccaggaaacacagaatccacatgaccttaagattatttacaactcagtcatggtgctgctgtcctccaggcttactggcccctcctgactggcatcaggggcttcctcaggtggtggagagagtttactttcaacaactagtttattcaagaaaagaacttactgattcctctgttcctaaagcaagagtggcaggtgatcagggctggtgtagcatccggttcctttagtgcagctaactgcatttgtcactgatgaccaaggaggaaatcactaagacatttgagaagcagtggtatgaacgttcttggacaagccacagttctgagccttaaccctgtagtttgcacacaagaacgagctccacctccccttcttcaggaggaatctgtgcggatagattggctggacttttcaatggttctgggttgcaggtgggcactgtatggctgggtatggagcggacagcccccaggagtcagagcctcagcccggctgccctggtggaaggtacaggtgttcagcaccttcagaaaagggcataaagtggtgggggacaattctcagtccaggaaaatgcattgaccattgctggctatttgcttacctagtaagaattggattcatttttgaccagattattcttctatgcttttttgcaataaatcaaatcccacatatctacaagtggtatgaagtcctgcaccccccaggaggcctgtccaggcatgtcttcagaggcagggtgggttacactcatttacctcccctctccccaccaaattatgacacaaacgagtatgtttcctctctagaaccctgtaatgcctcctcccccatccccagagctccttactgtaggtcttaccctggacaaggattttttcaagttggaggcacagaacatgagcaatctgacattcccacagcccctcaaacatgcaaggctactaaggcaggaggagtataaatgatggatattgaccaagacctgcttggacggagaccgccatattatctgttctcttcgttcacaaaacagccttcacttgtctcagaatttgatggacacatactgtgatgagcaggagcttcagatgcactctttacacattttgttgaaataaacctctacatttgtagaa

SEQ ID NO: 103714 - DNA, 7912 bp, Homo sapiens
  Payload ID: 385
  Gene Symbol: ACACA
  Gene Name: acetyl-CoA carboxylase alpha
  Uniprot ID: Q13085
  ENST ID: ENST00000621312
  CDS Start-End: 607-7413
ggcagccaggagaggcagtggagcttttctccgttgactgtcagaagaaagtgactgttgttgaaaatgtttgctgcaactaaaggagagctgctaagatctactttctagttaaacaagcttttatatttctccccggctcctctcagttcccttgggaaatcaactaattgtgtgtgtaagctaagtgtgtggaggagagaagatgcaaaaaggaagagaaaggtggggaaagaaggaaattgggaacaattagacaaaaagactatagtttgaggccatcaggagtattctagtctgactgaagccaggcagaaggcacagtatctcttgtcctcctgggttttaagcagctgcaacaggaggaggaactgcggcttgtgtttacaaggccgaaatctgaagaaaaagcttccattcttttcccatcttgatatggagggttctccagaggaaaataaggaaatgagatattacatgcttcaaagactttgaaatactcgtgggatatgaagtggaggtgcctagagggttgaagataatgaggacagatgaagaaatgtttgattgtgccatacttacagttgctgattttcaaggtccagcatgtctggcttgcacctagtaaagcagggccgagacagaaagaaaatagattctcaacgagatttcactgtggcttctccagcagaatttgttactcgctttgggggaaataaagtgattgagaaggttcttattgctaacaatggcattgcagcagtgaaatgcatgcggtctatccgtaggtggtcttatgaaatgtttcgaaatgaacgtgcaattagattcgttgtcatggtcacacctgaagaccttaaagccaatgcagaatacattaagatggcagatcactatgtgccagtgcctggaggaccaaacaacaacaactatgcaaatgtggaattaattcttgatattgctaaaaggatcccagtacaagcagtgtgggctggctggggtcatgcttctgagaatcccaaactaccggaacttctcttgaaaaatggcattgccttcatgggtcctccaagccaggccatgtgggctttaggggataagattgcatcttccatagtggctcaaactgcaggtatcccaactcttccctggagcggcagtggtcttcgtgtggactggcaggaaaatgatttttcaaaacgtatcttaaatgttccccaggagctatatgaaaaaggttatgtgaaagatgtggatgatgggctacaggcagctgaggaagttggatatccagtaatgatcaaggcctcagagggaggaggagggaagggaattagaaaagtcaacaatgcagatgacttccctaatctcttcagacaggttcaagctgaagttcctggatctcccatatttgtgatgagactagccaaacaatctcgtcatctggaggtgcagatcttagcggaccaatatggcaatgctatctctttgtttggtcgtgattgctctgtacaacgcaggcatcagaagattattgaagaagcacctgctactattgctactccagcagtatttgaacacatggaacagtgtgcggtgaaacttgccaaaatggtgggttatgtgagtgctgggactgtggaatacctgtacagccaggatggcagcttctactttctggaattgaatcctcggctgcaggtagagcacccttgtacagagatggtggctgatgtcaatctccctgcagcacagctccagattgccatggggattcctctatatagaatcaaggatatccgtatgatgtatggggtatctccctggggtgattctcccattgattttgaagattctgcacacgttccttgtccaaggggccatgttattgctgctcggatcactagtgaaaatccagatgagggttttaagcccagctcaggaacagttcaggagctaaatttccgcagcaataagaatgtttggggatatttcagtgttgctgctgcagggggacttcatgaatttgctgattctcagtttggtcactgcttttcttggggagaaaacagagaagaggcaatttcaaacatggtggtggctttgaaggagctgtctattcggggtgactttcgaactacagttgaatacctgatcaaattgttagagactgaaagctttcagatgaacagaattgatactggctggctggacagactgatagcagaaaaagtacaggctgagcgacctgacaccatgttgggggttgtgtgtggtgccctccacgtggcagatgtgagcctgcggaatagcgtctctaacttccttcactccttagaaaggggtcaagtccttcctgctcatacacttctgaatacagtagatgttgaacttatctatgagggagtcaagtatgtacttaaggtgactcgacagtcccccaactcctatgtggtgatcatgaatggctcatgtgtagaagtagatgtacatcggctgagtgacggtggactgctcttgtcctatgatggcagcagttatactacgtatatgaaagaggaagtggatagatatcgcatcacaattggcaataaaacctgtgtgtttgagaaggaaaatgacccatcggtgatgcgctcaccttctgctgggaagttaatccagtacattgtagaagatggaggtcatgtgtttgccggccagtgctatgctgagattgaggtaatgaagatggtaatgaccttaacagctgtggagtctggctgtatccattacgtcaagcgacctggagcagctcttgaccctggctgtgtactagccaaaatgcaactggacaaccccagcaaggttcagcaggctgaacttcacacaggtagtctgccacggatccagagcacggcactcagaggcgagaaactccatcgagtgttccattatgtcctggataatctggtcaatgtaatgaatggatactgccttccagatcctttctttagcagcaaggtaaaagactgggtagagcgattgatgaaaaccctcagagatccctccctgcctctcctagaattgcaagatattatgaccagtgtgtctggccgcattccccccaatgtggagaagtctatcaagaaggaaatggctcagtatgctagcaacatcacatcagtcctctgtcagtttcccagccagcagattgcaaacatcctagatagccatgcagctacattgaaccggaaatctgaacgggaagtcttctttatgaatactcagagcattgttcagctggtacagaggtaccgaagtggcatccgaggccacatgaaggctgtggtgatggatctgctccggcagtacctgcgagtagagacacaattccagaatggtcactatgacaaatgtgtattcgccctccgagaagagaataaaagtgacatgaacactgtactgaactacatcttctctcacgctcaagtcaccaagaagaatcttctggtcacaatgcttattgatcagttgtgtggccgggaccctactctcactgatgagctgctgaatattctcacagagctaactcaactcagtaagaccaccaatgccaaagtagcacttcgagcacgccaggttcttattgcctcccatttgccatcatatgagcttcgccataaccaagtagagtctatcttcctatcagctattgacatgtatggacatcaattttgcattgagaacctgcagaaactcatcctatcagaaacatctatttttgatgtcctaccaaacttcttctatcacagcaaccaagtagtgaggatggcagctctggaggtgtatgttcgaagggcttatattgcctatgaacttaacagcgtacaacaccgccagcttaaggacaacacctgtgtggtggaattccagttcatgctgcccacatctcatccaaacagagggaacatccctacgctaaacagaatgtccttctcctccaacctcaaccactatggcatgacccatgtagctagtgtcagcgatgtactgttggacaactcattcactccaccttgtcagcggatgggcggaatggtctcttttcggacttttgaagattttgtcaggatctttgatgaagtgatgggctgcttctctgactccccaccccagagtcccacattccctgaggcaggtcacacgtctctttatgatgaggataaggttcccagggatgaaccaattcacattctcaatgtggctatcaagactgactgtgatattgaggatgacaggctggcagctatgttcagagaatttacccagcaaaataaagctaccctggttgaccatgggatccggcgccttactttcctggttgcacaaaaggatttcagaaagcaggtcaactatgaggtggatcggagatttcatagagaattccctaaattttttacattccgagcaagggataagtttgaggaggatcgtatctatcgtcatctggagcctgctctggctttccagttagagctgaaccggatgagaaattttgacctcactgccattccatgtgctaatcacaagatgcacctgtatctcggggcagccaaggtggaagtgggcacagaagtgacagactacaggttctttgttcgtgcaatcatcaggcattctgatctggtcaccaaggaagcttcttttgaatatctgcaaaatgaaggggagcggctactcctggaagccatggatgagttggaagttgcttttaacaatacaaatgtccgcactgactgtaaccacatcttcctcaactttgtgcccacggttatcatggacccatcaaagattgaggaatccgtgcggagcatggtaatgcggtatggaagtcgcctgtggaaattgcgcgtcctccaggcagaactgaaaatcaacattcgcctgacgccaactggaaaagcaattcccatccgcctcttcctgacaaacgagtctggctattacttggatatcagcctatacaaggaagtgactgactccaggacagcacagatcatgtttcaggcatatggagacaaacagggaccactgcatggaatgttaatcaatactccatatgtgaccaaagacctgctgcaatcaaagaggttccaggcacaatccttagggacaacatacatatatgatatcccagagatgtttcggcagtccctgatcaaactctgggagtctatgtccactcaagcatttcttccatctccccctctgccttctgacatgctgacttacactgaactggtactggatgatcaaggtcagctggtccacatgaacaggcttccaggaggaaatgagattggcatggtagcttggaaaatgacctttaaaagtcctgaatatccagaaggccgagatatcattgttattggcaatgacatcacataccgaattgggtcctttgggcctcaagaggatttgttatttctcagagcttccgaacttgctagggcagaaggtattccacgcatctatgtatcagccaacagtggagcaagaatcggactggcagaagaaattcgccatatgtttcatgtggcctgggtagatcctgaggatccttacaagggatacaggtatttatatctgactcctcaagattataagagagtcagtgctctcaactctgtccattgtgaacacgtggaagatgaaggagaatccaggtacaagataacagatattattgggaaagaagagggaattggacccgagaaccttcgaggttctggaatgattgctggagaatcctcattggcctataatgagatcattaccatcagcctggtgacgtgccgggccattgggattggggcttaccttgtccggctgggacagagaaccatccaggttgagaattctcacttaattctaacaggagctggagccctcaacaaagtcctcgggcgggaagtgtacacctccaataaccagctggggggcatccagattatgcacaacaatggggtgacccactgcactgtgtgtgatgactttgaaggggttttcactgtcctgcactggctgtcttacatgcccaagagcgtgcacagttcagttcctcttctgaactcaaaggatcctatagacagaatcatcgagtttgttcccacaaagaccccatacgatcctcgatggatgctagcaggccgtcctcacccaacccaaaaaggtcagtggttgagtggcttttttgactatggatctttctcagagattatgcagccctgggcacagactgtggtggttggtagagccaggctaggaggaatacctgtgggagttgttgctgtagaaacccgaacagtagaactaagtatcccagctgatccagcaaacctggattctgaagccaagataatccagcaggctggccaggtttggttcccagattctgcgtttaagacgtatcaggccatcaaggacttcaaccgggaagggctgcctctgatggtctttgccaactggagaggcttctctggtggaatgaaagatatgtacgaccaagtgctgaagtttggtgcttacattgtggatggcttgagggagtgctgccagcctgtgctggtttacattcctccccaggctgagctgcggggtggctcctgggtggtgattgactcctccatcaacccccggcacatggagatgtatgctgaccgagaaagcaggggatctgttctggagccagaagggacagtagaaatcaaattccgcagaaaggatctggtgaaaaccatgcgtcgggtggacccagtctacatccacttggctgagcgattggggaccccagagctaagcacagctgagcggaaggagttggagaacaagttgaaggagcgggaggaattcctaattcccatttaccatcaggtagccgtgcagtttgctgacttgcacgacacaccaggccggatgcaggagaagggtgttattagcgatatcctggattggaaaacatcccgtaccttcttctactggcggctgaggcgtcttctgctggaggacctggtcaagaagaaaatccacaatgccaaccctgagctgactgatggccagattcaagccatgttaaggcgctggtttgtggaagtggaaggaacagtgaaggcttatgtttgggacaataataaggatctggcggagtggctagagaaacagctgacagaggaggatggtgttcactcggtaatagaggaaaacatcaaatgcatcagcagagactacgtcctcaagcaaatccgcagcttggtccaggccaatccagaggttgccatggattccatcatccatatgacgcagcacatatcacccactcagcgagcagaagtcatacggatcctctccacaatggattccccttccacgtaggaagagcttcctgcctgtccctgccctgtctctggagaaaagggctagagctgccttttacaactgtaaccactgtaatgagaaggcacaggagacccagcactggagtcaaatggcattttacttcctctcgtttcaggttatgcatgacatcctgggatgtaagatcacagaatccccctccagcccaccagtcacacctaccccattcagtatttattaccctggccaggcctagtcctccactccctgcacaggactgagaaggcaatgaaaggtacaaacatgtaccatgaggtcttactaaccaaagtagggctgcccctcctgtcctgacagccccttggcctcccagcatggggaagcgtgaggagttgcccagcagtgagcagcccccctcactcctggccccatgagccgcagccacaggcagcagaggagggctaaggagaggaggaagcctcaagtccattgtttattaccccgactcttagcccag

SEQ ID NO: 103715 - DNA, 2177 bp, Homo sapiens
  Payload ID: 385
  Gene Symbol: ACACA
  Gene Name: acetyl-CoA carboxylase alpha
  ENST ID: ENST00000614482
  CDS Start-End: 1-157
agaaattcgccatatgtttcatgtggcctgggtagatcctgaggatccttacaagggatacaggtatttatatctgactcctcaagattataagagagtcagtgctctcaactctgtccattgtgaacacgtggaagatgaaggagaatccaggtgacgtgccgggccattgggattggggcttaccttgtccggctgggacagagaaccatccaggttgagaattctcacttaattctaacaggagctggagccctcaacaaagtcctcgggcgggaagtgtacacctccaataaccagctggggggcatccagattatgcacaacaatggggtgacccactgcactgtgtgtgatgactttgaaggggttttcactgtcctgcactggctgtcttacatgcccaagagcgtgcacagttcagttcctcttctgaactcaaaggatcctatagacagaatcatcgagtttgttcccacaaagaccccatacgatcctcgatggatgctagcaggccgtcctcacccaacccaaaaaggtcagtggttgagtggcttttttgactatggatctttctcagagattatgcagccctgggcacagactgtggtggttggtagagccaggctaggaggaatacctgtgggagttgttgctgtagaaacccgaacagtagaactaagtatcccagctgatccagcaaacctggattctgaagccaagataatccagcaggctggccaggtttggttcccagattctgcgtttaagacgtatcaggccatcaaggacttcaaccgggaagggctgcctctgatggtctttgccaactggagaggcttctctggtggaatgaaagatatgtacgaccaagtgctgaagtttggtgcttacattgtggatggcttgagggagtgctgccagcctgtgctggtttacattcctccccaggctgagctgcggggtggctcctgggtggtgattgactcctccatcaacccccggcacatggagatgtatgctgaccgagaaagcaggggatctgttctggagccagaagggacagtagaaatcaaattccgcagaaaggatctggtgaaaaccatgcgtcgggtggacccagtctacatccacttggctgagcgattggggaccccagagctaagcacagctgagcggaaggagttggagaacaagttgaaggagcgggaggaattcctaattcccatttaccatcaggtagccgtgcagtttgctgacttgcacgacacaccaggccggatgcaggagaagggtgttattagcgatatcctggattggaaaacatcccgtaccttcttctactggcggctgaggcgtcttctgctggaggacctggtcaagaagaaaatccacaatgccaaccctgagctgactgatggccagattcaagccatgttaaggcgctggtttgtggaagtggaaggaacagtgaaggcttatgtttgggacaataataaggatctggcggagtggctagagaaacagctgacagaggaggatggtgttcactcggtaatagaggaaaacatcaaatgcatcagcagagactacgtcctcaagcaaatccgcagcttggtccaggccaatccagaggttgccatggattccatcatccatatgacgcagcacatatcacccactcagcgagcagaagtcatacggatcctctccacaatggattccccttccacgtaggaagagcttcctgcctgtccctgccctgtctctggagaaaagggctagagctgccttttacaactgtaaccactgtaatgagaaggcacaggagacccagcactggagtcaaatggcattttacttcctctcgtttcaggttatgcatgacatcctgggatgtaagatcacagaatccccctccagcccaccagtcacacctaccccattcagtatttattaccctggccaggcctagtcctccactccctgcacaggactgagaaggcaatgaaaggtacaaacatgtaccatgaggtcttactaaccaaagtagggctgcccctcctgtcctgacagccccttggcctcccagcatggggaagcgtgaggagttgcccagcagtgagcagcccccctcactcctggccccatgagccgcagccacaggcagcagagga

SEQ ID NO: 103716 - DNA, 1063 bp, Homo sapiens
  Payload ID: 385
  Gene Symbol: ACACA
  Gene Name: acetyl-CoA carboxylase alpha
  ENST ID: ENST00000617548
  CDS Start-End: 482-826
gccctcttggccttttcccggtccccgccgcgcgcctgctgctgtccccgtgcccgaggactgggaggatggggctgagccgcttgcctgacttttgatccgaccagtaatcactttgcccgtgtggcgcgtggcccgttgcctgaggcttcctggcgcgtggggctgtttggtcccctccggagtgcggtgaggcgggccgagccgggactgcctgggtttggggataacgttcccatctccacccctgttgcagcaagggaaattgaggctgagggaactgggcccagggacggcgagccgtggcgcctctccagtccgggccccgaagggctgctcgtggatgaaccagactgattttaaggggtgaagagggtgcgtttcaatcagatgctcctggaacgtcgaaattgtcttctttggaaagaaccatcccctctttgggcttcagaggcccaaattgaggcgcaatgatgagaggatgtggtggtctactctgatgtcaatcttgagggctaggtctttttggaagtggatatctactcagacagtaagaattataagagctgtaagagctcattttggaggaataatggatgaaccatctcccttggcccaacctctggagctgaaccagcactctcgattcataataggttctgtgtctgaagataactcagaggatgagatcagcaacctggtgaagttggacctactggaggagaaggagggctccttgtcacctgcttctgttggctcagatacactctctgatttggggatctctagcctacaggatggcttggccttgcacataagactttgaaatactcgtgggatatgaagtggaggtgcctagagggttgaagataatgaggacagatgaagaaatgtttgattgtgccatacttacagttgctgattttcaaggtccagcatgtctggcttgcacctagtaaagcagggccgagacagaaagaaaatagattctcaacgagatttcactgtggcttctccagcagaatttgttactcgctttgggggaaataaagtgattgagaag

SEQ ID NO: 103717 - DNA, 463 bp, Homo sapiens
  Payload ID: 385
  Gene Symbol: ACACA
  Gene Name: acetyl-CoA carboxylase alpha
  ENST ID: ENST00000618053
  CDS Start-End: 1-290
acatcaaatgcatcagcagagactacgtcctcaagcaaatccgcagcttggtccaggccaatccagaggttgccatggattccatcatccatatgacgcagcacatatcacccactcagcgagcagaagtcatacggatcctctccacaatggattccccttccacgttatgcatgacatcctgggatgtaagatcacagaatccccctccagcccaccagtcacacctaccccattcagtatttattaccctggccaggcctagtcctccactccctgcacaggactgagaaggcaatgaaaggtacaaacatgtaccatgaggtcttactaaccaaagtagggctgcccctcctgtcctgacagccccttggcctcccagcatggggaagcgtgaggagttgcccagcagtgagcagcccccctcactcctggccccatgagccgcagccacaggcagcag

SEQ ID NO: 103718 - DNA, 9624 bp, Homo sapiens; identical to SEQ ID NO: 103713
  Payload ID: 385
  Gene Symbol: ACACA
  Gene Name: acetyl-CoA carboxylase alpha
  Uniprot ID: Q13085
  ENST ID: ENST00000612895
  CDS Start-End: 436-7302

SEQ ID NO: 103719 - DNA, 7912 bp, Homo sapiens; identical to SEQ ID NO: 103714
  Payload ID: 385
  Gene Symbol: ACACA
  Gene Name: acetyl-CoA carboxylase alpha
  Uniprot ID: Q13085
  ENST ID: ENST00000617649
  CDS Start-End: 607-7413

SEQ ID NO: 103720 - DNA, 1468 bp, Homo sapiens
  Payload ID: 385
  Gene Symbol: ACACA
  Gene Name: acetyl-CoA carboxylase alpha
  ENST ID: ENST00000615229
  CDS Start-End: 374-718
aatcactttgcccgtgtggcgcgtggcccgttgcctgaggcttcctggcgcgtggggctgtttggtcccctccggagtgcggtgaggcgggccgagccgggactgcctgggtttggggataacgttcccatctccacccctgttgcagcaagggaaattgaggctgagggaactgggcccagggacggcgagccgtggcgcctctccagtccgggccccgaagggctgctcgtggatgaaccagactgattttaaggggtgaagagggtgcgtttcaatcagatgctcctggaacgtcgaaattgtcttctttggaaagaaccatcccctctttgggcttcagaggcccaaattgaggcgcaatgatgagaggatgtggtggtctactctgatgtcaatcttgagggctaggtctttttggaagtggatatctactcagacagtaagaattataagagctgtaagagctcattttggaggaataatggatgaaccatctcccttggcccaacctctggagctgaaccagcactctcgattcataataggttctgtgtctgaagataactcagaggatgagatcagcaacctggtgaagttggacctactggaggagaaggagggctccttgtcacctgcttctgttggctcagatacactctctgatttggggatctctagcctacaggatggcttggccttgcacataagactttgaaatactcgtgggatatgaagtggaggtgcctagagggttgaagataatgaggacagatgaagaaatgtttgattgtgccatacttacagttgctgattttcaaggtccagcatgtctggcttgcacctagtaaagcagggccgagacagaaagaaaatagattctcaacgagatttcactgtggcttctccagcagaatttgttactcgctttgggggaaataaagtgattgagaaggttcttattgctaacaatggcattgcagcagtgaaatgcatgcggtctatccgtaggtggtcttatgaaatgtttcgaaatgaacgtgcaattagattcgttgtcatggtcacacctgaagaccttaaagccaatgcagaatacattaagatggcagatcactatgtgccagtgcctggaggaccaaacaacaacaactatgcaaatgtggaattaattcttgatattgctaaaaggatcccagtacaagcagtgtgggctggctggggtcatgcttctgagaatcccaaactaccggaacttctcttgaaaaatggcattgccttcatgggtcctccaagccaggccatgtgggctttaggggataagattgcatcttccatagtggctcaaactgcaggtatcccaactcttccctggagcggcagtggtcttcgtgtggactggcaggaaaatgatttttcaaaacgtatcttaaatgttccccaggagctatatgaaaaaggttatgtg

SEQ ID NO: 103721 - DNA, 9961 bp, Homo sapiens
  Payload ID: 385
  Gene Symbol: ACACA
  Gene Name: acetyl-CoA carboxylase alpha
  Uniprot ID: Q13085
  ENST ID: ENST00000616317
  CDS Start-End: 482-7633
gccctcttggccttttcccggtccccgccgcgcgcctgctgctgtccccgtgcccgaggactgggaggatggggctgagccgcttgcctgacttttgatccgaccagtaatcactttgcccgtgtggcgcgtggcccgttgcctgaggcttcctggcgcgtggggctgtttggtcccctccggagtgcggtgaggcgggccgagccgggactgcctgggtttggggataacgttcccatctccacccctgttgcagcaagggaaattgaggctgagggaactgggcccagggacggcgagccgtggcgcctctccagtccgggccccgaagggctgctcgtggatgaaccagactgattttaaggggtgaagagggtgcgtttcaatcagatgctcctggaacgtcgaaattgtcttctttggaaagaaccatcccctctttgggcttcagaggcccaaattgaggcgcaatgatgagaggatgtggtggtctactctgatgtcaatcttgagggctaggtctttttggaagtggatatctactcagacagtaagaattataagagctgtaagagctcattttggaggaataatggatgaaccatctcccttggcccaacctctggagctgaaccagcactctcgattcataataggttctgtgtctgaagataactcagaggatgagatcagcaacctggtgaagttggacctactggaggagaaggagggctccttgtcacctgcttctgttggctcagatacactctctgatttggggatctctagcctacaggatggcttggccttgcacataaggtccagcatgtctggcttgcacctagtaaagcagggccgagacagaaagaaaatagattctcaacgagatttcactgtggcttctccagcagaatttgttactcgctttgggggaaataaagtgattgagaaggttcttattgctaacaatggcattgcagcagtgaaatgcatgcggtctatccgtaggtggtcttatgaaatgtttcgaaatgaacgtgcaattagattcgttgtcatggtcacacctgaagaccttaaagccaatgcagaatacattaagatggcagatcactatgtgccagtgcctggaggaccaaacaacaacaactatgcaaatgtggaattaattcttgatattgctaaaaggatcccagtacaagcagtgtgggctggctggggtcatgcttctgagaatcccaaactaccggaacttctcttgaaaaatggcattgccttcatgggtcctccaagccaggccatgtgggctttaggggataagattgcatcttccatagtggctcaaactgcaggtatcccaactcttccctggagcggcagtggtcttcgtgtggactggcaggaaaatgatttttcaaaacgtatcttaaatgttccccaggagctatatgaaaaaggttatgtgaaagatgtggatgatgggctacaggcagctgaggaagttggatatccagtaatgatcaaggcctcagagggaggaggagggaagggaattagaaaagtcaacaatgcagatgacttccctaatctcttcagacaggttcaagctgaagttcctggatctcccatatttgtgatgagactagccaaacaatctcgtcatctggaggtgcagatcttagcggaccaatatggcaatgctatctctttgtttggtcgtgattgctctgtacaacgcaggcatcagaagattattgaagaagcacctgctactattgctactccagcagtatttgaacacatggaacagtgtgcggtgaaacttgccaaaatggtgggttatgtgagtgctgggactgtggaatacctgtacagccaggatggcagcttctactttctggaattgaatcctcggctgcaggtagagcacccttgtacagagatggtggctgatgtcaatctccctgcagcacagctccagattgccatggggattcctctatatagaatcaaggatatccgtatgatgtatggggtatctccctggggtgattctcccattgattttgaagattctgcacacgttccttgtccaaggggccatgttattgctgctcggatcactagtgaaaatccagatgagggttttaagcccagctcaggaacagttcaggagctaaatttccgcagcaataagaatgtttggggatatttcagtgttgctgctgcagggggacttcatgaatttgctgattctcagtttggtcactgcttttcttggggagaaaacagagaagaggcaatttcaaacatggtggtggctttgaaggagctgtctattcggggtgactttcgaactacagttgaatacctgatcaaattgttagagactgaaagctttcagatgaacagaattgatactggctggctggacagactgatagcagaaaaagtacaggctgagcgacctgacaccatgttgggggttgtgtgtggtgccctccacgtggcagatgtgagcctgcggaatagcgtctctaacttccttcactccttagaaaggggtcaagtccttcctgctcatacacttctgaatacagtagatgttgaacttatctatgagggagtcaagtatgtacttaaggtgactcgacagtcccccaactcctatgtggtgatcatgaatggctcatgtgtagaagtagatgtacatcggctgagtgacggtggactgctcttgtcctatgatggcagcagttatactacgtatatgaaagaggaagtggatagatatcgcatcacaattggcaataaaacctgtgtgtttgagaaggaaaatgacccatcggtgatgcgctcaccttctgctgggaagttaatccagtacattgtagaagatggaggtcatgtgtttgccggccagtgctatgctgagattgaggtaatgaagatggtaatgaccttaacagctgtggagtctggctgtatccattacgtcaagcgacctggagcagctcttgaccctggctgtgtactagccaaaatgcaactggacaaccccagcaaggttcagcaggctgaacttcacacaggtagtctgccacggatccagagcacggcactcagaggcgagaaactccatcgagtgttccattatgtcctggataatctggtcaatgtaatgaatggatactgccttccagatcctttctttagcagcaaggtaaaagactgggtagagcgattgatgaaaaccctcagagatccctccctgcctctcctagaattgcaagatattatgaccagtgtgtctggccgcattccccccaatgtggagaagtctatcaagaaggaaatggctcagtatgctagcaacatcacatcagtcctctgtcagtttcccagccagcagattgcaaacatcctagatagccatgcagctacattgaaccggaaatctgaacgggaagtcttctttatgaatactcagagcattgttcagctggtacagaggtaccgaagtggcatccgaggccacatgaaggctgtggtgatggatctgctccggcagtacctgcgagtagagacacaattccagaatggtcactatgacaaatgtgtattcgccctccgagaagagaataaaagtgacatgaacactgtactgaactacatcttctctcacgctcaagtcaccaagaagaatcttctggtcacaatgcttattgatcagttgtgtggccgggaccctactctcactgatgagctgctgaatattctcacagagctaactcaactcagtaagaccaccaatgccaaagtagcacttcgagcacgccaggttcttattgcctcccatttgccatcatatgagcttcgccataaccaagtagagtctatcttcctatcagctattgacatgtatggacatcaattttgcattgagaacctgcagaaactcatcctatcagaaacatctatttttgatgtcctaccaaacttcttctatcacagcaaccaagtagtgaggatggcagctctggaggtgtatgttcgaagggcttatattgcctatgaacttaacagcgtacaacaccgccagcttaaggacaacacctgtgtggtggaattccagttcatgctgcccacatctcatccaaacagagggaacatccctacgctaaacagaatgtccttctcctccaacctcaaccactatggcatgacccatgtagctagtgtcagcgatgtactgttggacaactcattcactccaccttgtcagcggatgggcggaatggtctcttttcggacttttgaagattttgtcaggatctttgatgaagtgatgggctgcttctctgactccccaccccagagtcccacattccctgaggcaggtcacacgtctctttatgatgaggataaggttcccagggatgaaccaattcacattctcaatgtggctatcaagactgactgtgatattgaggatgacaggctggcagctatgttcagagaatttacccagcaaaataaagctaccctggttgaccatgggatccggcgccttactttcctggttgcacaaaaggatttcagaaagcaggtcaactatgaggtggatcggagatttcatagagaattccctaaattttttacattccgagcaagggataagtttgaggaggatcgtatctatcgtcatctggagcctgctctggctttccagttagagctgaaccggatgagaaattttgacctcactgccattccatgtgctaatcacaagatgcacctgtatctcggggcagccaaggtggaagtgggcacagaagtgacagactacaggttctttgttcgtgcaatcatcaggcattctgatctggtcaccaaggaagcttcttttgaatatctgcaaaatgaaggggagcggctactcctggaagccatggatgagttggaagttgcttttaacaatacaaatgtccgcactgactgtaaccacatcttcctcaactttgtgcccacggttatcatggacccatcaaagattgaggaatccgtgcggagcatggtaatgcggtatggaagtcgcctgtggaaattgcgcgtcctccaggcagaactgaaaatcaacattcgcctgacgccaactggaaaagcaattcccatccgcctcttcctgacaaacgagtctggctattacttggatatcagcctatacaaggaagtgactgactccaggacagcacagatcatgtttcaggcatatggagacaaacagggaccactgcatggaatgttaatcaatactccatatgtgaccaaagacctgctgcaatcaaagaggttccaggcacaatccttagggacaacatacatatatgatatcccagagatgtttcggcagtccctgatcaaactctgggagtctatgtccactcaagcatttcttccatctccccctctgccttctgacatgctgacttacactgaactggtactggatgatcaaggtcagctggtccacatgaacaggcttccaggaggaaatgagattggcatggtagcttggaaaatgacctttaaaagtcctgaatatccagaaggccgagatatcattgttattggcaatgacatcacataccgaattgggtcctttgggcctcaagaggatttgttatttctcagagcttccgaacttgctagggcagaaggtattccacgcatctatgtatcagccaacagtggagcaagaatcggactggcagaagaaattcgccatatgtttcatgtggcctgggtagatcctgaggatccttacaagggatacaggtatttatatctgactcctcaagattataagagagtcagtgctctcaactctgtccattgtgaacacgtggaagatgaaggagaatccaggtacaagataacagatattattgggaaagaagagggaattggacccgagaaccttcgaggttctggaatgattgctggagaatcctcattggcctataatgagatcattaccatcagcctggtgacgtgccgggccattgggattggggcttaccttgtccggctgggacagagaaccatccaggttgagaattctcacttaattctaacaggagctggagccctcaacaaagtcctcgggcgggaagtgtacacctccaataaccagctggggggcatccagattatgcacaacaatggggtgacccactgcactgtgtgtgatgactttgaaggggttttcactgtcctgcactggctgtcttacatgcccaagagcgtgcacagttcagttcctcttctgaactcaaaggatcctatagacagaatcatcgagtttgttcccacaaagaccccatacgatcctcgatggatgctagcaggccgtcctcacccaacccaaaaaggtcagtggttgagtggcttttttgactatggatctttctcagagattatgcagccctgggcacagactgtggtggttggtagagccaggctaggaggaatacctgtgggagttgttgctgtagaaacccgaacagtagaactaagtatcccagctgatccagcaaacctggattctgaagccaagataatccagcaggctggccaggtttggttcccagattctgcgtttaagacgtatcaggccatcaaggacttcaaccgggaagggctgcctctgatggtctttgccaactggagaggcttctctggtggaatgaaagatatgtacgaccaagtgctgaagtttggtgcttacattgtggatggcttgagggagtgctgccagcctgtgctggtttacattcctccccaggctgagctgcggggtggctcctgggtggtgattgactcctccatcaacccccggcacatggagatgtatgctgaccgagaaagcaggggatctgttctggagccagaagggacagtagaaatcaaattccgcagaaaggatctggtgaaaaccatgcgtcgggtggacccagtctacatccacttggctgagcgattggggaccccagagctaagcacagctgagcggaaggagttggagaacaagttgaaggagcgggaggaattcctaattcccatttaccatcaggtagccgtgcagtttgctgacttgcacgacacaccaggccggatgcaggagaagggtgttattagcgatatcctggattggaaaacatcccgtaccttcttctactggcggctgaggcgtcttctgctggaggacctggtcaagaagaaaatccacaatgccaaccctgagctgactgatggccagattcaagccatgttaaggcgctggtttgtggaagtggaaggaacagtgaaggcttatgtttgggacaataataaggatctggcggagtggctagagaaacagctgacagaggaggatggtgttcactcggtaatagaggaaaacatcaaatgcatcagcagagactacgtcctcaagcaaatccgcagcttggtccaggccaatccagaggttgccatggattccatcatccatatgacgcagcacatatcacccactcagcgagcagaagtcatacggatcctctccacaatggattccccttccacgtaggaagagcttcctgcctgtccctgccctgtctctggagaaaagggctagagctgccttttacaactgtaaccactgtaatgagaaggcacaggagacccagcactggagtcaaatggcattttacttcctctcgtttcaggttatgcatgacatcctgggatgtaagatcacagaatccccctccagcccaccagtcacacctaccccattcagtatttattaccctggccaggcctagtcctccactccctgcacaggactgagaaggcaatgaaaggtacaaacatgtaccatgaggtcttactaaccaaagtagggctgcccctcctgtcctgacagccccttggcctcccagcatggggaagcgtgaggagttgcccagcagtgagcagcccccctcactcctggccccatgagccgcagccacaggcagcagaggagggctaaggagaggaggaagcctcaagtccattgtttattaccccgactcttagcccagcacacagtaggcactggagaggaatgattcccagtttaaccacactacggtaccttttatgaagaaaaattagagcataaaatctactacaagctccataggaactcaaagatgagggcaaaactgtgagccaagaagcagagaaagaaaatagaaccagttattcttgatttaggggacctcaaccttgggttcagtctctgaggacaaagggaaaggtagttgttggcctgcctctcgcctgcacgtcactgctggactagctgtcgcatgtggctgggagctgcaaggccagtgcttgaggggccccagcagttccacaggtggtgaagcctgagttggcagaggaggagccagaagagaactgccctttctgcactggtggaaactagttatttatgccatgtggagagccagtgagatagatagatagtctgtttgttttgaggacttggaaagttgttcctatgaagcctggagcttggatggttttgagaggttaatggtgcctccacactcactcttccctagttccaggattactgtcctagcagctaacggttctactctcttccccagagtgtagacaggcagcaggtctccccacagctctgaaaggaccctggtgacagctacaccctcagcaccaggagctggccttcctgatgagggaggcttccaggaaacacagaatccacatgaccttaagattatttacaactcagtcatggtgctgctgtcctccaggcttactggcccctcctgactggcatcaggggcttcctcaggtggtggagagagtttactttcaacaactagtttattcaagaaaagaacttactgattcctctgttcctaaagcaagagtggcaggtgatcagggctggtgtagcatccggttcctttagtgcagctaactgcatttgtcactgatgaccaaggaggaaatcactaagacatttgagaagcagtggtatgaacgttcttggacaagccacagttctgagccttaaccctgtagtttgcacacaagaacgagctccacctccccttcttcaggaggaatctgtgcggatagattggctggacttttcaatggttctgggttgcaggtgggcactgtatggctgggtatggagcggacagcccccaggagtcagagcctcagcccggctgccctggtggaaggtacaggtgttcagcaccttcagaaaagggcataaagtggtgggggacaattctcagtccaggaaaatgcattgaccattgctggctatttgcttacctagtaagaattggattcatttttgaccagattattcttctatgcttttttgcaataaatcaaatcccacatatctacaagtggtatgaagtcctgcaccccccaggaggcctgtccaggcatgtcttcagaggcagggtgggttacactcatttacctcccctctccccaccaaattatgacacaaacgagtatgtttcctctctagaaccctgtaatgcctcctcccccatccccagagctccttactgtaggtcttaccctggacaaggattttttcaagttggaggcacagaacatgagcaatctgacattcccacagcccctcaaacatgcaaggctactaaggcaggaggagtataaatgatggatattgaccaagacctgcttggacggagaccgccatattatctgttctcttcgttcacaaaacagccttcacttgtctcagaatttgatggacacatactgtgatgagcaggagcttcagatgcactctttacacattttgttgaaataaacctctacatttgtagaagagtta

SEQ ID NO: 103722 - DNA, 9554 bp, Homo sapiens
  Payload ID: 385
  Gene Symbol: ACACA
  Gene Name: acetyl-CoA carboxylase alpha
  Uniprot ID: Q13085
  ENST ID: ENST00000613687
  CDS Start-End: 192-7232
cggcctggtgctgcacgcctgtcagccatcgcccgagccgccggcgtctcctcccgcccagcagttcctccacgcaggggctccggaatcgcccgaccgcacacgttgccaccctgaggtctttctggaagtggatatctactcagacagtaagaattataagagctgtaagagctcattttggaggaataatggatgaaccatctcccttggcccaacctctggagctgaaccagcactctcgattcataataggttctgtgtctgaagataactcagaggatgagatcagcaacctggtgaagttggacctactggaggagaaggagggctccttgtcacctgcttctgttggctcagatacactctctgatttggggatctctagcctacaggatggcttggccttgcacataaggtccagcatgtctggcttgcacctagtaaagcagggccgagacagaaagaaaatagattctcaacgagatttcactgtggcttctccagcagaatttgttactcgctttgggggaaataaagtgattgagaaggttcttattgctaacaatggcattgcagcagtgaaatgcatgcggtctatccgtaggtggtcttatgaaatgtttcgaaatgaacgtgcaattagattcgttgtcatggtcacacctgaagaccttaaagccaatgcagaatacattaagatggcagatcactatgtgccagtgcctggaggaccaaacaacaacaactatgcaaatgtggaattaattcttgatattgctaaaaggatcccagtacaagcagtgtgggctggctggggtcatgcttctgagaatcccaaactaccggaacttctcttgaaaaatggcattgccttcatgggtcctccaagccaggccatgtgggctttaggggataagattgcatcttccatagtggctcaaactgcaggtatcccaactcttccctggagcggcagtggtcttcgtgtggactggcaggaaaatgatttttcaaaacgtatcttaaatgttccccaggagctatatgaaaaaggttatgtgaaagatgtggatgatgggctacaggcagctgaggaagttggatatccagtaatgatcaaggcctcagagggaggaggagggaagggaattagaaaagtcaacaatgcagatgacttccctaatctcttcagacaggttcaagctgaagttcctggatctcccatatttgtgatgagactagccaaacaatctcgtcatctggaggtgcagatcttagcggaccaatatggcaatgctatctctttgtttggtcgtgattgctctgtacaacgcaggcatcagaagattattgaagaagcacctgctactattgctactccagcagtatttgaacacatggaacagtgtgcggtgaaacttgccaaaatggtgggttatgtgagtgctgggactgtggaatacctgtacagccaggatggcagcttctactttctggaattgaatcctcggctgcaggtagagcacccttgtacagagatggtggctgatgtcaatctccctgcagcacagctccagattgccatggggattcctctatatagaatcaaggatatccgtatgatgtatggggtatctccctggggtgattctcccattgattttgaagattctgcacacgttccttgtccaaggggccatgttattgctgctcggatcactagtgaaaatccagatgagggttttaagcccagctcaggaacagttcaggagctaaatttccgcagcaataagaatgtttggggatatttcagtgttgctgctgcagggggacttcatgaatttgctgattctcagtttggtcactgcttttcttggggagaaaacagagaagaggcaatttcaaacatggtggtggctttgaaggagctgtctattcggggtgactttcgaactacagttgaatacctgatcaaattgttagagactgaaagctttcagatgaacagaattgatactggctggctggacagactgatagcagaaaaagtacaggctgagcgacctgacaccatgttgggggttgtgtgtggtgccctccacgtggcagatgtgagcctgcggaatagcgtctctaacttccttcactccttagaaaggggtcaagtccttcctgctcatacacttctgaatacagtagatgttgaacttatctatgagggagtcaagtatgtacttaaggtgactcgacagtcccccaactcctatgtggtgatcatgaatggctcatgtgtagaagtagatgtacatcggctgagtgacggtggactgctcttgtcctatgatggcagcagttatactacgtatatgaaagaggaagtggatagatatcgcatcacaattggcaataaaacctgtgtgtttgagaaggaaaatgacccatcggtgatgcgctcaccttctgctgggaagttaatccagtacattgtagaagatggaggtcatgtgtttgccggccagtgctatgctgagattgaggtaatgaagatggtaatgaccttaacagctgtggagtctggctgtatccattacgtcaagcgacctggagcagctcttgaccctggctgtgtactagccaaaatgcaactggacaaccccagcaaggttcagcaggctgaacttcacacaggtagtctgccacggatccagagcacggcactcagaggcgagaaactccatcgagtgttccattatgtcctggataatctggtcaatgtaatgaatggatactgccttccagatcctttctttagcagcaaggtaaaagactgggtagagcgattgatgaaaaccctcagagatccctccctgcctctcctagaattgcaagatattatgaccagtgtgtctggccgcattccccccaatgtggagaagtctatcaagaaggaaatggctcagtatgctagcaacatcacatcagtcctctgtcagtttcccagccagcagattgcaaacatcctagatagccatgcagctacattgaaccggaaatctgaacgggaagtcttctttatgaatactcagagcattgttcagctggtacagaggtaccgaagtggcatccgaggccacatgaaggctgtggtgatggatctgctccggcagtacctgcgagtagagacacaattccagaatggtcactatgacaaatgtgtattcgccctccgagaagagaataaaagtgacatgaacactgtactgaactacatcttctctcacgctcaagtcaccaagaagaatcttctggtcacaatgcttattgatcagttgtgtggccgggaccctactctcactgatgagctgctgaatattctcacagagctaactcaactcagtaagaccaccaatgccaaagtagcacttcgagcacgccaggttcttattgcctcccatttgccatcatatgagcttcgccataaccaagtagagtctatcttcctatcagctattgacatgtatggacatcaattttgcattgagaacctgcagaaactcatcctatcagaaacatctatttttgatgtcctaccaaacttcttctatcacagcaaccaagtagtgaggatggcagctctggaggtgtatgttcgaagggcttatattgcctatgaacttaacagcgtacaacaccgccagcttaaggacaacacctgtgtggtggaattccagttcatgctgcccacatctcatccaaacagagggaacatccctacgctaaacagaatgtccttctcctccaacctcaaccactatggcatgacccatgtagctagtgtcagcgatgtactgttggacaactcattcactccaccttgtcagcggatgggcggaatggtctcttttcggacttttgaagattttgtcaggatctttgatgaagtgatgggctgcttctctgactccccaccccagagtcccacattccctgaggcaggtcacacgtctctttatgatgaggataaggttcccagggatgaaccaattcacattctcaatgtggctatcaagactgactgtgatattgaggatgacaggctggcagctatgttcagagaatttacccagcaaaataaagctaccctggttgaccatgggatccggcgccttactttcctggttgcacaaaaggatttcagaaagcaggtcaactatgaggtggatcggagatttcatagagaattccctaaattttttacattccgagcaagggataagtttgaggaggatcgtatctatcgtcatctggagcctgctctggctttccagttagagctgaaccggatgagaaattttgacctcactgccattccatgtgctaatcacaagatgcacctgtatctcggggcagccaaggtggaagtgggcacagaagtgacagactacaggttctttgttcgtgcaatcatcaggcattctgatctggtcaccaaggaagcttcttttgaatatctgcaaaatgaaggggagcggctactcctggaagccatggatgagttggaagttgcttttaacaatacaaatgtccgcactgactgtaaccacatcttcctcaactttgtgcccacggttatcatggacccatcaaagattgaggaatccgtgcggagcatggtaatgcggtatggaagtcgcctgtggaaattgcgcgtcctccaggcagaactgaaaatcaacattcgcctgacgccaactggaaaagcaattcccatccgcctcttcctgacaaacgagtctggctattacttggatatcagcctatacaaggaagtgactgactccaggacagcacagatcatgtttcaggcatatggagacaaacagggaccactgcatggaatgttaatcaatactccatatgtgaccaaagacctgctgcaatcaaagaggttccaggcacaatccttagggacaacatacatatatgatatcccagagatgtttcggcagtccctgatcaaactctgggagtctatgtccactcaagcatttcttccatctccccctctgccttctgacatgctgacttacactgaactggtactggatgatcaaggtcagctggtccacatgaacaggcttccaggaggaaatgagattggcatggtagcttggaaaatgacctttaaaagtcctgaatatccagaaggccgagatatcattgttattggcaatgacatcacataccgaattgggtcctttgggcctcaagaggatttgttatttctcagagcttccgaacttgctagggcagaaggtattccacgcatctatgtatcagccaacagtggagcaagaatcggactggcagaagaaattcgccatatgtttcatgtggcctgggtagatcctgaggatccttacaagggatacaggtatttatatctgactcctcaagattataagagagtcagtgctctcaactctgtccattgtgaacacgtggaagatgaaggagaatccaggtacaagataacagatattattgggaaagaagagggaattggacccgagaaccttcgaggttctggaatgattgctggagaatcctcattggcctataatgagatcattaccatcagcctggtgacgtgccgggccattgggattggggcttaccttgtccggctgggacagagaaccatccaggttgagaattctcacttaattctaacaggagctggagccctcaacaaagtcctcgggcgggaagtgtacacctccaataaccagctggggggcatccagattatgcacaacaatggggtgacccactgcactgtgtgtgatgactttgaaggggttttcactgtcctgcactggctgtcttacatgcccaagagcgtgcacagttcagttcctcttctgaactcaaaggatcctatagacagaatcatcgagtttgttcccacaaagaccccatacgatcctcgatggatgctagcaggccgtcctcacccaacccaaaaaggtcagtggttgagtggcttttttgactatggatctttctcagagattatgcagccctgggcacagactgtggtggttggtagagccaggctaggaggaatacctgtgggagttgttgctgtagaaacccgaacagtagaactaagtatcccagctgatccagcaaacctggattctgaagccaagataatccagcaggctggccaggtttggttcccagattctgcgtttaagacgtatcaggccatcaaggacttcaaccgggaagggctgcctctgatggtctttgccaactggagaggcttctctggtggaatgaaagatatgtacgaccaagtgctgaagtttggtgcttacattgtggatggcttgagggagtgctgccagcctgtgctggtttacattcctccccaggctgagctgcggggtggctcctgggtggtgattgactcctccatcaacccccggcacatggagatgtatgctgaccgagaaagcaggggatctgttctggagccagaagggacagtagaaatcaaattccgcagaaaggatctggtgaaaaccatgcgtcgggtggacccagtctacatccacttggctgagcgattggggaccccagagctaagcacagctgagcggaaggagttggagaacaagttgaaggagcgggaggaattcctaattcccatttaccatcaggtagccgtgcagtttgctgacttgcacgacacaccaggccggatgcaggagaagggtgttattagcgatatcctggattggaaaacatcccgtaccttcttctactggcggctgaggcgtcttctgctggaggacctggtcaagaagaaaatccacaatgccaaccctgagctgactgatggccagattcaagccatgttaaggcgctggtttgtggaagtggaaggaacagtgaaggcttatgtttgggacaataataaggatctggcggagtggctagagaaacagctgacagaggaggatggtgttcactcggtaatagaggaaaacatcaaatgcatcagcagagactacgtcctcaagcaaatccgcagcttggtccaggccaatccagaggttgccatggattccatcatccatatgacgcagcacatatcacccactcagcgagcagaagtcatacggatcctctccacaatggattccccttccacgtaggaagagcttcctgcctgtccctgccctgtctctggagaaaagggctagagctgccttttacaactgtaaccactgtaatgagaaggcacaggagacccagcactggagtcaaatggcattttacttcctctcgtttcaggttatgcatgacatcctgggatgtaagatcacagaatccccctccagcccaccagtcacacctaccccattcagtatttattaccctggccaggcctagtcctccactccctgcacaggactgagaaggcaatgaaaggtacaaacatgtaccatgaggtcttactaaccaaagtagggctgcccctcctgtcctgacagccccttggcctcccagcatggggaagcgtgaggagttgcccagcagtgagcagcccccctcactcctggccccatgagccgcagccacaggcagcagaggagggctaaggagaggaggaagcctcaagtccattgtttattaccccgactcttagcccagcacacagtaggcactggagaggaatgattcccagtttaaccacactacggtaccttttatgaagaaaaattagagcataaaatctactacaagctccataggaactcaaagatgagggcaaaactgtgagccaagaagcagagaaagaaaatagaaccagttattcttgatttaggggacctcaaccttgggttcagtctctgaggacaaagggaaaggtagttgttggcctgcctctcgcctgcacgtcactgctggactagctgtcgcatgtggctgggagctgcaaggccagtgcttgaggggccccagcagttccacaggtggtgaagcctgagttggcagaggaggagccagaagagaactgccctttctgcactggtggaaactagttatttatgccatgtggagagccagtgagatagatagatagtctgtttgttttgaggacttggaaagttgttcctatgaagcctggagcttggatggttttgagaggttaatggtgcctccacactcactcttccctagttccaggattactgtcctagcagctaacggttctactctcttccccagagtgtagacaggcagcaggtctccccacagctctgaaaggaccctggtgacagctacaccctcagcaccaggagctggccttcctgatgagggaggcttccaggaaacacagaatccacatgaccttaagattatttacaactcagtcatggtgctgctgtcctccaggcttactggcccctcctgactggcatcaggggcttcctcaggtggtggagagagtttactttcaacaactagtttattcaagaaaagaacttactgattcctctgttcctaaagcaagagtggcaggtgatcagggctggtgtagcatccggttcctttagtgcagctaactgcatttgtcactgatgaccaaggaggaaatcactaagacatttgagaagcagtggtatgaacgttcttggacaagccacagttctgagccttaaccctgtagtttgcacacaagaacgagctccacctccccttcttcaggaggaatctgtgcggatagattggctggacttttcaatggttctgggttgcaggtgggcactgtatggctgggtatggagcggacagcccccaggagtcagagcctcagcccggctgccctggtggaaggtacaggtgttcagcaccttcagaaaagggcataaagtggtgggggacaattctcagtccaggaaaatgcattgaccattgctggctatttgcttacctagtaagaattggattcatttttgaccagattattcttctatgcttttttgcaataaatcaaatcccacatatctacaagtggtatgaagtcctgcaccccccaggaggcctgtccaggcatgtcttcagaggcagggtgggttacactcatttacctcccctctccccaccaaattatgacacaaacgagtatgtttcctctctagaaccctgtaatgcctcctcccccatccccagagctccttactgtaggtcttaccctggacaaggattttttcaagttggaggcacagaacatgagcaatctgacattcccacagcccctcaaacatgcaaggctactaaggcaggaggagtataaatgatggatattgaccaagacctgcttggacggagaccgccatattatctgttctcttcgttcacaaaacagccttcacttgtctcagaatttgatggacacatactgtgatgagcaggagcttcagatgcactctttacacattttgttgaaataaacctctacatttgtagaa

SEQ ID NO: 103723 - DNA, 551 bp, Homo sapiens
  Payload ID: 385
  Gene Symbol: ACACA
  Gene Name: acetyl-CoA carboxylase alpha
  ENST ID: ENST00000621960
  CDS Start-End: 269-551
gtcagccatcgcccgagccgccggcgtctcctcccgcccagcagttcctccacgcaggggctccggaatcgcccgaccgcacacgttgccaccctgaggttctgtgtctgaagataactcagaggatgagatcagcaacctggtgaagttggacctactggaggagaaggagggctccttgtcacctgcttctgttggctcagatacactctctgatttggggatctctagcctacaggatggcttggccttgcacataaggtccagcatgtctggcttgcacctagtaaagcagggccgagacagaaagaaaatagattctcaacgagatttcactgtggcttctccagcagaatttgttactcgctttgggggaaataaagtgattgagaaggttcttattgctaacaatggcattgcagcagtgaaatgcatgcggtctatccgtaggtggtcttatgaaatgtttcgaaatgaacgtgcaattagattcgttgtcatggtcacacctgaagaccttaaagccaatgcagaatacattaagatggcag

SEQ ID NO: 103724 - DNA, 569 bp, Homo sapiens
  Payload ID: 385
  Gene Symbol: ACACA
  Gene Name: acetyl-CoA carboxylase alpha
  ENST ID: ENST00000614438
  CDS Start-End: 1-339
atggatgaaccatctcccttggcccaacctctggagctgaaccagcactctcgattcataataggttctgtgtctgaagataactcagaggatgagatcagcaacctggtgaagttggacctactggaggagaaggagggctccttgtcacctgcttctgttggctcagatacactctctgatttggggatctctagcctacaggatggcttggccttgcacataagttcttggattaaaaggtctggatcagtggttcttggttctcactgttcatcagaatcacctcggggagccttgggagataagccccatccccagagatttcgattcatttgatactggcttggtgtggaactggggcttttttttaaggtatccaggtgattgttgtgtacagccagcattcagattataggtgtaccctagataacataagttagggtggctgttgttgctgttactatcttggcacctttattattaatgggtcataaaataattcagctctattttatacactaaatatatcaactctataataaaatcctgtatgagatctggctgga

SEQ ID NO: 103725 - DNA, 5315 bp, Homo sapiens
  Payload ID: 385
  Gene Symbol: ACACA
  Gene Name: acetyl-CoA carboxylase alpha
  ENST ID: ENST00000619546
  CDS Start-End: 1-2997
gaggatgacaggctggcagctatgttcagagaatttacccagcaaaataaagctaccctggttgaccatgggatccggcgccttactttcctggttgcacaaaaggatttcagaaagcaggtcaactatgaggtggatcggagatttcatagagaattccctaaattttttacattccgagcaagggataagtttgaggaggatcgtatctatcgtcatctggagcctgctctggctttccagttagagctgaaccggatgagaaattttgacctcactgccattccatgtgctaatcacaagatgcacctgtatctcggggcagccaaggtggaagtgggcacagaagtgacagactacaggttctttgttcgtgcaatcatcaggcattctgatctggtcaccaaggaagcttcttttgaatatctgcaaaatgaaggggagcggctactcctggaagccatggatgagttggaagttgcttttaacaatacaaatgtccgcactgactgtaaccacatcttcctcaactttgtgcccacggttatcatggacccatcaaagattgaggaatccgtgcggagcatggtaatgcggtatggaagtcgcctgtggaaattgcgcgtcctccaggcagaactgaaaatcaacattcgcctgacgccaactggaaaagcaattcccatccgcctcttcctgacaaacgagtctggctattacttggatatcagcctatacaaggaagtgactgactccaggacagcacagatcatgtttcaggcatatggagacaaacagggaccactgcatggaatgttaatcaatactccatatgtgaccaaagacctgctgcaatcaaagaggttccaggcacaatccttagggacaacatacatatatgatatcccagagatgtttcggcagattggcatggtagcttggaaaatgacctttaaaagtcctgaatatccagaaggccgagatatcattgttattggcaatgacatcacataccgaattgggtcctttgggcctcaagaggatttgttatttctcagagcttccgaacttgctagggcagaaggtattccacgcatctatgtatcagccaacagtggagcaagaatcggactggcagaagaaattcgccatatgtttcatgtggcctgggtagatcctgaggatccttacaagggatacaggtatttatatctgactcctcaagattataagagagtcagtgctctcaactctgtccattgtgaacacgtggaagatgaaggagaatccaggtacaagataacagatattattgggaaagaagagggaattggacccgagaaccttcgaggttctggaatgattgctggagaatcctcattggcctataatgagatcattaccatcagcctggtgacgtgccgggccattgggattggggcttaccttgtccggctgggacagagaaccatccaggttgagaattctcacttaattctaacaggagctggagccctcaacaaagtcctcgggcgggaagtgtacacctccaataaccagctggggggcatccagattatgcacaacaatggggtgacccactgcactgtgtgtgatgactttgaaggggttttcactgtcctgcactggctgtcttacatgcccaagagcgtgcacagttcagttcctcttctgaactcaaaggatcctatagacagaatcatcgagtttgttcccacaaagaccccatacgatcctcgatggatgctagcaggccgtcctcacccaacccaaaaaggtcagtggttgagtggcttttttgactatggatctttctcagagattatgcagccctgggcacagactgtggtggttggtagagccaggctaggaggaatacctgtgggagttgttgctgtagaaacccgaacagtagaactaagtatcccagctgatccagcaaacctggattctgaagccaagataatccagcaggctggccaggtttggttcccagattctgcgtttaagacgtatcaggccatcaaggacttcaaccgggaagggctgcctctgatggtctttgccaactggagaggcttctctggtggaatgaaagatatgtacgaccaagtgctgaagtttggtgcttacattgtggatggcttgagggagtgctgccagcctgtgctggtttacattcctccccaggctgagctgcggggtggctcctgggtggtgattgactcctccatcaacccccggcacatggagatgtatgctgaccgagaaagcaggggatctgttctggagccagaagggacagtagaaatcaaattccgcagaaaggatctggtgaaaaccatgcgtcgggtggacccagtctacatccacttggctgagcgattggggaccccagagctaagcacagctgagcggaaggagttggagaacaagttgaaggagcgggaggaattcctaattcccatttaccatcaggtagccgtgcagtttgctgacttgcacgacacaccaggccggatgcaggagaagggtgttattagcgatatcctggattggaaaacatcccgtaccttcttctactggcggctgaggcgtcttctgctggaggacctggtcaagaagaaaatccacaatgccaaccctgagctgactgatggccagattcaagccatgttaaggcgctggtttgtggaagtggaaggaacagtgaaggcttatgtttgggacaataataaggatctggcggagtggctagagaaacagctgacagaggaggatggtgttcactcggtaatagaggaaaacatcaaatgcatcagcagagactacgtcctcaagcaaatccgcagcttggtccaggccaatccagaggttgccatggattccatcatccatatgacgcagcacatatcacccactcagcgagcagaagtcatacggatcctctccacaatggattccccttccacgtaggaagagcttcctgcctgtccctgccctgtctctggagaaaagggctagagctgccttttacaactgtaaccactgtaatgagaaggcacaggagacccagcactggagtcaaatggcattttacttcctctcgtttcaggttatgcatgacatcctgggatgtaagatcacagaatccccctccagcccaccagtcacacctaccccattcagtatttattaccctggccaggcctagtcctccactccctgcacaggactgagaaggcaatgaaaggtacaaacatgtaccatgaggtcttactaaccaaagtagggctgcccctcctgtcctgacagccccttggcctcccagcatggggaagcgtgaggagttgcccagcagtgagcagcccccctcactcctggccccatgagccgcagccacaggcagcagaggagggctaaggagaggaggaagcctcaagtccattgtttattaccccgactcttagcccagcacacagtaggcactggagaggaatgattcccagtttaaccacactacggtaccttttatgaagaaaaattagagcataaaatctactacaagctccataggaactcaaagatgagggcaaaactgtgagccaagaagcagagaaagaaaatagaaccagttattcttgatttaggggacctcaaccttgggttcagtctctgaggacaaagggaaaggtagttgttggcctgcctctcgcctgcacgtcactgctggactagctgtcgcatgtggctgggagctgcaaggccagtgcttgaggggccccagcagttccacaggtggtgaagcctgagttggcagaggaggagccagaagagaactgccctttctgcactggtggaaactagttatttatgccatgtggagagccagtgagatagatagatagtctgtttgttttgaggacttggaaagttgttcctatgaagcctggagcttggatggttttgagaggttaatggtgcctccacactcactcttccctagttccaggattactgtcctagcagctaacggttctactctcttccccagagtgtagacaggcagcaggtctccccacagctctgaaaggaccctggtgacagctacaccctcagcaccaggagctggccttcctgatgagggaggcttccaggaaacacagaatccacatgaccttaagattatttacaactcagtcatggtgctgctgtcctccaggcttactggcccctcctgactggcatcaggggcttcctcaggtggtggagagagtttactttcaacaactagtttattcaagaaaagaacttactgattcctctgttcctaaagcaagagtggcaggtgatcagggctggtgtagcatccggttcctttagtgcagctaactgcatttgtcactgatgaccaaggaggaaatcactaagacatttgagaagcagtggtatgaacgttcttggacaagccacagttctgagccttaaccctgtagtttgcacacaagaacgagctccacctccccttcttcaggaggaatctgtgcggatagattggctggacttttcaatggttctgggttgcaggtgggcactgtatggctgggtatggagcggacagcccccaggagtcagagcctcagcccggctgccctggtggaaggtacaggtgttcagcaccttcagaaaagggcataaagtggtgggggacaattctcagtccaggaaaatgcattgaccattgctggctatttgcttacctagtaagaattggattcatttttgaccagattattcttctatgcttttttgcaataaatcaaatcccacatatctacaagtggtatgaagtcctgcaccccccaggaggcctgtccaggcatgtcttcagaggcagggtgggttacactcatttacctcccctctccccaccaaattatgacacaaacgagtatgtttcctctctagaaccctgtaatgcctcctcccccatccccagagctccttactgtaggtcttaccctggacaaggattttttcaagttggaggcacagaacatgagcaatctgacattcccacagcccctcaaacatgcaaggctactaaggcaggaggagtataaatgatggatattgaccaagacctgcttggacggagaccgccatattatctgttctcttcgttcacaaaacagccttcacttgtctcagaatttgatggacacatactgtgatgagcaggagcttcagatgcactctttacacattttgttgaaataaacctctacatttgt

SEQ ID NO: 103726 - DNA, 451 bp, Homo sapiens
  Payload ID: 385
  Gene Symbol: ACACA
  Gene Name: acetyl-CoA carboxylase alpha
  ENST ID: ENST00000612007
  CDS Start-End: 200-451
aggcactgactttcttgatgaattctgtccatctgtaaagcagctatatatcccactggaggctttgcctctcagagacaacgtgaagacggataagcaggcatcaggagcagagtggcctctcaggtctttttggaagtggatatctactcagacagtaagaattataagagctgtaagagctcattttggaggaataatggatgaaccatctcccttggcccaacctctggagctgaaccagcactctcgattcataataggttctgtgtctgaagataactcagaggatgagatcagcaacctggtgaagttggacctactggaggagaaggagggctccttgtcacctgcttctgttggctcagatacactctctgatttggggatctctagcctacaggatggcttggccttgcacataagttcttggattaaaaggtctggatca

SEQ ID NO: 103727 - DNA, 1627 bp, Homo sapiens
  Payload ID: 385
  Gene Symbol: ACACA
  Gene Name: acetyl-CoA carboxylase alpha
  ENST ID: ENST00000632361
  CDS Start-End: 1268-1627
gccctcttggccttttcccggtccccgccgcgcgcctgctgctgtccccgtgcccgaggactgggaggatggggctgagccgcttgcctgacttttgatccgaccagtaatcactttgcccgtgtggcgcgtggcccgttgcctgaggcttcctggcgcgtggggctgtttggtcccctccggagtgcggtgaggcgggccgagccgggactgcctgggtttggggataacgttcccatctccacccctgttgcagcaagggaaattgaggctgagggaactgggcccagggacggcgagccgtggctgcctctccagtccgggccccgaagggctgctcgtggatgaaccagactgattttaaggggtgaagagggtgcgtttcaatcagatgcttctggaacgtcgaaattgtcttctttggaaagaaccatcccctctttgggcttcagaggcccaaattgaggcgcaatgatgagaggatgtggtggtctactctgatgtcaatcttgagggctagggtcttgctatgtcacccagcctggagtggaattgtgtgatcaagactcactgaagcctccaactcctgggctcaagcaatcctcccacctcagccacccaagtagctgggactacaggctggagtgcaatggcatgatcttggctcactgcaacctccgcctcccggattcaacggattctcctgcctcagcctcctgagtagctgggattataggtgcctgccacaacacccaggaccagacttatgaagtggccttcctgaggagattttctgaccttatggtatgaagttccttcaggctcttaattctggataaactggagtgattaacaagagcaaagagacatagtattcagataaggactttgtgtcttatttttcttttatatcacaactggagccacagttgtgggcaaggcactgactttcttgatgaattctgtccatctgtaaagcagctatatatcccactggaggctttgcctctcagagacaacgtgaagacggataagcaggcatcaggagcagagtggcctctcagctggtcagattctccgaagaaggatcctctaggctgggcacggtggctcacacctataatcccagcactttgggaggccgaggcaggtggatcacgaggtcaggagttcgaggccagcctggccaatatggtctttctggaagtggatatctactcagacagtaagaattataagagctgtaagagctcattttggaggaataatggatgaaccatctcccttggcccaacctctggagctgaaccagcactctcgattcataataggttctgtgtctgaagataactcagaggatgagatcagcaacctggtgaagttggacctactggaggagaaggagggctccttgtcacctgcttctgttggctcagatacactctctgatttggggatctctagcctacaggatggcttggccttgcacataaggtccagcatgtctggcttgcacctagtaaagcagggccgagacagaaagaaaatagattctcaacgagatttcactgtggcttctccagcagaatttgttactcgctttgggggaaataaagtgattgagaag

SEQ ID NO: 103728 - DNA, 1469 bp, Homo sapiens
  Payload ID: 385
  Gene Symbol: ACACA
  Gene Name: acetyl-CoA carboxylase alpha
  ENST ID: ENST00000633050
  CDS Start-End: 375-719
aatcactttgcccgtgtggcgcgtggcccgttgcctgaggcttcctggcgcgtggggctgtttggtcccctccggagtgcggtgaggcgggccgagccgggactgcctgggtttggggataacgttcccatctccacccctgttgcagcaagggaaattgaggctgagggaactgggcccagggacggcgagccgtggctgcctctccagtccgggccccgaagggctgctcgtggatgaaccagactgattttaaggggtgaagagggtgcgtttcaatcagatgcttctggaacgtcgaaattgtcttctttggaaagaaccatcccctctttgggcttcagaggcccaaattgaggcgcaatgatgagaggatgtggtggtctactctgatgtcaatcttgagggctaggtctttctggaagtggatatctactcagacagtaagaattataagagctgtaagagctcattttggaggaataatggatgaaccatctcccttggcccaacctctggagctgaaccagcactctcgattcataataggttctgtgtctgaagataactcagaggatgagatcagcaacctggtgaagttggacctactggaggagaaggagggctccttgtcacctgcttctgttggctcagatacactctctgatttggggatctctagcctacaggatggcttggccttgcacataagactttgaaatactcgtgggatatgaagtggaggtgcctagagggttgaagataatgaggacagatgaagaaatgtttgattgtgccatacttacagttgctgattttcaaggtccagcatgtctggcttgcacctagtaaagcagggccgagacagaaagaaaatagattctcaacgagatttcactgtggcttctccagcagaatttgttactcgctttgggggaaataaagtgattgagaaggttcttattgctaacaatggcattgcagcagtgaaatgcatgcggtctatccgtaggtggtcttatgaaatgtttcgaaatgaacgtgcaattagattcgttgtcatggtcacacctgaagaccttaaagccaatgcagaatacattaagatggcagatcactatgtgccagtgcctggaggaccaaacaacaacaactatgcaaatgtggaattaattcttgatattgctaaaaggatcccagtacaagcagtgtgggctggctggggtcatgcttctgagaatcccaaactaccggaacttctcttgaaaaatggcattgccttcatgggtcctccaagccaggccatgtgggctttaggggataagattgcatcttccatagtggctcaaactgcaggtatcccaactcttccctggagcggcagtggtcttcgtgtggactggcaggaaaatgatttttcaaaacgtatcttaaatgttccccaggagctatatgaaaaaggttatgtg

SEQ ID NO: 103729 - DNA, 551 bp, Homo sapiens; identical to SEQ ID NO: 103723
  Payload ID: 385
  Gene Symbol: ACACA
  Gene Name: acetyl-CoA carboxylase alpha
  ENST ID: ENST00000632486
  CDS Start-End: 269-551

SEQ ID NO: 103730 - DNA, 463 bp, Homo sapiens; identical to SEQ ID NO: 103717
  Payload ID: 385
  Gene Symbol: ACACA
  Gene Name: acetyl-CoA carboxylase alpha
  ENST ID: ENST00000631953
  CDS Start-End: 1-290

SEQ ID NO: 103731 - DNA, 451 bp, Homo sapiens
  Payload ID: 385
  Gene Symbol: ACACA
  Gene Name: acetyl-CoA carboxylase alpha
  ENST ID: ENST00000633325
  CDS Start-End: 200-451
aggcactgactttcttgatgaattctgtccatctgtaaagcagctatatatcccactggaggctttgcctctcagagacaacgtgaagacggataagcaggcatcaggagcagagtggcctctcaggtctttctggaagtggatatctactcagacagtaagaattataagagctgtaagagctcattttggaggaataatggatgaaccatctcccttggcccaacctctggagctgaaccagcactctcgattcataataggttctgtgtctgaagataactcagaggatgagatcagcaacctggtgaagttggacctactggaggagaaggagggctccttgtcacctgcttctgttggctcagatacactctctgatttggggatctctagcctacaggatggcttggccttgcacataagttcttggattaaaaggtctggatca

SEQ ID NO: 103732 - DNA, 662 bp, Homo sapiens
  Payload ID: 385
  Gene Symbol: ACACA
  Gene Name: acetyl-CoA carboxylase alpha
  ENST ID: ENST00000632723
  CDS Start-End: 537-662
cggcctggtgctgcacgcctgtcagccatcgcccgagccgccggcgtctcctcccgcccagcagttcctccacgcaggggctccggaatcgcccgaccgcacacgttgccaccctgaggtctttctggaagtggatatctactcagacagtaagaattataagagctgtaagagctcattttggaggaataatggatgaaccatctcccttggcccaacctctggagctgaaccagcactctcgattcataataggttctgtgtctgaagataactcagaggatgagatcagcaacctggtgaagttggacctactggaggagaaggagggctccttgtcacctgcttctgttggctcagatacactctctgatttggggatctctagcctacaggatggcttggccttgcacataagactttgaaatactcgtgggatatgaagtggaggtgcctagagggttgaagataatgaggacagatgaagaaatgtttgattgtgccatacttacagttgctgattttcaaggtccagcatgtctggcttgcacctagtaaagcagggccgagacagaaagaaaatagattctcaacgagatttcactgtggcttctccagcagaatttgttactcgctttgggggaaataaagtgattgagaag

SEQ ID NO: 103733 - DNA, 2177 bp, Homo sapiens; identical to SEQ ID NO: 103715
  Payload ID: 385
  Gene Symbol: ACACA
  Gene Name: acetyl-CoA carboxylase alpha
  ENST ID: ENST00000631657
  CDS Start-End: 1-157

SEQ ID NO: 103734 - DNA, 569 bp, Homo sapiens; identical to SEQ ID NO: 103724
  Payload ID: 385
  Gene Symbol: ACACA
  Gene Name: acetyl-CoA carboxylase alpha
  ENST ID: ENST00000634140
  CDS Start-End: 1-339

SEQ ID NO: 103735 - DNA, 5315 bp, Homo sapiens; identical to SEQ ID NO: 103725
  Payload ID: 385
  Gene Symbol: ACACA
  Gene Name: acetyl-CoA carboxylase alpha
  ENST ID: ENST00000632453
  CDS Start-End: 1-2997

SEQ ID NO: 103736 - DNA, 9360 bp, Homo sapiens
  Payload ID: 386
  Gene Symbol: ACACB
  Gene Name: acetyl-CoA carboxylase beta
  Uniprot ID: O00763
  ENST ID: ENST00000338432
  CDS Start-End: 120-7496
cagctagcaggcttagattcaggccctcagcaaacaaggaacctggaaaatgtaaccctgaatgcacggtggggaggacatggcaagagaaaagcggcaggaataaagtgattttctgaatggtcttgcttctttgtctatcttgtctgattttctcctgtctgaccttttcctggttaaaaatctgggggaaaatgacggactccaagccgatcaccaagagtaaatcagaagcaaacctcatcccgagccaggagccctttccagcctctgataactcaggggagacaccgcagagaaatggggagggccacactctgcccaagacacccagccaggccgagccagcctcccacaaaggccccaaagatgccggtcggcggagaaactccctaccaccctcccaccagaagcccccaagaaaccccctttcttccagtgacgcagcaccctccccagagcttcaagccaacgggactgggacacaaggtctggaggccacagataccaatggcctgtcctcctcagccaggccccagggccagcaagctggctccccctccaaagaagacaagaagcaggcaaacatcaagaggcagctgatgaccaacttcatcctgggctcttttgatgactactcctccgacgaggactctgttgctggctcatctcgtgagtctacccggaagggcagccgggccagcttgggggccctgtccctggaggcttatctgaccacaggtgaagctgagacccgcgtccccactatgaggccgagcatgtcgggactccacctggtgaagaggggacgggaacacaagaagctggacctgcacagagactttaccgtggcttctcccgctgagtttgtcacacgctttgggggggatcgggtcatcgagaaggtgcttattgccaacaacgggattgccgccgtgaagtgcatgcgctccatccgcaggtgggcctatgagatgttccgcaacgagcgggccatccggtttgttgtgatggtgacccccgaggaccttaaggccaacgcagagtacatcaagatggcggatcattacgtccccgtcccaggagggcccaataacaacaactatgccaacgtggagctgattgtggacattgccaagagaatccccgtgcaggcggtgtgggctggctggggccatgcttcagaaaaccctaaacttccggagctgctgtgcaagaatggagttgctttcttaggccctcccagtgaggccatgtgggccttaggagataagatcgcctccaccgttgtcgcccagacgctacaggtcccaaccctgccctggagtggaagcggcctgacagtggagtggacagaagatgatctgcagcagggaaaaagaatcagtgtcccagaagatgtttatgacaagggttgcgtgaaagacgtagatgagggcttggaggcagcagaaagaattggttttccattgatgatcaaagcttctgaaggtggcggagggaagggaatccggaaggctgagagtgcggaggacttcccgatccttttcagacaagtacagagtgagatcccaggctcgcccatctttctcatgaagctggcccagcacgcccgtcacctggaagttcagatcctcgctgaccagtatgggaatgctgtgtctctgtttggtcgcgactgctccatccagcggcggcatcagaagatcgttgaggaagcaccggccaccatcgccccgctggccatattcgagttcatggagcagtgtgccatccgcctggccaagaccgtgggctatgtgagtgcagggacagtggaatacctctatagtcaggatggcagcttccacttcttggagctgaatcctcgcttgcaggtggaacatccctgcacagaaatgattgctgatgttaatctgccggccgcccagctacagatcgccatgggcgtgccactgcaccggctgaaggatatccggcttctgtatggagagtcaccatggggagtgactcccatttcttttgaaaccccctcaaaccctcccctcgcccgaggccacgtcattgccgccagaatcaccagcgaaaacccagacgagggttttaagccgagctccgggactgtccaggaactgaatttccggagcagcaagaacgtgtggggttacttcagcgtggccgctactggaggcctgcacgagtttgcggattcccaatttgggcactgcttctcctggggagagaaccgggaagaggccatttcgaacatggtggtggctttgaaggaactgtccatccgaggcgactttaggactaccgtggaatacctcattaacctcctggagaccgagagcttccagaacaacgacatcgacaccgggtggttggactacctcattgctgagaaagtgcaggcggagaaaccggatatcatgcttggggtggtatgcggggccttgaacgtggccgatgcgatgttcagaacgtgcatgacagatttcttacactccctggaaaggggccaggtcctcccagcggattcactactgaacctcgtagatgtggaattaatttacggaggtgttaagtacattctcaaggtggcccggcagtctctgaccatgttcgttctcatcatgaatggctgccacatcgagattgatgcccaccggctgaatgatggggggctcctgctctcctacaatgggaacagctacaccacctacatgaaggaagaggttgacagttaccgaattaccatcggcaataagacgtgtgtgtttgagaaggagaacgatcctacagtcctgagatccccctcggctgggaagctgacacagtacacagtggaggatgggggccacgttgaggctgggagcagctacgctgagatggaggtgatgaagatgatcatgaccctgaacgttcaggaaagaggccgggtgaagtacatcaagcgtccaggtgccgtgctggaagcaggctgcgtggtggccaggctggagctcgatgacccttctaaagtccacccggctgaaccgttcacaggagaactccctgcccagcagacactgcccatcctcggagagaaactgcaccaggtcttccacagcgtcctggaaaacctcaccaacgtcatgagtggcttttgtctgccagagcccgtttttagcataaagctgaaggagtgggtgcagaagctcatgatgaccctccggcacccgtcactgccgctgctggagctgcaggagatcatgaccagcgtggcaggccgcatccccgcccctgtggagaagtctgtccgcagggtgatggcccagtatgccagcaacatcacctcggtgctgtgccagttccccagccagcagatagccaccatcctggactgccatgcagccaccctgcagcggaaggctgatcgagaggtcttcttcatcaacacccagagcatcgtgcagttggtccagagataccgcagcgggatccgcggctatatgaaaacagtggtgttggatctcctgagaagatacttgcgtgttgagcaccattttcagcaagcccactacgacaagtgtgtgataaacctcagggagcagttcaagccagacatgtcccaggtgctggactgcatcttctcccacgcacaggtggccaagaagaaccagctggtgatcatgttgatcgatgagctgtgtggcccagacccttccctgtcggacgagctgatctccatcctcaacgagctcactcagctgagcaaaagcgagcactgcaaagtggccctcagagcccggcagatcctgattgcctcccacctcccctcctacgagctgcggcataaccaggtggagtccattttcctgtctgccattgacatgtacggccaccagttctgccccgagaacctcaagaaattaatactttcggaaacaaccatcttcgacgtcctgcctactttcttctatcacgcaaacaaagtcgtgtgcatggcgtccttggaggtttacgtgcggaggggctacatcgcctatgagttaaacagcctgcagcaccggcagctcccggacggcacctgcgtggtagaattccagttcatgctgccgtcctcccacccaaaccggatgaccgtgcccatcagcatcaccaaccctgacctgctgaggcacagcacagagctcttcatggacagcggcttctccccactgtgccagcgcatgggagccatggtagccttcaggagattcgaggacttcaccagaaattttgatgaagtcatctcttgcttcgccaacgtgcccaaagacacccccctcttcagcgaggcccgcacctccctatactccgaggatgactgcaagagcctcagagaagagcccatccacattctgaatgtgtccatccagtgtgcagaccacctggaggatgaggcactggtgccgattttacggacattcgtacagtccaagaaaaatatccttgtggattatggactccgacgaatcacattcttgattgcccaagagaaagaatttcccaagtttttcacattcagagcaagagatgagtttgcagaagatcgcatttaccgtcacttggaacctgccctggccttccagctggaacttaaccggatgcgtaacttcgatctgaccgccgtgccctgtgccaaccacaagatgcacctttacctgggtgctgccaaggtgaaggaaggtgtggaagtgacggaccataggttcttcatccgcgccatcatcaggcactctgacctgatcacaaaggaagcctccttcgaatacctgcagaacgagggtgagcggctgctcctggaggccatggacgagctggaggtggcgttcaataacaccagcgtgcgcaccgactgcaaccacatcttcctcaacttcgtgcccactgtcatcatggaccccttcaagatcgaggagtccgtgcgctacatggttatgcgctacggcagccggctgtggaaactccgtgtgctacaggctgaggtcaagatcaacatccgccagaccaccaccggcagtgccgttcccatccgcctgttcatcaccaatgagtcgggctactacctggacatcagcctctacaaagaagtgactgactccagatctggaaatatcatgtttcactccttcggcaacaagcaagggccccagcacgggatgctgatcaatactccctacgtcaccaaggatctgctccaggccaagcgattccaggcccagaccctgggaaccacctacatctatgacttcccggaaatgttcaggcaggctctctttaaactgtggggctccccagacaagtatcccaaagacatcctgacatacactgaattagtgttggactctcagggccagctggtggagatgaaccgacttcctggtggaaatgaggtgggcatggtggccttcaaaatgaggtttaagacccaggagtacccggaaggacgggatgtgatcgtcatcggcaatgacatcacctttcgcattggatcctttggccctggagaggaccttctgtacctgcgggcatccgagatggcccgggcagagggcattcccaaaatttacgtggcagccaacagtggcgcccgtattggcatggcagaggagatcaaacacatgttccacgtggcttgggtggacccagaagacccccacaaaggatttaaatacctgtacctgactccccaagactacaccagaatcagctccctgaactccgtccactgtaaacacatcgaggaaggaggagagtccagatacatgatcacggatatcatcgggaaggatgatggcttgggcgtggagaatctgaggggctcaggcatgattgctggggagtcctctctggcttacgaagagatcgtcaccattagcttggtgacctgccgagccattgggattggggcctacttggtgaggctgggccagcgagtgatccaggtggagaattcccacatcatcctcacaggagcaagtgctctcaacaaggtcctgggaagagaggtctacacatccaacaaccagctgggtggcgttcagatcatgcattacaatggtgtctcccacatcaccgtgccagatgactttgagggggtttataccatcctggagtggctgtcctatatgccaaaggataatcacagccctgtccctatcatcacacccactgaccccattgacagagaaattgaattcctcccatccagagctccctacgacccccggtggatgcttgcaggaaggcctcacccaactctgaagggaacgtggcagagcggattctttgaccacggcagtttcaaggaaatcatggcaccctgggcgcagaccgtggtgacaggacgagcaaggcttggggggattcccgtgggagtgattgctgtggagacacggactgtggaggtggcagtccctgcagaccctgccaacctggattctgaggccaagataattcagcaggcaggacaggtgtggttcccagactcagcctacaaaaccgcccaggccgtcaaggacttcaaccgggagaagttgcccctgatgatctttgccaactggagggggttctccggtggcatgaaagacatgtatgaccaggtgctgaagtttggagcctacatcgtggacggccttagacaatacaaacagcccatcctgatctatatcccgccctatgcggagctccggggaggctcctgggtggtcatagatgccaccatcaacccgctgtgcatagaaatgtatgcagacaaagagagcaggggtggtgttctggaaccagaggggacagtggagattaagttccgaaagaaagatctgataaagtccatgagaaggatcgatccagcttacaagaagctcatggaacagctaggggaacctgatctctccgacaaggaccgaaaggacctggagggccggctaaaggctcgcgaggacctgctgctccccatctaccaccaggtggcggtgcagttcgccgacttccatgacacacccggccggatgctggagaagggcgtcatatctgacatcctggagtggaagaccgcacgcaccttcctgtattggcgtctgcgccgcctcctcctggaggaccaggtcaagcaggagatcctgcaggccagcggggagctgagtcacgtgcatatccagtccatgctgcgtcgctggttcgtggagacggagggggctgtcaaggcctacttgtgggacaacaaccaggtggttgtgcagtggctggaacagcactggcaggcaggggatggcccgcgctccaccatccgtgagaacatcacgtacctgaagcacgactctgtcctcaagaccatccgaggcctggttgaagaaaaccccgaggtggccgtggactgtgtgatatacctgagccagcacatcagcccagctgagcgggcgcaggtcgttcacctgctgtctaccatggacagcccggcctccacctgaccgtggcccgcccagccactcccgggaccacggcaaaaggaaccacccagacccaccacccgtacaccctcagcagaccctgaagacttgcttttaaacaaagaaaatcctgggcacttctgcagggctgctggttccgagctgacacccgtcttaacaaaaggcccaggagtgcctcttccaaacaaaaacagcctcctctccatagctgggaagtttattttgttttgtctctgaagacagcagttttattgcatcactaaatctaatcaagctaaaacatccctgtttccttttgcaaaacagtgcctggcatgtgggatccaggcgttctttaggatccttggataccacatcgtgaaatcttttatttttttactctgagaccagcaccagatgtaagtaagcatctcatatatttcagccaaataaatgggccaagggaaaaaaatatatatatatagacaggactagagaaaacctatttttgtaatgatgtttctttggatactgtctagtcacccagaaaaatgtatggatgaatttttttttttttttttgagacaaagtctcactgtgtcatgcaggctggagtgcagtggcatgatctcactgcaacctccatctcctgtctcagcctcctagataactgggattacaggtgcccaccaccatgcccggctaatttttgtatttttggtagagacagagtttcaccaggttggtcaggctggtctcaaactcttgacttcaggtaatccacccaccttggcctcccaaagtgctgggattacaggcatgagccaccatcttcagccagatgatttttttattgagagagtgaaatgctattttgttccccaaatggcgctagtgaatcactaggagggtcccactgataggccatgtttagcactggttgccagggattctctttttgagagagggaaagcaaaatgaatggaagtacccagctggaggtttcagggcttctggaggatgctctcgcatagctcgaggtcctctgcccacctcttctctccaaggaaaatgaggactgccccttccccctgcaggattggcccccagcctgcgcatgcaccctcctcttgcccaagtggggagcacagaggcggagaggaatcccttaccacacccacggcccagcttgctcacgagtgtcacctctgtgacggtcaccactgctcccttggagggccacttgagttactgttgcttcctcgcctgctggcttgatgagcaccgatggtgggatctgaccccgaggggcagagctgtcggtgactgaggactggactgtggtgaccatgccgatttgctcagggagaacgttgcaatgcacccagcagctcctggctctgcaggcggcacagcctggggccctgtgatcctctggtttcttccattggggcggagtcggggatggagggagctggccacaacccactgctctgatgggtggtttgtccaaggatgctgaatgtaatgcctggtcaatgtggaagcccatgaggttgcccagggaagcctccaaaagctgggatgcttgagggtatccaagttgaaaaagacaaaatctgaccatcagccagtgacagtcctggcaaatgaaggtggggcggggcagtgaggggtgggagaaggtgaatgattcattattccaccccgaggtttgctggggtgaggggaagaatcgatgctgctttgggaactgaaggtttttctgttgggaaggccctcttggttttggagagaaagacaagttatgagtagctgctaccctggaacggtgggcagagagcctactaggaaatgtgcagaataaactattttttgaaggaaa

SEQ ID NO: 103737 - DNA, 9247 bp, Homo sapiens
  Payload ID: 386
  Gene Symbol: ACACB
  Gene Name: acetyl-CoA carboxylase beta
  Uniprot ID: O00763
  ENST ID: ENST00000377848
  CDS Start-End: 10-7386
attttctgaatggtcttgcttctttgtctatcttgtctgattttctcctgtctgaccttttcctggttaaaaatctgggggaaaatgacggactccaagccgatcaccaagagtaaatcagaagcaaacctcatcccgagccaggagccctttccagcctctgataactcaggggagacaccgcagagaaatggggagggccacactctgcccaagacacccagccaggccgagccagcctcccacaaaggccccaaagatgccggtcggcggagaaactccctaccaccctcccaccagaagcccccaagaaaccccctttcttccagtgacgcagcaccctccccagagcttcaagccaacgggactgggacacaaggtctggaggccacagataccaatggcctgtcctcctcagccaggccccagggccagcaagctggctccccctccaaagaagacaagaagcaggcaaacatcaagaggcagctgatgaccaacttcatcctgggctcttttgatgactactcctccgacgaggactctgttgctggctcatctcgtgagtctacccggaagggcagccgggccagcttgggggccctgtccctggaggcttatctgaccacaggtgaagctgagacccgcgtccccactatgaggccgagcatgtcgggactccacctggtgaagaggggacgggaacacaagaagctggacctgcacagagactttaccgtggcttctcccgctgagtttgtcacacgctttgggggggatcgggtcatcgagaaggtgcttattgccaacaacgggattgccgccgtgaagtgcatgcgctccatccgcaggtgggcctatgagatgttccgcaacgagcgggccatccggtttgttgtgatggtgacccccgaggaccttaaggccaacgcagagtacatcaagatggcggatcattacgtccccgtcccaggagggcccaataacaacaactatgccaacgtggagctgattgtggacattgccaagagaatccccgtgcaggcggtgtgggctggctggggccatgcttcagaaaaccctaaacttccggagctgctgtgcaagaatggagttgctttcttaggccctcccagtgaggccatgtgggccttaggagataagatcgcctccaccgttgtcgcccagacgctacaggtcccaaccctgccctggagtggaagcggcctgacagtggagtggacagaagatgatctgcagcagggaaaaagaatcagtgtcccagaagatgtttatgacaagggttgcgtgaaagacgtagatgagggcttggaggcagcagaaagaattggttttccattgatgatcaaagcttctgaaggtggcggagggaagggaatccggaaggctgagagtgcggaggacttcccgatccttttcagacaagtacagagtgagatcccaggctcgcccatctttctcatgaagctggcccagcacgcccgtcacctggaagttcagatcctcgctgaccagtatgggaatgctgtgtctctgtttggtcgcgactgctccatccagcggcggcatcagaagatcgttgaggaagcaccggccaccatcgccccgctggccatattcgagttcatggagcagtgtgccatccgcctggccaagaccgtgggctatgtgagtgcagggacagtggaatacctctatagtcaggatggcagcttccacttcttggagctgaatcctcgcttgcaggtggaacatccctgcacagaaatgattgctgatgttaatctgccggccgcccagctacagatcgccatgggcgtgccactgcaccggctgaaggatatccggcttctgtatggagagtcaccatggggagtgactcccatttcttttgaaaccccctcaaaccctcccctcgcccgaggccacgtcattgccgccagaatcaccagcgaaaacccagacgagggttttaagccgagctccgggactgtccaggaactgaatttccggagcagcaagaacgtgtggggttacttcagcgtggccgctactggaggcctgcacgagtttgcggattcccaatttgggcactgcttctcctggggagagaaccgggaagaggccatttcgaacatggtggtggctttgaaggaactgtccatccgaggcgactttaggactaccgtggaatacctcattaacctcctggagaccgagagcttccagaacaacgacatcgacaccgggtggttggactacctcattgctgagaaagtgcaggcggagaaaccggatatcatgcttggggtggtatgcggggccttgaacgtggccgatgcgatgttcagaacgtgcatgacagatttcttacactccctggaaaggggccaggtcctcccagcggattcactactgaacctcgtagatgtggaattaatttacggaggtgttaagtacattctcaaggtggcccggcagtctctgaccatgttcgttctcatcatgaatggctgccacatcgagattgatgcccaccggctgaatgatggggggctcctgctctcctacaatgggaacagctacaccacctacatgaaggaagaggttgacagttaccgaattaccatcggcaataagacgtgtgtgtttgagaaggagaacgatcctacagtcctgagatccccctcggctgggaagctgacacagtacacagtggaggatgggggccacgttgaggctgggagcagctacgctgagatggaggtgatgaagatgatcatgaccctgaacgttcaggaaagaggccgggtgaagtacatcaagcgtccaggtgccgtgctggaagcaggctgcgtggtggccaggctggagctcgatgacccttctaaagtccacccggctgaaccgttcacaggagaactccctgcccagcagacactgcccatcctcggagagaaactgcaccaggtcttccacagcgtcctggaaaacctcaccaacgtcatgagtggcttttgtctgccagagcccgtttttagcataaagctgaaggagtgggtgcagaagctcatgatgaccctccggcacccgtcactgccgctgctggagctgcaggagatcatgaccagcgtggcaggccgcatccccgcccctgtggagaagtctgtccgcagggtgatggcccagtatgccagcaacatcacctcggtgctgtgccagttccccagccagcagatagccaccatcctggactgccatgcagccaccctgcagcggaaggctgatcgagaggtcttcttcatcaacacccagagcatcgtgcagttggtccagagataccgcagcgggatccgcggctatatgaaaacagtggtgttggatctcctgagaagatacttgcgtgttgagcaccattttcagcaagcccactacgacaagtgtgtgataaacctcagggagcagttcaagccagacatgtcccaggtgctggactgcatcttctcccacgcacaggtggccaagaagaaccagctggtgatcatgttgatcgatgagctgtgtggcccagacccttccctgtcggacgagctgatctccatcctcaacgagctcactcagctgagcaaaagcgagcactgcaaagtggccctcagagcccggcagatcctgattgcctcccacctcccctcctacgagctgcggcataaccaggtggagtccattttcctgtctgccattgacatgtacggccaccagttctgccccgagaacctcaagaaattaatactttcggaaacaaccatcttcgacgtcctgcctactttcttctatcacgcaaacaaagtcgtgtgcatggcgtccttggaggtttacgtgcggaggggctacatcgcctatgagttaaacagcctgcagcaccggcagctcccggacggcacctgcgtggtagaattccagttcatgctgccgtcctcccacccaaaccggatgaccgtgcccatcagcatcaccaaccctgacctgctgaggcacagcacagagctcttcatggacagcggcttctccccactgtgccagcgcatgggagccatggtagccttcaggagattcgaggacttcaccagaaattttgatgaagtcatctcttgcttcgccaacgtgcccaaagacacccccctcttcagcgaggcccgcacctccctatactccgaggatgactgcaagagcctcagagaagagcccatccacattctgaatgtgtccatccagtgtgcagaccacctggaggatgaggcactggtgccgattttacggacattcgtacagtccaagaaaaatatccttgtggattatggactccgacgaatcacattcttgattgcccaagagaaagaatttcccaagtttttcacattcagagcaagagatgagtttgcagaagatcgcatttaccgtcacttggaacctgccctggccttccagctggaacttaaccggatgcgtaacttcgatctgaccgccgtgccctgtgccaaccacaagatgcacctttacctgggtgctgccaaggtgaaggaaggtgtggaagtgacggaccataggttcttcatccgcgccatcatcaggcactctgacctgatcacaaaggaagcctccttcgaatacctgcagaacgagggtgagcggctgctcctggaggccatggacgagctggaggtggcgttcaataacaccagcgtgcgcaccgactgcaaccacatcttcctcaacttcgtgcccactgtcatcatggaccccttcaagatcgaggagtccgtgcgctacatggttatgcgctacggcagccggctgtggaaactccgtgtgctacaggctgaggtcaagatcaacatccgccagaccaccaccggcagtgccgttcccatccgcctgttcatcaccaatgagtcgggctactacctggacatcagcctctacaaagaagtgactgactccagatctggaaatatcatgtttcactccttcggcaacaagcaagggccccagcacgggatgctgatcaatactccctacgtcaccaaggatctgctccaggccaagcgattccaggcccagaccctgggaaccacctacatctatgacttcccggaaatgttcaggcaggctctctttaaactgtggggctccccagacaagtatcccaaagacatcctgacatacactgaattagtgttggactctcagggccagctggtggagatgaaccgacttcctggtggaaatgaggtgggcatggtggccttcaaaatgaggtttaagacccaggagtacccggaaggacgggatgtgatcgtcatcggcaatgacatcacctttcgcattggatcctttggccctggagaggaccttctgtacctgcgggcatccgagatggcccgggcagagggcattcccaaaatttacgtggcagccaacagtggcgcccgtattggcatggcagaggagatcaaacacatgttccacgtggcttgggtggacccagaagacccccacaaaggatttaaatacctgtacctgactccccaagactacaccagaatcagctccctgaactccgtccactgtaaacacatcgaggaaggaggagagtccagatacatgatcacggatatcatcgggaaggatgatggcttgggcgtggagaatctgaggggctcaggcatgattgctggggagtcctctctggcttacgaagagatcgtcaccattagcttggtgacctgccgagccattgggattggggcctacttggtgaggctgggccagcgagtgatccaggtggagaattcccacatcatcctcacaggagcaagtgctctcaacaaggtcctgggaagagaggtctacacatccaacaaccagctgggtggcgttcagatcatgcattacaatggtgtctcccacatcaccgtgccagatgactttgagggggtttataccatcctggagtggctgtcctatatgccaaaggataatcacagccctgtccctatcatcacacccactgaccccattgacagagaaattgaattcctcccatccagagctccctacgacccccggtggatgcttgcaggaaggcctcacccaactctgaagggaacgtggcagagcggattctttgaccacggcagtttcaaggaaatcatggcaccctgggcgcagaccgtggtgacaggacgagcaaggcttggggggattcccgtgggagtgattgctgtggagacacggactgtggaggtggcagtccctgcagaccctgccaacctggattctgaggccaagataattcagcaggcaggacaggtgtggttcccagactcagcctacaaaaccgcccaggccgtcaaggacttcaaccgggagaagttgcccctgatgatctttgccaactggagggggttctccggtggcatgaaagacatgtatgaccaggtgctgaagtttggagcctacatcgtggacggccttagacaatacaaacagcccatcctgatctatatcccgccctatgcggagctccggggaggctcctgggtggtcatagatgccaccatcaacccgctgtgcatagaaatgtatgcagacaaagagagcaggggtggtgttctggaaccagaggggacagtggagattaagttccgaaagaaagatctgataaagtccatgagaaggatcgatccagcttacaagaagctcatggaacagctaggggaacctgatctctccgacaaggaccgaaaggacctggagggccggctaaaggctcgcgaggacctgctgctccccatctaccaccaggtggcggtgcagttcgccgacttccatgacacacccggccggatgctggagaagggcgtcatatctgacatcctggagtggaagaccgcacgcaccttcctgtattggcgtctgcgccgcctcctcctggaggaccaggtcaagcaggagatcctgcaggccagcggggagctgagtcacgtgcatatccagtccatgctgcgtcgctggttcgtggagacggagggggctgtcaaggcctacttgtgggacaacaaccaggtggttgtgcagtggctggaacagcactggcaggcaggggatggcccgcgctccaccatccgtgagaacatcacgtacctgaagcacgactctgtcctcaagaccatccgaggcctggttgaagaaaaccccgaggtggccgtggactgtgtgatatacctgagccagcacatcagcccagctgagcgggcgcaggtcgttcacctgctgtctaccatggacagcccggcctccacctgaccgtggcccgcccagccactcccgggaccacggcaaaaggaaccacccagacccaccacccgtacaccctcagcagaccctgaagacttgcttttaaacaaagaaaatcctgggcacttctgcagggctgctggttccgagctgacacccgtcttaacaaaaggcccaggagtgcctcttccaaacaaaaacagcctcctctccatagctgggaagtttattttgttttgtctctgaagacagcagttttattgcatcactaaatctaatcaagctaaaacatccctgtttccttttgcaaaacagtgcctggcatgtgggatccaggcgttctttaggatccttggataccacatcgtgaaatcttttatttttttactctgagaccagcaccagatgtaagtaagcatctcatatatttcagccaaataaatgggccaagggaaaaaaatatatatatatagacaggactagagaaaacctatttttgtaatgatgtttctttggatactgtctagtcacccagaaaaatgtatggatgaatttttttttttttttttgagacaaagtctcactgtgtcatgcaggctggagtgcagtggcatgatctcactgcaacctccatctcctgtctcagcctcctagataactgggattacaggtgcccaccaccatgcccggctaatttttgtatttttggtagagacagagtttcaccaggttggtcaggctggtctcaaactcttgacttcaggtaatccacccaccttggcctcccaaagtgctgggattacaggcatgagccaccatcttcagccagatgatttttttattgagagagtgaaatgctattttgttccccaaatggcgctagtgaatcactaggagggtcccactgataggccatgtttagcactggttgccagggattctctttttgagagagggaaagcaaaatgaatggaagtacccagctggaggtttcagggcttctggaggatgctctcgcatagctcgaggtcctctgcccacctcttctctccaaggaaaatgaggactgccccttccccctgcaggattggcccccagcctgcgcatgcaccctcctcttgcccaagtggggagcacagaggcggagaggaatcccttaccacacccacggcccagcttgctcacgagtgtcacctctgtgacggtcaccactgctcccttggagggccacttgagttactgttgcttcctcgcctgctggcttgatgagcaccgatggtgggatctgaccccgaggggcagagctgtcggtgactgaggactggactgtggtgaccatgccgatttgctcagggagaacgttgcaatgcacccagcagctcctggctctgcaggcggcacagcctggggccctgtgatcctctggtttcttccattggggcggagtcggggatggagggagctggccacaacccactgctctgatgggtggtttgtccaaggatgctgaatgtaatgcctggtcaatgtggaagcccatgaggttgcccagggaagcctccaaaagctgggatgcttgagggtatccaagttgaaaaagacaaaatctgaccatcagccagtgacagtcctggcaaatgaaggtggggcggggcagtgaggggtgggagaaggtgaatgattcattattccaccccgaggtttgctggggtgaggggaagaatcgatgctgctttgggaactgaaggtttttctgttgggaaggccctcttggttttggagagaaagacaagttatgagtagctgctaccctggaacggtgggcagagagcctactaggaaatgtgcagaataaactattttttgaagg

SEQ ID NO: 103738 - DNA, 6588 bp, Homo sapiens
  Payload ID: 386
  Gene Symbol: ACACB
  Gene Name: acetyl-CoA carboxylase beta
  ENST ID: ENST00000377854
  CDS Start-End: 4012-6588
attttctgaatggtcttgcttctttgtctatcttgtctgattttctcctgtctgaccttttcctggttaaaaatctgggggaaaatgacggactccaagccgatcaccaagagtaaatcagaagcaaacctcatcccgagccaggagccctttccagcctctgataactcaggggagacaccgcagagaaatggggagggccacactctgcccaagacacccagccaggccgagccagcctcccacaaaggccccaaagatgccggtcggcggagaaactccctaccaccctcccaccagaagcccccaagaaaccccctttcttccagtgacgcagcaccctccccagagcttcaagccaacgggactgggacacaaggtctggaggccacagataccaatggcctgtcctcctcagccaggccccagggccagcaagctggctccccctccaaagaagacaagaagcaggcaaacatcaagaggcagctgatgaccaacttcatcctgggctcttttgatgactactcctccgacgaggactctgttgctggctcatctcgtgagtctacccggaagggcagccgggccagcttgggggccctgtccctggaggcttatctgaccacaggtgaagctgagacccgcgtccccactatgaggccgagcatgtcgggactccacctggtgaagaggggacgggaacacaagaagctggacctgcacagagactttaccgtggcttctcccgctgagtttgtcacacgctttgggggggatcgggtcatcgagaaggtgcttattgccaacaacgggattgccgccgtgaagtgcatgcgctccatccgcaggtgggcctatgagatgttccgcaacgagcgggccatccggtttgttgtgatggtgacccccgaggaccttaaggccaacgcagagtacatcaagatggcggatcattacgtccccgtcccaggagggcccaataacaacaactatgccaacgtggagctgattgtggacattgccaagagaatccccgtgcaggcggtgtgggctggctggggccatgcttcagaaaaccctaaacttccggagctgctgtgcaagaatggagttgctttcttaggccctcccagtgaggccatgtgggccttaggagataagatcgcctccaccgttgtcgcccagacgctacaggtcccaaccctgccctggagtggaagcggcctgacagtggagtggacagaagatgatctgcagcagggaaaaagaatcagtgtcccagaagatgtttatgacaagggttgcgtgaaagacgtagatgagggcttggaggcagcagaaagaattggttttccattgatgatcaaagcttctgaaggtggcggagggaagggaatccggaaggctgagagtgcggaggacttcccgatccttttcagacaagtacagagtgagatcccaggctcgcccatctttctcatgaagctggcccagcacgcccgtcacctggaagttcagatcctcgctgaccagtatgggaatgctgtgtctctgtttggtcgcgactgctccatccagcggcggcatcagaagatcgttgaggaagcaccggccaccatcgccccgctggccatattcgagttcatggagcagtgtgccatccgcctggccaagaccgtgggctatgtgagtgcagggacagtggaatacctctatagtcaggatggcagcttccacttcttggagctgaatcctcgcttgcaggtggaacatccctgcacagaaatgattgctgatgttaatctgccggccgcccagctacagatcgccatgggcgtgccactgcaccggctgaaggatatccggcttctgtatggagagtcaccatggggagtgactcccatttcttttgaaaccccctcaaaccctcccctcgcccgaggccacgtcattgccgccagaatcaccagcgaaaacccagacgagggttttaagccgagctccgggactgtccaggaactgaatttccggagcagcaagaacgtgtggggttacttcagcgtggccgctactggaggcctgcacgagtttgcggattcccaatttgggcactgcttctcctggggagagaaccgggaagaggccatttcgaacatggtggtggctttgaaggaactgtccatccgaggcgactttaggactaccgtggaatacctcattaacctcctggagaccgagagcttccagaacaacgacatcgacaccgggtggttggactacctcattgctgagaaagtgcaggcggagaaaccggatatcatgcttggggtggtatgcggggccttgaacgtggccgatgcgatgttcagaacgtgcatgacagatttcttacactccctggaaaggggccaggtcctcccagcggattcactactgaacctcgtagatgtggaattaatttacggaggtgttaagtacattctcaaggtggcccggcagtctctgaccatgttcgttctcatcatgaatggctgccacatcgagattgatgcccaccggctgaatgatggggggctcctgctctcctacaatgggaacagctacaccacctacatgaaggaagaggttgacagttaccgaattaccatcggcaataagacgtgtgtgtttgagaaggagaacgatcctacagtcctgagatccccctcggctgggaagctgacacagtacacagtggaggatgggggccacgttgaggctgggagcagctacgctgagatggaggtgatgaagatgatcatgaccctgaacgttcaggaaagaggccgggtgaagtacatcaagcgtccaggtgccgtgctggaagcaggctgcgtggtggccaggctggagctcgatgacccttctaaagtccacccggctgaaccgttcacaggagaactccctgcccagcagacactgcccatcctcggagagaaactgcaccaggtcttccacagcgtcctggaaaacctcaccaacgtcatgagtggcttttgtctgccagagcccgtttttagcataaagctgaaggagtgggtgcagaagctcatgatgaccctccggcacccgtcactgccgctgctggagctgcaggagatcatgaccagcgtggcaggccgcatccccgcccctgtggagaagtctgtccgcagggtgatggcccagtatgccagcaacatcacctcggtgctgtgccagttccccagccagcagatagccaccatcctggactgccatgcagccaccctgcagcggaaggctgatcgagaggtcttcttcatcaacacccagagcatcgtgcagttggtccagagataccgcagcgggatccgcggctatatgaaaacagtggtgttggatctcctgagaagatacttgcgtgttgagcaccattttcagcaagcccactacgacaagtgtgtgataaacctcagggagcagttcaagccagacatgtcccaggtgctggactgcatcttctcccacgcacaggtggccaagaagaaccagctggtgatcatgttgatcgatgagctgtgtggcccagacccttccctgtcggacgagctgatctccatcctcaacgagctcactcagctgagcaaaagcgagcactgcaaagtggccctcagagcccggcagatcctgattgcctcccacctcccctcctacgagctgcggcataaccaggtggagtccattttcctgtctgccattgacatgtacggccaccagttctgccccgagaacctcaagaaattaatactttcggaaacaaccatcttcgacgtcctgcctactttcttctatcacgcaaacaaagtcgtgtgcatggcgtccttggaggtttacgtgcggaggggctacatcgcctatgagttaaacagcctgcagcaccggcagctcccggacggcacctgcgtggtagaattccagttcatgctgccgtcctcccacccaaaccggatgaccgtgcccatcagcatcaccaaccctgacctgctgaggcacagcacagagctcttcatggacagcggcttctccccactgtgccagcgcatgggagccatggtagccttcaggagattcgaggacttcaccagaaattttgatgaagtcatctcttgcttcgccaacgtgcccaaagacacccccctcttcagcgaggcccgcacctccctatactccgaggatgactgcaagagcctcagagaagagcccatccacattctgaatgtgtccatccagtgtgcagaccacctggaggatgaggcactggtgccgattttacggacattcgtacagtccaagaaaaatatccttgtggattatggactccgacgaatcacattcttgattgcccaagagaaagaatttcccaagtttttcacattcagagcaagagatgagtttgcagaagatcgcatttaccgtcacttggaacctgccctggccttccagctggaacttaaccggatgcgtaacttcgatctgaccgccgtgccctgtgccaaccacaagatgcacctttacctgggtgctgccaaggtgaaggaaggtgtggaagtgacggaccataggttcttcatccgcgccatcatcaggcactctgacctgatcacaaaggaagcctccttcgaatacctgcagaacgagggtgagcggctgctcctggaggccatggacgagctggaggtggcgttcaataacaccagcgtgcgcaccgactgcaaccacatcttcctcaacttcgtgcccactgtcatcatggaccccttcaagatcgaggagtccgtgcgctacatggttatgcgctacggcagccggctgtggaaactccgtgtgctacaggctgaggtcaagatcaacatccgccagaccaccaccggcagtgccgttcccatccgcctgttcatcaccaatgagtcgggctactacctggacatcagcctctacaaagaagtgactgactccagatctggaaatatcatgtttcactccttcggcaacaagcaagggccccagcacgggatgctgatcaatactccctacgtcaccaaggatctgctccaggccaagcgattccaggcccagaccctgggaaccacctacatctatgacttcccggaaatgttcaggcaggctctctttaaactgtggggctccccagacaagtatcccaaagacatcctgacatacactgaattagtgttggactctcagggccagctggtggagatgaaccgacttcctggtggaaatgaggtgggcatggtggccttcaaaatgaggtttaagacccaggagtacccggaaggacgggatgtgatcgtcatcggcaatgacatcacctttcgcattggatcctttggccctggagaggaccttctgtacctgcgggcatccgagatggcccgggcagagggcattcccaaaatttacgtggcagccaacagtggcgcccgtattggcatggcagaggagatcaaacacatgttccacgtggcttgggtggacccagaagacccccacaaaggatttaaatacctgtacctgactccccaagactacaccagaatcagctccctgaactccgtccactgtaaacacatcgaggaaggaggagagtccagatacatgatcacggatatcatcgggaaggatgatggcttgggcgtggagaatctgaggggctcaggcatgattgctggggagtcctctctggcttacgaagagatcgtcaccattagcttggtgacctgccgagccattgggattggggcctacttggtgaggctgggccagcgagtgatccaggtggagaattcccacatcatcctcacaggagcaagtgctctcaacaaggtcctgggaagagaggtctacacatccaacaaccagctgggtggcgttcagatcatgcattacaatggtgtctcccacatcaccgtgccagatgactttgagggggtttataccatcctggagtggctgtcctatatgccaaaggataatcacagccctgtccctatcatcacacccactgaccccattgacagagaaattgaattcctcccatccagagctccctacgacccccggtggatgcttgcaggaaggcctcacccaactctgaagggaacgtggcagagcggattctttgaccacggcagtttcaaggaaatcatggcaccctgggcgcagaccgtggtgacaggacgagcaaggcttggggggattcccgtgggagtgattgctgtggagacacggactgtggaggtggcagtccctgcagaccctgccaacctggattctgaggccaagataattcagcaggcaggacaggtgtggttcccagactcagcctacaaaaccgcccaggccgtcaaggacttcaaccgggagaagttgcccctgatgatctttgccaactggagggggttctccggtggcatgaaagggtgcctggggacctggagagatgtgtcttggtggaagataagggccatgttgcccatgcacattggggaaggatcagtgtga

SEQ ID NO: 103739 - DNA, 3654 bp, Homo sapiens
  Payload ID: 386
  Gene Symbol: ACACB
  Gene Name: acetyl-CoA carboxylase beta
  ENST ID: ENST00000538526
  CDS Start-End: 1-2578
gatgaccgtgcccatcagcatcaccaaccctgacctgctgaggcacagcacagagctcttcatggacagcggcttctccccactgtgccagcgcatgggagccatggtagccttcaggagattcgaggacttcaccagaaattttgatgaagtcatctcttgcttcgccaacgtgcccaaagacacccccctcttcagcgaggcccgcacctccctatactccgaggatgactgcaagagcctcagagaagagcccatccacattctgaatgtgtccatccagtgtgcagaccacctggaggatgaggcactggtgccgattttacggacattcgtacagtccaagaaaaatatccttgtggattatggactccgacgaatcacattcttgattgcccaagagaaagaatttcccaagtttttcacattcagagcaagagatgagtttgcagaagatcgcatttaccgtcacttggaacctgccctggccttccagctggaacttaaccggatgcgtaacttcgatctgaccgccgtgccctgtgccaaccacaagatgcacctttacctgggtgctgccaaggtgaaggaaggtgtggaagtgacggaccataggttcttcatccgcgccatcatcaggcactctgacctgatcacaaaggaagcctccttcgaatacctgcagaacgagggtgagcggctgctcctggaggccatggacgagctggaggtggcgttcaataacaccagcgtgcgcaccgactgcaaccacatcttcctcaacttcgtgcccactgtcatcatggaccccttcaagatcgaggagtccgtgcgctacatggttatgcgctacggcagccggctgtggaaactccgtgtgctacaggctgaggtcaagatcaacatccgccagaccaccaccggcagtgccgttcccatccgcctgttcatcaccaatgagtcgggctactacctggacatcagcctctacaaagaagtgactgactccagatctggaaatatcatgtttcactccttcggcaacaagcaagggccccagcacgggatgctgatcaatactccctacgtcaccaaggatctgctccaggccaagcgattccaggcccagaccctgggaaccacctacatctatgacttcccggaaatgttcaggcaggctctctttaaactgtggggctccccagacaagtatcccaaagacatcctgacatacactgaattagtgttggactctcagggccagctggtggagatgaaccgacttcctggtggaaatgaggtgggcatggtggccttcaaaatgaggtttaagacccaggagtacccggaaggacgggatgtgatcgtcatcggcaatgacatcacctttcgcattggatcctttggccctggagaggaccttctgtacctgcgggcatccgagatggcccgggcagagggcattcccaaaatttacgtggcagccaacagtggcgcccgtattggcatggcagaggagatcaaacacatgttccacgtggcttgggtggacccagaagacccccacaaaggatttaaatacctgtacctgactccccaagactacaccagaatcagctccctgaactccgtccactgtaaacacatcgaggaaggaggagagtccagatacatgatcacggatatcatcgggaaggatgatggcttgggcgtggagaatctgaggggctcaggcatgattgctggggagtcctctctggcttacgaagagatcgtcaccattagcttggtgacctgccgagccattgggattggggcctacttggtgaggctgggccagcgagtgatccaggtggagaattcccacatcatcctcacaggagcaagtgctctcaacaaggtcctgggaagagaggtctacacatccaacaaccagctgggtggcgttcagatcatgcattacaatggtgtctcccacatcaccgtgccagatgactttgagggggtttataccatcctggagtggctgtcctatatgccaaaggataatcacagccctgtccctatcatcacacccactgaccccattgacagagaaattgaattcctcccatccagagctccctacgacccccggtggatgcttgcaggaaggcctcacccaactctgaagggaacgtggcagagcggattctttgaccacggcagtttcaaggaaatcatggcaccctgggcgcagaccgtggtgacaggacgagcaaggcttggggggattcccgtgggagtgattgctgtggagacacggactgtggaggtggcagtccctgcagaccctgccaacctggattctgaggccaagataattcagcaggcaggacaggtgtggttcccagactcagcctacaaaaccgcccaggccgtcaaggacttcaaccgggagaagttgcccctgatgatctttgccaactggagggggttctccggtggcatgaaagggtgcctggggacctggagagatgtgtcttggtggaagataagggccatgttgcccatgcacattggggaaggatcagtgtgactacatgtatgaccaggtgctgaagtttggagcctacatcgtggacggccttagacaatacaaacagcccatcctgatctatatcccgccctatgcggagctccggggaggctcctgggtggtcatagatgccaccatcaacccgctgtgcatagaaatgtatgcagacaaagagagcaggggtggtgttctggaaccagaggggacagtggagattaagttccgaaagaaagatctgataaagtccatgagaaggatcgatccagcttacaagaagctcatggaacagctaggggaacctgatctctccgacaaggaccgaaaggacctggagggccggctaaaggctcgcgaggacctgctgctccccatctaccaccaggtggcggtgcagttcgccgacttccatgacacacccggccggatgctggagaagggcgtcatatctgacatcctggagtggaagaccgcacgcaccttcctgtattggcgtctgcgccgcctcctcctggaggaccaggtcaagcaggagatcctgcaggccagcggggagctgagtcacgtgcatatccagtccatgctgcgtcgctggttcgtggagacggagggggctgtcaaggcctacttgtgggacaacaaccaggtggttgtgcagtggctggaacagcactggcaggcaggggatggcccgcgctccaccatccgtgagaacatcacgtacctgaagcacgactctgtcctcaagaccatccgaggcctggttgaagaaaaccccgaggtggccgtggactgtgtgatatacctgagccagcacatcagcccagctgagcgggcgcaggtcgttcacctgctgtctaccatggacagcccggcctccacctgaccgtggcccgcccagccactcccgggaccacggcaaaaggaaccacccagacccaccacccgtacaccctcagcagaccctgaagacttgcttttaaacaaagaaaatcctgggcacttctgcagggctgctggttccgagctgacacccgtcttaacaaaaggcccaggagtgcctcttccaaacaaaaaca

SEQ ID NO: 103740 - DNA, 583 bp, Homo sapiens
  Payload ID: 386
  Gene Symbol: ACACB
  Gene Name: acetyl-CoA carboxylase beta
  ENST ID: ENST00000539864
  CDS Start-End: 154-583
cttagtcaccctgtgggcgcctgtcagcctcactcaagaatggagctggtggctgcatccccagtgacgattttctgaatggtcttgcttctttgtctatcttgtctgattttctcctgtctgaccttttcctggttaaaaatctgggggaaaatgacggactccaagccgatcaccaagagtaaatcagaagcaaacctcatcccgagccaggagccctttccagcctctgataactcaggggagacaccgcagagaaatggggagggccacactctgcccaagacacccagccaggccgagccagcctcccacaaaggccccaaagatgccggtcggcggagaaactccctaccaccctcccaccagaagcccccaagaaaccccctttcttccagtgacgcagcaccctccccagagcttcaagccaacgggactgggacacaaggtctggaggccacagataccaatggcctgtcctcctcagccaggccccagggccagcaagctggctccccctccaaagaagacaagaagcaggcaaacatcaagaggcagctgatgaccaacttcatcctgggct

SEQ ID NO: 103741 - DNA, 678 bp, Homo sapiens
  Payload ID: 386
  Gene Symbol: ACACB
  Gene Name: acetyl-CoA carboxylase beta
  ENST ID: ENST00000544726
  CDS Start-End: 213-678
tttcgggatggagcaagcgcagcgcgaagttgggcgcccgccggctgcagcagaaccccgcccgcggcgctctaggactgcatctcggcctccgggtcgcgacctggctgtcctgctgggtcccgggcctcgggtcggcttcaggcggttaaggggtgcatgctctgcacccctgcgggagcccggtgggattggcctgcggggtggtcaacatgagtcctgccaagtgcaagatctgtttccctgatcgcgaagtaaagccgagcatgtcgggactccacctggtgaagaggggacgggaacacaagaagctggacctgcacagagactttaccgtggcttctcccgctgagtttgtcacacgctttgggggggatcgggtcatcgagaaggtgcttattgccaacaacgggattgccgccgtgaagtgcatgcgctccatccgcaggtgggcctatgagatgttccgcaacgagcgggccatccggtttgttgtgatggtgacccccgaggaccttaaggccaacgcagagtacatcaagatggcggatcattacgtccccgtcccaggagggcccaataacaacaactatgccaacgtggagctgattgtggacattgccaagagaatccccgtgcaggcggtgtgggctggctggggccatgcttcagaaaacc

SEQ ID NO: 103742 - DNA, 959 bp, Homo sapiens
  Payload ID: 386
  Gene Symbol: ACACB
  Gene Name: acetyl-CoA carboxylase beta
  ENST ID: ENST00000536440
  CDS Start-End: 1-338
tggtggagatgaaccgacttcctggtggaaatgaggtgggcatggtggccttcaaaatgaggtttaagacccaggagtacccggaaggacgggatgtgatcgtcatcggcaatgacatcacctttcgcattggatcctttggccctggagaggaccttctgtacctgcgggcatccgagatggcccgggcagagggcattcccaaaatttacgtggcagccaacagtggcgcccgtattggcatggcagaggagatcaaacacatgttccacgtggcttgggtggacccagaagacccccacaaaatacatgatcacggatatcatcgggaaggatgatggcttgggcgtggagaatctgaggggctcaggcatgattgctggggagtcctctctggcttacgaagagatcgtcaccattagcttggtgacctgccgagccattgggattggggcctacttggtgaggctgggccagcgagtgatccaggtggagaattcccacatcatcctcacaggagcaagtgctctcaacaaggtgaccaaaaaggggcctgtgcagagtggatccttgggggccaggagtcattttaacattcccattggtctctggtgggggatttttctcaatatgaagccagtttcattcctactgatacaagagctctttttttccaatttgcagctatctgggtccttatgagaaaaaaaaaattagttttaggcaattctggtcgatctaactccctgtattactgacattttaaaacaaattattgaagtgccattacacattgcagaaaattagaaaaggaaccccccaaaaaagtaattttgcagcttctatcattctggtatagttccctctcatcttctgtctttatgtggttaatttatagtgaatatgcagttttgtattctacttttttcactgtattaaaacattttccttgttgaaaa

SEQ ID NO: 103743 - DNA, 1087 bp, Homo sapiens
  Payload ID: 387
  Gene Symbol: ASMT
  Gene Name: acetylserotonin O-methyltransferase
  Uniprot ID: P46597
  ENST ID: ENST00000381229
  CDS Start-End: 37-1074
agaggctccggaagccacggctggattggagacaagatgggatcctcagaggaccaggcctatcgcctccttaatgactacgccaacggcttcatggtgtcccaggttctcttcgccgcctgcgagctgggcgtgtttgaccttctcgccgaggccccagggcccctggacgtggcggcagtggctgcaggtgtgagggccagcgcccatgggacagagctcctgctggacatctgtgtgtccctgaagctgctgaaagtggagacgaggggaggaaaagctttctatcgaaacacagagctgtccagcgactacctgaccacggtcagcccgacgtcacaatgcagcatgctgaagtacatgggcaggaccagctaccggtgctggggccacctggcagacgccgtgagagaaggaaggaaccagtacctggagacgtttggcgttcccgctgaagagctttttacggccatctacaggtccgagggcgagcggctacagttcatgcaagctctgcaggaggtctggagcgtcaacgggagaagcgtgctgaccgcctttgacctgtcagtgttcccacttatgtgtgaccttggtggtggggctggagctctggctaaggaatgcatgtctctgtaccctggatgtaagatcaccgtttttgacatcccagaagtggtgtggacggcaaagcagcacttctcattccaggaggaagaacagattgacttccaggaaggggatttcttcaaagaccctcttccggaagctgatctgtacatcctggccagggtcctccatgactgggcagacggaaagtgctcacacctgctggagaggatctaccacacttgcaagccaggtggtggcattctggtaattgaaagcctcctggatgaagacaggcgaggtcctctgctcacgcagctctactctctgaacatgcttgtgcagacggaagggcaggagaggacccccacccactaccacatgctcctctcttctgctggcttcagagacttccagtttaagaaaacaggagccatttatgatgccattttagccaggaaataactgtttcttgtga

SEQ ID NO: 103744 - DNA, 989 bp, Homo sapiens
  Payload ID: 387
  Gene Symbol: ASMT
  Gene Name: acetylserotonin O-methyltransferase
  Uniprot ID: P46597
  ENST ID: ENST00000381233
  CDS Start-End: 26-922
aagccacggctggattggagacaagatgggatcctcagaggaccaggcctatcgcctccttaatgactacgccaacggcttcatggtgtcccaggttctcttcgccgcctgcgagctgggcgtgtttgaccttctcgccgaggccccagggcccctggacgtggcggcagtggctgcaggtgtgagggccagcgcccatgggacagagctcctgctggacatctgtgtgtccctgaagctgctgaaagtggagacgaggggaggaaaagctttctatcgaaacacagagctgtccagcgactacctgaccacggtcagcccgacgtcacaatgcagcatgctgaagtacatgggcaggaccagctaccggtgctggggccacctggcagacgccgtgagagaaggaaggaaccagtacctggagacgtttggcgttcccgctgaagagctttttacggccatctacaggtccgagggcgagcggctacagttcatgcaagctctgcaggaggtctggagcgtcaacgggagaagcgtgctgaccgcctttgacctgtcagtgttcccacttatgtgtgaccttggtggggatttcttcaaagaccctcttccggaagctgatctgtacatcctggccagggtcctccatgactgggcagacggaaagtgctcacacctgctggagaggatctaccacacttgcaagccaggtggtggcattctggtaattgaaagcctcctggatgaagacaggcgaggtcctctgctcacgcagctctactctctgaacatgcttgtgcagacggaagggcaggagaggacccccacccactaccacatgctcctctcttctgctggcttcagagacttccagtttaagaaaacaggagccatttatgatgccattttagccaggaaataactgtttcttgtgacctggaactaacgtcaaagcacacaagacataataataaagacatgtacctcca

SEQ ID NO: 103745 - DNA, 1388 bp, Homo sapiens
  Payload ID: 387
  Gene Symbol: ASMT
  Gene Name: acetylserotonin O-methyltransferase
  Uniprot ID: P46597
  ENST ID: ENST00000381241
  CDS Start-End: 200-1321
cacacgctttgtgatcccctaatacggttaatgcaaatttctagagtgatccgtctttgtttgagtactgggcaggcagcagggagagtcaggcagcagctgtgagcgggtggctcttccccaccttgccagcaggctctgtgctccttgaagcaagcgctccagaggctccggaagccacggctggattggagacaagatgggatcctcagaggaccaggcctatcgcctccttaatgactacgccaacggcttcatggtgtcccaggttctcttcgccgcctgcgagctgggcgtgtttgaccttctcgccgaggccccagggcccctggacgtggcggcagtggctgcaggtgtgagggccagcgcccatgggacagagctcctgctggacatctgtgtgtccctgaagctgctgaaagtggagacgaggggaggaaaagctttctatcgaaacacagagctgtccagcgactacctgaccacggtcagcccgacgtcacaatgcagcatgctgaagtacatgggcaggaccagctaccggtgctggggccacctggcagacgccgtgagagaaggaaggaaccagtacctggagacgtttggcgttcccgctgaagagctttttacggccatctacaggtccgagggcgagcggctacagttcatgcaagctctgcaggaggtctggagcgtcaacgggagaagcgtgctgaccgcctttgacctgtcagtgttcccacttatgtgtgaccttggtgggacatggataaagctggaaaccatcattctcagcaaactatcgcaaggacagaaaaccaaacaccgcgtgttctcactcataggtggggctggagctctggctaaggaatgcatgtctctgtaccctggatgtaagatcaccgtttttgacatcccagaagtggtgtggacggcaaagcagcacttctcattccaggaggaagaacagattgacttccaggaaggggatttcttcaaagaccctcttccggaagctgatctgtacatcctggccagggtcctccatgactgggcagacggaaagtgctcacacctgctggagaggatctaccacacttgcaagccaggtggtggcattctggtaattgaaagcctcctggatgaagacaggcgaggtcctctgctcacgcagctctactctctgaacatgcttgtgcagacggaagggcaggagaggacccccacccactaccacatgctcctctcttctgctggcttcagagacttccagtttaagaaaacaggagccatttatgatgccattttagccaggaaataactgtttcttgtgacctggaactaacgtcaaagcacacaagacataataataaagacatgtacctcca

SEQ ID NO: 103746 - DNA, 442 bp, Homo sapiens
  Payload ID: 387
  Gene Symbol: ASMT
  Gene Name: acetylserotonin O-methyltransferase
  ENST ID: ENST00000432523
  CDS Start-End: 1-375
gattgcaggctgacctcggtgtgcctgccctgtgttccaggggatttcttcaaagaccctcttccggaagctgatctgtacatcctggccagggtcctccatgactgggcagacggaaagtgctcacacctgctggagaggatctaccacacttgcaagccaggtggtggcattctggtaattgaaagcctcctggatgaagacaggcgaggtcctctgctcacgcagctctactctctgaacatgcttgtgcagacggaagggcaggagaggacccccacccactaccacatgctcctctcttctgctggcttcagagacttccagtttaagaaaacaggagccatttatgatgccattttagccaggaaataactgtttcttgtgacctggaactaacgtcaaagcacacaagacataataataaagacatgtacctcca

SEQ ID NO: 103747 - DNA, 2027 bp, Homo sapiens
  Payload ID: 388
  Gene Symbol: ASMTL
  Gene Name: acetylserotonin O-methyltransferase-like
  Uniprot ID: O95671
  ENST ID: ENST00000381317
  CDS Start-End: 34-1899
aagtgcggacgcccggctcccggcgtggacgccatggtgctgtgcccggtgattgggaagctgctgcacaagcgcgtggtgctggccagcgcctccccacgccgtcaggagatcctcagcaacgcgggtctcaggtttgaggtggtcccctccaagtttaaagagaagctggacaaagcctccttcgctactccgtatgggtacgccatggagaccgccaagcagaaggccctggaggtggccaaccggctgtaccagaaagacctgcgggcccccgacgtggtcattggagcggacacgatcgtgacagtcggggggctgattctggagaagccggtggacaagcaggacgcctacaggatgctgtcccggttgagtgggagagaacacagcgtgttcacaggtgtcgcgatcgtccactgctccagcaaagaccatcagctggacaccagggtctcggaattctacgaggaaacgaaggtgaagttctcggagctgtccgaggagctgctctgggaatacgtccacagcggggagcccatggacaaagctggcggctacgggatccaggccctgggcggcatgctggtggagtccgtacacggggactttctgaacgtggtgggattcccgctgaaccacttctgcaagcagctggtgaagctctactacccgccccgtccggaggacctgcggcggagtgtcaagcacgactccatcccggccgcggacaccttcgaagacctcagtgacgtggaggggggcggctcggagcccactcagagggacgcgggcagccgcgatgagaaggccgaggcgggagaggcgggacaggccacggcagaggctgagtgtcacaggactcgggagaccctgcctccgttcccgacacgcctcctggagctgattgagggctttatgctatccaagggcctgctcaccgcttgcaaactgaaggtgttcgatttgttaaaagatgaagcaccccagaaggctgcggatattgccagcaaagtggacgcctctgcgtgtggaatggagaggcttctggacatctgtgctgccatggggctcctggagaagacagagcaaggttacagtaacacagagacagcgaacgtctacctggcatcggatggcgaatactctctgcacggcttcatcatgcacaataatgacctcacatggaacctctttacatacctggagtttgccatccgagagggaacaaaccagcaccacagggcgttggggaagaaggcggaagatctgttccaggatgcgtactaccagagcccggagacgcggctgaggttcatgcgggccatgcacggcatgacgaagctgactgcgtgccaggtggccacggccttcaatctgtcccgcttctcctccgcctgcgacgtgggaggctgcacgggtgcactggcccgagagctggcccgtgagtaccctcgtatgcaggtgactgtgtttgacctcccagacattatcgagctggccgcccacttccaaccccccggaccgcaggcagtgcagatccacttcgcagcaggtgactttttcagggaccccctccccagcgctgagctgtacgtcctgtgccggatcctgcatgactggccagacgacaaagtccacaagttactcagcagggtcgccgagagctgcaagccaggggccggcctgctgctggtggagacgctcctggatgaggagaagagggtggcgcagcgcgccctgatgcagtcactgaacatgctggtgcagactgaaggcaaggagcggagcctgggcgagtatcagtgcttgctggagctgcacggcttccaccaggtgcaggtggtgcacttggggggtgtcctggatgccatcttggccaccaaagtggccccctgaagcccaggcagcatgttcattatagggatgtcctcccccaggctgcaggtggaccgcccggtccccaagtaccataggacagtcacataggagcgtgtagtcgtgactgaataaagaaagcaaaagcc

SEQ ID NO: 103748 - DNA, 2035 bp, Homo sapiens
  Payload ID: 388
  Gene Symbol: ASMTL
  Gene Name: acetylserotonin O-methyltransferase-like
  Uniprot ID: O95671
  ENST ID: ENST00000381333
  CDS Start-End: 90-1907
ctggccgcctgttttttttgcagccgcgctgcgcgcaccgcgggctccgggctcagaagtgcggacgcccggctcccggcgtggacgccatggtgctgtgcccggtgattgggaagctgctgcacaagcgcgtggtgctggccagcgcctccccacgccgtcaggagatcctcagcaacgcgggtctcaggtttgaggtggtcccctccaagtttaaagagaagctggacaaagcctccttcgctactccgtatgggtacgccatggagaccgccaagcagaaggccctggaggtggccaaccggctgtaccagacagtcggggggctgattctggagaagccggtggacaagcaggacgcctacaggatgctgtcccggttgagtgggagagaacacagcgtgttcacaggtgtcgcgatcgtccactgctccagcaaagaccatcagctggacaccagggtctcggaattctacgaggaaacgaaggtgaagttctcggagctgtccgaggagctgctctgggaatacgtccacagcggggagcccatggacaaagctggcggctacgggatccaggccctgggcggcatgctggtggagtccgtacacggggactttctgaacgtggtgggattcccgctgaaccacttctgcaagcagctggtgaagctctactacccgccccgtccggaggacctgcggcggagtgtcaagcacgactccatcccggccgcggacaccttcgaagacctcagtgacgtggaggggggcggctcggagcccactcagagggacgcgggcagccgcgatgagaaggccgaggcgggagaggcgggacaggccacggcagaggctgagtgtcacaggactcgggagaccctgcctccgttcccgacacgcctcctggagctgattgagggctttatgctatccaagggcctgctcaccgcttgcaaactgaaggtgttcgatttgttaaaagatgaagcaccccagaaggctgcggatattgccagcaaagtggacgcctctgcgtgtggaatggagaggcttctggacatctgtgctgccatggggctcctggagaagacagagcaaggttacagtaacacagagacagcgaacgtctacctggcatcggatggcgaatactctctgcacggcttcatcatgcacaataatgacctcacatggaacctctttacatacctggagtttgccatccgagagggaacaaaccagcaccacagggcgttggggaagaaggcggaagatctgttccaggatgcgtactaccagagcccggagacgcggctgaggttcatgcgggccatgcacggcatgacgaagctgactgcgtgccaggtggccacggccttcaatctgtcccgcttctcctccgcctgcgacgtgggaggctgcacgggtgcactggcccgagagctggcccgtgagtaccctcgtatgcaggtgactgtgtttgacctcccagacattatcgagctggccgcccacttccaaccccccggaccgcaggcagtgcagatccacttcgcagcaggtgactttttcagggaccccctccccagcgctgagctgtacgtcctgtgccggatcctgcatgactggccagacgacaaagtccacaagttactcagcagggtcgccgagagctgcaagccaggggccggcctgctgctggtggagacgctcctggatgaggagaagagggtggcgcagcgcgccctgatgcagtcactgaacatgctggtgcagactgaaggcaaggagcggagcctgggcgagtatcagtgcttgctggagctgcacggcttccaccaggtgcaggtggtgcacttggggggtgtcctggatgccatcttggccaccaaagtggccccctgaagcccaggcagcatgttcattatagggatgtcctcccccaggctgcaggtggaccgcccggtccccaagtaccataggacagtcacataggagcgtgtagtcgtgactgaataaagaaagcaaaagcc

SEQ ID NO: 103749 - DNA, 2048 bp, Homo sapiens
  Payload ID: 388
  Gene Symbol: ASMTL
  Gene Name: acetylserotonin O-methyltransferase-like
  Uniprot ID: O95671
  ENST ID: ENST00000534940
  CDS Start-End: 227-1918
atctccactcccctcccaccaggcacgaggacatccccatccccacgccactcgcaccgggtccgcggggaaccccctatctctaccttccccgacgcggctcccacaagacccccatctctgcgccgggcccctccacgtgcggggtctcaggtttgaggtggtcccctccaagtttaaagagaagctggacaaagcctccttcgctactccgtatgggtacgccatggagaccgccaagcagaaggccctggaggtggccaaccggctgtaccagaaagacctgcgggcccccgacgtggtcattggagcggacacgatcgtgacagtcggggggctgattctggagaagccggtggacaagcaggacgcctacaggatgctgtcccggttgagtgggagagaacacagcgtgttcacaggtgtcgcgatcgtccactgctccagcaaagaccatcagctggacaccagggtctcggaattctacgaggaaacgaaggtgaagttctcggagctgtccgaggagctgctctgggaatacgtccacagcggggagcccatggacaaagctggcggctacgggatccaggccctgggcggcatgctggtggagtccgtacacggggactttctgaacgtggtgggattcccgctgaaccacttctgcaagcagctggtgaagctctactacccgccccgtccggaggacctgcggcggagtgtcaagcacgactccatcccggccgcggacaccttcgaagacctcagtgacgtggaggggggcggctcggagcccactcagagggacgcgggcagccgcgatgagaaggccgaggcgggagaggcgggacaggccacggcagaggctgagtgtcacaggactcgggagaccctgcctccgttcccgacacgcctcctggagctgattgagggctttatgctatccaagggcctgctcaccgcttgcaaactgaaggtgttcgatttgttaaaagatgaagcaccccagaaggctgcggatattgccagcaaagtggacgcctctgcgtgtggaatggagaggcttctggacatctgtgctgccatggggctcctggagaagacagagcaaggttacagtaacacagagacagcgaacgtctacctggcatcggatggcgaatactctctgcacggcttcatcatgcacaataatgacctcacatggaacctctttacatacctggagtttgccatccgagagggaacaaaccagcaccacagggcgttggggaagaaggcggaagatctgttccaggatgcgtactaccagagcccggagacgcggctgaggttcatgcgggccatgcacggcatgacgaagctgactgcgtgccaggtggccacggccttcaatctgtcccgcttctcctccgcctgcgacgtgggaggctgcacgggtgcactggcccgagagctggcccgtgagtaccctcgtatgcaggtgactgtgtttgacctcccagacattatcgagctggccgcccacttccaaccccccggaccgcaggcagtgcagatccacttcgcagcaggtgactttttcagggaccccctccccagcgctgagctgtacgtcctgtgccggatcctgcatgactggccagacgacaaagtccacaagttactcagcagggtcgccgagagctgcaagccaggggccggcctgctgctggtggagacgctcctggatgaggagaagagggtggcgcagcgcgccctgatgcagtcactgaacatgctggtgcagactgaaggcaaggagcggagcctgggcgagtatcagtgcttgctggagctgcacggcttccaccaggtgcaggtggtgcacttggggggtgtcctggatgccatcttggccaccaaagtggccccctgaagcccaggcagcatgttcattatagggatgtcctcccccaggctgcaggtggaccgcccggtccccaagtaccataggacagtcacataggagcgtgtagtcgtgactgaataaagaaagcaaaagcctg

SEQ ID NO: 103750 - DNA, 2472 bp, Homo sapiens
  Payload ID: 389
  Gene Symbol: ASCL1
  Gene Name: achaete-scute family bHLH transcription factor 1
  Uniprot ID: P50553
  ENST ID: ENST00000266744
  CDS Start-End: 560-1270
cttctggccagggaacgtggaaggcgcaccgacagggatccggccagggagggcgagtgaaagaaggaaatcagaaaggaagggagttaacaaaataataaaaacagcctgagccacggctggagagaccgagacccggcgcaagagagcgcagccttagtaggagaggaacgcgagacgcggcagagcgcgttcagcactgacttttgctgctgcttctgcttttttttttcttagaaacaagaaggcgccagcggcagcctcacacgcgagcgccacgcgaggctcccgaagccaacccgcgaagggaggaggggagggaggaggaggcggcgtgcagggaggagaaaaagcattttcactttttttgctcccactctaagaagtctcccggggattttgtatatattttttaacttccgtcagggctcccgcttcatatttccttttctttccctctctgttcctgcacccaagttctctctgtgtccccctcgcgggccccgcacctcgcgtcccggatcgctctgattccgcgactccttggccgccgctgcgcatggaaagctctgccaagatggagagcggcggcgccggccagcagccccagccgcagccccagcagcccttcctgccgcccgcagcctgtttctttgccacggccgcagccgcggcggccgcagccgccgcagcggcagcgcagagcgcgcagcagcagcagcagcagcagcagcagcagcagcaggcgccgcagctgagaccggcggccgacggccagccctcagggggcggtcacaagtcagcgcccaagcaagtcaagcgacagcgctcgtcttcgcccgaactgatgcgctgcaaacgccggctcaacttcagcggctttggctacagcctgccgcagcagcagccggccgccgtggcgcgccgcaacgagcgcgagcgcaaccgcgtcaagttggtcaacctgggctttgccacccttcgggagcacgtccccaacggcgcggccaacaagaagatgagtaaggtggagacactgcgctcggcggtcgagtacatccgcgcgctgcagcagctgctggacgagcatgacgcggtgagcgccgccttccaggcaggcgtcctgtcgcccaccatctcccccaactactccaacgacttgaactccatggccggctcgccggtctcatcctactcgtcggacgagggctcttacgacccgctcagccccgaggagcaggagcttctcgacttcaccaactggttctgaggggctcggcctggtcaggccctggtgcgaatggactttggaagcagggtgatcgcacaacctgcatctttagtgctttcttgtcagtggcgttgggagggggagaaaaggaaaagaaaaaaaaaagaagaagaagaagaaaagagaagaagaaaaaaacgaaaacagtcaaccaaccccatcgccaactaagcgaggcatgcctgagagacatggctttcagaaaacgggaagcgctcagaacagtatctttgcactccaatcattcacggagatatgaagagcaactgggacctgagtcaatgcgcaaaatgcagcttgtgtgcaaaagcagtgggctcctggcagaagggagcagcacacgcgttatagtaactcccatcacctctaacacgcacagctgaaagttcttgctcgggtcccttcacctcctcgccctttcttaaagtgcagttcttagccctctagaaacgagttggtgtctttcgtctcagtagcccccaccccaataagctgtagacattggtttacagtgaaactatgctattctcagccctttgaaactctgcttctcctccagggcccgattcccaaaccccatggcttccctcacactgtcttttctaccattttcattatagaatgcttccaatcttttgtgaattttttattataaaaaatctatttgtatctatcctaaccagttcggggatatattaagatatttttgtacataagagagaaagagagagaaaaatttatagaagttttgtacaaatggtttaaaatgtgtatatcttgatactttaacatgtaatgctattacctctgcatattttagatgtgtagttcaccttacaactgcaattttccctatgtggttttgtaaagaactctcctcataggtgagatcaagaggccaccagttgtacttcagcaccaatgtgtcttactttatagaaatgttgttaatgtattaatgatgttattaaatactgttcaagaagaacaaagtttatgcagctactgtccaaactcaaagtggcagccagttggttttgataggttgccttttggagatttctattactgcctttttttttcttactgttttattacaaacttacaaaaatatgtataaccctgttttatacaaactagtttcgtaataaaactttttcctttttttaaaatgaaaataa

SEQ ID NO: 103751 - DNA, 1852 bp, Homo sapiens
  Payload ID: 390
  Gene Symbol: ASCL2
  Gene Name: achaete-scute family bHLH transcription factor 2
  Uniprot ID: Q99929
  ENST ID: ENST00000331289
  CDS Start-End: 621-1202
ctggcggctcttgggactggcggggctgcgcgcggggttagggtgggggtacgggaaggctcaacccaggacctgcgtaccttgctttgggggcgcactaagcacctgccgggagcagggggcgcaccgggaactcgcagatttcgccagttgggcgcactggggatctgtggactgcgtccgggggatgggctagggggacatgcgcacgctttgggccttacagaatgtgatcgcgcgagggggagggcgaagcgtggcgggagggcgaggcgaaggaaggagggcgtgagaaaggcgacggcggcggcgcggaggagggttatctatacatttaaaaaccagccgcctgcgccgcgcctgcggagacctgggagagtccggccgcacgcgcgggacacgagcgtcccacgctccctggcgcgtacggcctgccaccactaggcctcctatccccgggctccagacgacctaggacgcgtgccctggggagttgcctggcggcgccgtgccagaagcccccttggggcgccacagttttccccgtcgcctccggttcctctgcctgcaccttcctgcggcgcgccgggacctggagcgggcgggtggatgcaggcgcgatggacggcggcacactgcccaggtccgcgccccctgcgccccccgtccctgtcggctgcgctgcccggcggagacccgcgtccccggaactgttgcgctgcagccggcggcggcgaccggccaccgcagagaccggaggcggcgcagcggccgtagcgcggcgcaatgagcgcgagcgcaaccgcgtgaagctggtgaacttgggcttccaggcgctgcggcagcacgtgccgcacggcggcgccagcaagaagctgagcaaggtggagacgctgcgctcagccgtggagtacatccgcgcgctgcagcgcctgctggccgagcacgacgccgtgcgcaacgcgctggcgggagggctgaggccgcaggccgtgcggccgtctgcgccccgcgggccgccagggaccaccccggtcgccgcctcgccctcccgcgcttcttcgtccccgggccgcgggggcagctcggagcccggctccccgcgttccgcctactcgtcggacgacagcggctgcgaaggcgcgctgagtcctgcggagcgcgagctactcgacttctccagctggttagggggctactgagcgccctcgacctatgagcctcagccccggaagccgagcgagcggccggcgcgctcatcgccggggagcccgccaggtggaccggcccgcgctccgcccccagcgagccggggacccacccaccaccccccgcaccgccgacgccgcctcgttcgtccggcccagcctgaccaatgccgcggtggaaacgggcttggagctggccccataagggctggcggcttcctccgacgccgcccctccccacagcttctcgactgcagtggggcggggggcaccaacacttggagatttttccggaggggagaggattttctaagggcacagagaatccattttctacacattaacttgagctgctggagggacactgctggcaaacggagacctatttttgtacaaagaacccttgacctggggcgtaataaagatgacctggacccctgcccccactatctggagttttccatgctggccaagatctggacacgagcagtccctgaggggcggggtccctggcgtgaggcccccgtgacagcccaccctggggtgggtttgtgggcactgctgctctgctagggagaagcctgtgtggggcacacctcttcaagggagcgtgaactttataaataaatcagttctgtttacca

SEQ ID NO: 103752 - DNA, 633 bp, Homo sapiens
  Payload ID: 391
  Gene Symbol: ASCL3
  Gene Name: achaete-scute family bHLH transcription factor 3
  Uniprot ID: Q9NQ33
  ENST ID: ENST00000531618
  CDS Start-End: 51-596
ctatctgaccacattgttaaacttggttatgtttgcaggttaaagaggaaatgatggacaacagaggcaactctagtctacctgacaaacttcctatcttccctgattctgcccgcttgccactgaccaggtccttctatctggagcccatggtcactttccacgtgcacccagaggccccggtgtcatccccttactctgaggagctgccacggctgccttttcccagcgactctcttatcctgggaaattacagtgaaccctgccccttctctttcccgatgccttatccaaattacagagggtgcgagtactcctacgggccagccttcacccggaaaaggaatgagcgggaaaggcagcgggtgaaatgtgtcaatgaaggctacgcccagctccgccatcatctgccagaggagtatttggagaagcgactcagcaaagtggaaaccctcagagctgcgatcaagtacattaactacctgcagtctcttctgtaccctgataaagctgagaccaagaataaccctggaaaagtttcctccatgatagcaaccaccagccaccatgctgaccctatgttcagaattgtttgagttgctgtttccaaatagaaatgaataatatcacaaa

SEQ ID NO: 103753 - DNA, 2260 bp, Homo sapiens
  Payload ID: 392
  Gene Symbol: ASCL4
  Gene Name: achaete-scute family bHLH transcription factor 4
  Uniprot ID: Q6XD76
  ENST ID: ENST00000342331
  CDS Start-End: 832-1353
tatgttggaacataatatgcagacccttatattctttgctacagtctgtatttttcctatacccttcaaacatgcctcattgagtttttaaaagattcggtttggaagaagaaaaacctcaagcctcgccccgggtcttccttgacttgacacattttataaccgcaagagagcagtttttcctttgatgaggctaagaccccagaaatgaaagagcaagtttaagtttgcaaacactctaaaagctccttccattagacctggtcgcgggaaaccacaaaggacagtcaagtgattttcaaggagaaagcctctggtccactttccctccgccgccagatctgcaggttcctgggaggagctcttctcaaatcctgaagattgctaggctcttggcgaacgactcatctcttgaagacctagagtggtggattacaggcattgaaaagcttttggtggctttggaagatgactctggtgtgagctcacctttccaggctgggggaccaggcagaggaaccccctttgttatcttctgaaagaagatcagtggggaagacggggtttgaagtgtggattaggagatcctacgtctttgcctaccacctctgcctaaatcataaaaagatcgaggagtgcaatgaacttcaggaatcatgcaccgtttccctgaagcctgtccaggaacctaacttctggacccagaaacttctgcaaagacagacccactgagccaggcagtctgcaccagcacctctgcttctaagattctgtttcgtcttcttctattgagagattgacctcttgagtgatttgtgtgctttccggcaaatgatggagacgcgtaaaccggcggaacggctggccttgccatactcgctgcgcaccgcgcccctgggcgttccggggaccctgcccggactcccgcggagggaccccctcagggtcgccctgcgtctggacgccgcgtgctgggagtgggcgcgcagcggctgcgcacggggatggcagtacttgcccgtgccgctggacagcgccttcgagcccgccttcctccgcaagcgcaacgagcgcgagcggcagcgggtgcgctgcgtgaacgagggctatgcgcgcctccgagaccacctgccccgggagctggcagacaagcgcctcagcaaagtggagacgctccgcgctgccatcgactacatcaagcacctgcaggagctgctggagcgccaggcctgggggctcgagggcgcggccggcgccgtcccccagcgcagggcggaatgcaacagcgacggggagtccaaggcctcttcggcgccttcgcccagcagcgagcccgaggaggggggcagctagcgagcgcccgaactggccaggacccccgcgcccgccgcacagcgcgcagccgggcgctcaacctaaggtcctcttcgaaggtggtttgcattcttaatctggcatcttctccaggcctaaatcttaagaaaaagaaatgggtgctggggtttgggggatgggggagttgttttgacatttgggaatttctcccctgcccttattggttacgtgcctgcaacttataggtgcttattaaggagactcttttcctatacttctaaaatgcaaactgtttcagattctgagcacctcattgtaaatacgattattctaaaaactcaaagggcgagaacaactggaatttcccaccttccgtggtgtgggtaaatggtatacataaacattaaaccttaaccaaagaagaactttaccgccaccaaaacagaaacaaccccaaacagccaaaaacagtccttaaaaatgagaggaacattttcttgcattccttccttcgggaattgtattcaaaatgtaatggaaagtaattgttgacctcctgctttgggtgaaggagactgtaagctggtacttgagaacgaatttgccagcatgtgctgttgttgactgtgtgaatgatggtgccagggaatccgtggcttggtacacactgtttcatccagtggccacgtggaagctttgtagcattgagcagatagtaaaatatcttagaattaatgatctctttggaagagagcccagatttgtatgaaaacttgtttttcctctcaattgttttgtccactgttttcttcattttccttttctctgcataccccccgccccccaacgtgtagctctccatctaagttttggataaactgaagtggcactgtgactttaaaaataaaaaagaaatctacttgga

SEQ ID NO: 103754 - DNA, 1420 bp, Homo sapiens
  Payload ID: 393
  Gene Symbol: ASCL5
  Gene Name: achaete-scute family bHLH transcription factor 5
  Uniprot ID: Q7RTU5
  ENST ID: ENST00000458416
  CDS Start-End: 1-621
atgaacaataacttctgccgggctctggtggaccggaggcctctggggccccccagctgcatgcagctgggcgtcatgccccctccccggcaggcgcccctgccccccgccgagcccctgggcaacgtgcccttcctgctgtacccgggcccagcagagccgccctactacgacgcctatgcgggggtgttcccctacgtgcccttccccggcgccttcggggtctacgaataccccttcgagccagccttcatccagaagcgcaacgagcgcgagaggcagcgagtcaagtgcgtcaacgagggctacgctcgcctccgcggccacctccccggcgccctggctgagaagcgactcagcaaggtggagacgctgcgcgccgccatccgctacataaagtacctgcaagagctgctgagctcggcccccgacggctcgacgccccccgcttcccgcggcctcccgggcaccgggccctgccccgcgccgcccgccaccccccgtcccgaccgccctggcgacggcgaggcccgggcgccctcctccctggtgccggagtcatccgagtcctcctgcttctccccgtcgcctttcttggagtcggaggaatcctggcattgatcgggcctgtggccgcccccggcttggaggatgatccgccggccccgtcccactttcgggagcagcgggaggctgttgggtcacccgcgatgcgccgcaggacggtgactgtaggaggtccgcggcgctcccgtgtctgcgacaccctccctcctccaccagcttggggcggaagtgcagggcagcgggtacgatgggcacgatagagacctaggagctccgtgggtgaagcgaggggcagggcctgggactgctccgggcgtcctgcgtcccctccggggtgcagaggggctccccaggacggtcatccctgggtctggctcccgctcggcctcaggtggctctgctccgtccttccttgccgcaggcgcagtccagtctctgcgagtccccgggatgcgagcccgactttgagccctcggttaccatgccactgctctccaccagatggcctcagatactagcgacttctttgggagcacgcttactcctcgagaaaggaacccagaggaagggatgggaggccagattgctgctggcgctcagcccagaccgaacctacagactcagcagaggcgacctgtgtgccccggtggcgttctctggcttcctgggttgggagggggggttactccctccccgcatcccccccatgaggtcgtctagttttgtcccaggttgggtggggactgtggtttttttccctcagactgtaagccttgggggaggggggcgtgcatataggtacataggcactgcgtcggcaccaaagagctaaataaaaggattgttgaatttt

SEQ ID NO: 103755 - DNA, 2026 bp, Homo sapiens
  Payload ID: 393
  Gene Symbol: ASCL5
  Gene Name: achaete-scute family bHLH transcription factor 5
  ENST ID: ENST00000449188
  CDS Start-End: 607-1227
ctgctgggcaggcgggcagccccggagattccgcagtccccccaggaggttcaagagccactgatcaggataagcgctgccggaggaacaaacccagagagaaatgttcccggggactccctccactgagctggcgcactcctaacagcagccatcagtttggggaccccggacagcccggggatcccgaaggccgcgaggaccaaggaccaggcgctggggtgggtgtggaggacatggagcccgtggtttaggcctgaggtgcccatgttgggtggcagcaagaggcagggtgggcgggtctgtggccatgcccatgggtgctgcggaacggggtgcgggccctcagagttccgcggcgccatgggctggctctgagaaggcgtgcaccgacctcctgagaggggccacacttgtctagggcgatggctcttgttagggagtcattggaagccaccctaaagggcgaaaagaggccctagcaagtcctggtacccaagagctgctgctagcgatgtgacttgccccactggtggagacggtgcagaccccaagccggggccattcggtggaggcctcgctctgggtccagctccacgcggcaccatgaacaataacttctgccgggctctggtggaccggaggcctctggggccccccagctgcatgcagctgggcgtcatgccccctccccggcaggcgcccctgccccccgccgagcccctgggcaacgtgcccttcctgctgtacccgggcccagcagagccgccctactacgacgcctatgcgggggtgttcccctacgtgcccttccccggcgccttcggggtctacgaataccccttcgagccagccttcatccagaagcgcaacgagcgcgagaggcagcgagtcaagtgcgtcaacgagggctacgctcgcctccgcggccacctccccggcgccctggctgagaagcgactcagcaaggtggagacgctgcgcgccgccatccgctacataaagtacctgcaagagctgctgagctcggcccccgacggctcgacgccccccgcttcccgcggcctcccgggcaccgggccctgccccgcgccgcccgccaccccccgtcccgaccgccctggcgacggcgaggcccgggcgccctcctccctggtgccggagtcatccgagtcctcctgcttctccccgtcgcctttcttggagtcggaggaatcctggcattgatcgggcctgtggccgcccccggcttggaggatgatccgccggccccgtcccactttcgggagcagcgggaggctgttgggtcacccgcgatgcgccgcaggacggtgactgtaggaggtccgcggcgctcccgtgtctgcgacaccctccctcctccaccagcttggggcggaagtgcagggcagcgggtacgatgggcacgatagagacctaggagctccgtgggtgaagcgaggggcagggcctgggactgctccgggcgtcctgcgtcccctccggggtgcagaggggctccccaggacggtcatccctgggtctggctcccgctcggcctcaggtggctctgctccgtccttccttgccgcaggcgcagtccagtctctgcgagtccccgggatgcgagcccgactttgagccctcggttaccatgccactgctctccaccagatggcctcagatactagcgacttctttgggagcacgcttactcctcgagaaaggaacccagaggaagggatgggaggccagattgctgctggcgctcagcccagaccgaacctacagactcagcagaggcgacctgtgtgccccggtggcgttctctggcttcctgggttgggagggggggttactccctccccgcatcccccccatgaggtcgtctagttttgtcccaggttgggtggggactgtggtttttttccctcagactgtaagccttgggggaggggggcgtgcatataggtacataggcactgcgtcggcaccaaagagctaaataaaaggattgttgaatttt

SEQ ID NO: 103756 - DNA, 1840 bp, Homo sapiens
  Payload ID: 394
  Gene Symbol: AAAS
  Gene Name: achalasia, adrenocortical insufficiency, alacrimia
  Uniprot ID: Q9NRG9
  ENST ID: ENST00000209873
  CDS Start-End: 167-1807
tttcccgttagtcttttcttcacttccgttgagttccgcctcgccgtttgtcccttgcggtacccgtccgcatacgaatctagcccgggaaccgagttgcgggagtgcggtctgtgccgttccggccaggagtttgccgactgcagacgtcctgcgaaccggcaagatgtgctctctggggttgttccctcctccaccgcctcggggtcaagtcaccctatatgagcacaataacgagctggtgacgggcagtagctatgagagcccgccccccgacttccggggccagtggatcaatcttcctgtcctacaactgacaaaggatcccctaaagacccctggaaggctggaccatggcacaagaactgccttcatccatcaccgggagcaagtgtggaagagatgcatcaacatttggcgtgatgtgggcctttttggggtgctaaatgaaattgcaaactcagaagaagaggtgtttgagtgggtgaagacggcatccggctgggccctggcactctgtcgatgggcctcttccctccatgggtccctgttcccccatctgtctctcaggagcgaagatctgatcgctgaatttgcccaagtcacaaattggtccagctgctgcttgcgtgtctttgcatggcacccccacaccaacaagtttgcagtggccctgctagatgactcagtccgtgtgtataatgccagcagcaccatagtcccctccctgaagcaccggctgcagcgaaatgtggcgtctctggcctggaagccccttagtgcctctgtcttggctgtggcctgccagagctgcattcttatctggaccctggaccctacctccttgtctacccgaccctcttctggctgtgcccaagtgctgtctcaccctgggcatacacctgttaccagcttggcctgggcccccagtggggggcggctgctctcagcttcacccgtggatgctgctatccgggtatgggatgtctcaacagagacctgtgtcccccttccctggttccgaggaggtggggtgaccaacctgctctggtccccagacggcagcaaaatcctggctaccactccttcagctgtctttcgagtctgggaggcccagatgtggacttgtgagaggtggcctactctatcagggcgctgtcagactggctgctggagcccagatggcagccgactgctgttcactgtattgggagagccactgatttactccctgtcttttccagaacgttgtggtgagggaaaggggtgcgttggaggtgcaaagtcagcaacgattgtggcagatctgtctgagacaacaatacagacaccagatggtgaggagaggcttgggggagaggctcactccatggtctgggaccccagtggggaacgtctggctgtgcttatgaaaggaaagccaagggtacaggatggtaaaccagtcatcctcctttttcgcactcgaaacagccctgtgtttgagctccttccctgtggcattatccagggggagccaggagcccagccccagctcatcactttccatccttccttcaacaaaggggccctgctcagtgtgggctggtccacaggccgaattgcccacatcccgctgtactttgtcaatgcccagtttccacgttttagcccagtgcttgggcgggcccaggaaccccctgctgggggtggaggctctattcatgacctgcccctctttactgagacatccccaacctctgccccttgggaccctctcccagggccaccacctgttctgccccactccccacattcccacctctaagaataaataagttttccttttgttttccactca

SEQ ID NO: 103757 - DNA, 1703 bp, Homo sapiens
  Payload ID: 394
  Gene Symbol: AAAS
  Gene Name: achalasia, adrenocortical insufficiency, alacrimia
  Uniprot ID: Q9NRG9
  ENST ID: ENST00000394384
  CDS Start-End: 132-1673
ccgcctcgccgtttgtcccttgcggtacccgtccgcatacgaatctagcccgggaaccgagttgcgggagtgcggtctgtgccgttccggccaggagtttgccgactgcagacgtcctgcgaaccggcaagatgtgctctctggggttgttccctcctccaccgcctcggggtcaagtcaccctatatgagcacaataacgagctggtgacgggcagtagctatgagagcccgccccccgacttccggggccagtggatcaatcttcctgtcctacaactgacaaaggatcccctaaagacccctggaaggctggaccatggcacaagaactgccttcatccatcaccgggagcaagtgtggaagagatgcatcaacatttggcgtgatgtgggcctttttggggtgctaaatgaaattgcaaactcagaagaagaggtgtttgagtgggtgaagacggcatccggctgggccctggcactctgtcgatgggcctcttccctccatgggtccctgttcccccatctgtctctcaggagcgaagatctgatcgctgaatttgcccaagtcacaaattgcaccatagtcccctccctgaagcaccggctgcagcgaaatgtggcgtctctggcctggaagccccttagtgcctctgtcttggctgtggcctgccagagctgcattcttatctggaccctggaccctacctccttgtctacccgaccctcttctggctgtgcccaagtgctgtctcaccctgggcatacacctgttaccagcttggcctgggcccccagtggggggcggctgctctcagcttcacccgtggatgctgctatccgggtatgggatgtctcaacagagacctgtgtcccccttccctggttccgaggaggtggggtgaccaacctgctctggtccccagacggcagcaaaatcctggctaccactccttcagctgtctttcgagtctgggaggcccagatgtggacttgtgagaggtggcctactctatcagggcgctgtcagactggctgctggagcccagatggcagccgactgctgttcactgtattgggagagccactgatttactccctgtcttttccagaacgttgtggtgagggaaaggggtgcgttggaggtgcaaagtcagcaacgattgtggcagatctgtctgagacaacaatacagacaccagatggtgaggagaggcttgggggagaggctcactccatggtctgggaccccagtggggaacgtctggctgtgcttatgaaaggaaagccaagggtacaggatggtaaaccagtcatcctcctttttcgcactcgaaacagccctgtgtttgagctccttccctgtggcattatccagggggagccaggagcccagccccagctcatcactttccatccttccttcaacaaaggggccctgctcagtgtgggctggtccacaggccgaattgcccacatcccgctgtactttgtcaatgcccagtttccacgttttagcccagtgcttgggcgggcccaggaaccccctgctgggggtggaggctctattcatgacctgcccctctttactgagacatccccaacctctgccccttgggaccctctcccagggccaccacctgttctgccccactccccacattcccacctctaagaataaataagttttccttttgttttccac

SEQ ID NO: 103758 - DNA, 1652 bp, Homo sapiens
  Payload ID: 394
  Gene Symbol: AAAS
  Gene Name: achalasia, adrenocortical insufficiency, alacrimia
  ENST ID: ENST00000550286
  CDS Start-End: 355-1623
gtgccaggccagggcgggggcagcgggcggaacagcactgttccttctctccagttcaccttacagggtaagaagcaggcacctaaccgatcattataacctgatggtgaaaatcgaggtttcatcgaaggatgcaagttgcaggccggagtgatttttcctaggggtatctgggtttggatggtgttacgactaagtggatcaatcttcctgtcctacaactgacaaaggatcccctaaagacccctggaaggctggaccatggcacaagaactgccttcatccatcaccgggagcaagtgtggaagagatgcatcaacatttggcgtgatgtgggcctttttggggtgctaaatgaaattgcaaactcagaagaagaggctcaggagcgaagatctgatcgctgaatttgcccaagtcacaaattggtccagctgctgcttgcgtgtctttgcatggcacccccacaccaacaagtttgcagtggccctgctagatgactcagtccgtgtgtataatgccagcagcaccatagtcccctccctgaagcaccggctgcagcgaaatgtggcgtctctggcctggaagccccttagtgcctctgtcttggctgtggcctgccagagctgcattcttatctggaccctggaccctacctccttgtctacccgaccctcttctggctgtgcccaagtgctgtctcaccctgggcatacacctgttaccagcttggcctgggcccccagtggggggcggctgctctcagcttcacccgtggatgctgctatccgggtatgggatgtctcaacagagacctgtgtcccccttccctggttccgaggaggtggggtgaccaacctgctctggtccccagacggcagcaaaatcctggctaccactccttcagctgtctttcgagtctgggaggcccagatgtggacttgtgagaggtggcctactctatcagggcgctgtcagactggctgctggagcccagatggcagccgactgctgttcactgtattgggagagccactgatttactccctgtcttttccagaacgttgtggtgagggaaaggggtgcgttggaggtgcaaagtcagcaacgattgtggcagatctgtctgagacaacaatacagacaccagatggtgaggagaggcttgggggagaggctcactccatggtctgggaccccagtggggaacgtctggctgtgcttatgaaaggaaagccaagggtacaggatggtaaaccagtcatcctcctttttcgcactcgaaacagccctgtgtttgagctccttccctgtggcattatccagggggagccaggagcccagccccagctcatcactttccatccttccttcaacaaaggggccctgctcagtgtgggctggtccacaggccgaattgcccacatcccgctgtactttgtcaatgcccagtttccacgttttagcccagtgcttgggcgggcccaggaaccccctgctgggggtggaggctctattcatgacctgcccctctttactgagacatccccaacctctgccccttgggaccctctcccagggccaccacctgttctgccccactccccacattcccacctctaagaataaataagttttccttttgttttcca

SEQ ID NO: 103759 - DNA, 949 bp, Homo sapiens
  Payload ID: 394
  Gene Symbol: AAAS
  Gene Name: achalasia, adrenocortical insufficiency, alacrimia
  ENST ID: ENST00000547757
  CDS Start-End: 117-949
tcccttgcggtacccgtccgcatacgaatctagcccgggaaccgagttgcgggagtgcggtctgtgccgttccggccaggagtttgccgactgcagacgtcctgcgaaccggcaagatgtgctctctggggttgttccctcctccaccgcctcggggtcaagtcaccctatatgagcacaataacgagctggtgacgggcagtagctatgagagcccgccccccgacttccggggccagtggatcaatcttcctgtcctacaactgacaaaggatcccctaaagacccctggaaggctggaccatggcacaagaactgccttcatccatcaccgggagcaagtgtggaagagatgcatcaacatttggcgtgatgtgggcctttttggggtgctaaatgaaattgcaaactcagaagaagaggtgtttgagtgggtgaagacggcatccggctgggccctggcactctgtcgatgggcctcttccctccatgggtccctgttcccccatctgtctctcaggagcgaagatctgatcgctgaatttgcccaagtcacaaattgcaccatagtcccctccctgaagcaccggctgcagcgaaatgtggcgtctctggcctggaagccccttagtgcctctgtcttggctgtggcctgccagagctgcattcttatctggaccctggaccctacctccttgtctacccgaccctcttctggctgtgcccaagtgctgtctcaccctgggcatacacctgttaccagcttggcctgggcccccagtggggggcggctgctctcagcttcacccgtggatgctgctatccgggtatgggatgtctcaacagagacctgtgtcccccttccctggttccgaggaggtggggtgaccaacctgctctggtccccagacggcagcaaaatcctggctaccactccttcagctgtctt

SEQ ID NO: 103760 - DNA, 1075 bp, Homo sapiens
  Payload ID: 394
  Gene Symbol: AAAS
  Gene Name: achalasia, adrenocortical insufficiency, alacrimia
  ENST ID: ENST00000548931
  CDS Start-End: 1-1075
ccccacaccaacaagtttgcagtggccctgctagatgactcagtccgtgtgtataatgccagcagcaccatagtcccctccctgaagcaccggctgcagcgaaatgtggcgtctctggcctggaagccccttagtgcctctgtcttggctgtggcctgccagagctgcattcttatctggaccctggaccctacctccttgtctacccgaccctcttctggctgtgcccaagtgctgtctcaccctgggcatacacctgttaccagcttggcctgggcccccagtggggggcggctgctctcagcttcacccgtggatgctgctatccgggtatgggatgtctcaacagagacctgtgtcccccttccctggttccgaggaggtggggtgaccaacctgctctggtccccagacggcagcaaaatcctggctaccactccttcagctgtctttcgagtctgggaggcccagatgtggacttgtgagaggtggcctactctatcagggcgctgtcagactggctgctggagcccagatggcagccgactgctgttcactgtattgggagagccactgatttactccctgtcttttccagaacgttgtggtgagggaaaggggtgcgttggaggtgcaaagtcagcaacgattgtggcagatctgtctgagacaacaatacagacaccagatggtgaggagaggcttgggggagaggctcactccatggtctgggaccccagtggggaacgtctggctgtgcttatgaaaggaaagccaagggtacaggatggtaaaccagtcatcctcctttttcgcactcgaaacagccctgtgtttgagctccttccctgggctggtccacaggccgaattgcccacatcccgctgtactttgtcaatgcccagtttccacgttttagcccagtgcttgggcgggcccaggaaccccctgctgggggtggaggctctattcatgacctgcccctctttactgagacatccccaacctctgccccttgggaccctctcccagggccaccacctgttctgccccactccccacattcccacctcta

SEQ ID NO: 103761 - DNA, 1549 bp, Homo sapiens
  Payload ID: 395
  Gene Symbol: ACP1
  Gene Name: acid phosphatase 1, soluble
  Uniprot ID: P24666
  ENST ID: ENST00000272065
  CDS Start-End: 94-570
gcgcaggcgcgcggggcaagagggtggcagtgcgcctgcgccgcgtcggcgtgcggaacgccgcggtgtctcggcgcctctgcgcgcgggaagatggcggaacaggctaccaagtccgtgctgtttgtgtgtctgggtaacatttgtcgatcacccattgcagaagcagttttcaggaaacttgtaaccgatcaaaacatctcagagaattggagggtagacagcgcggcaacttccgggtatgagatagggaacccccctgactaccgagggcagagctgcatgaagaggcacggcattcccatgagccacgttgcccggcagattaccaaagaagattttgccacatttgattatatactatgtatggatgaaagcaatctgagagatttgaatagaaaaagtaatcaagttaaaacctgcaaagctaaaattgaactacttgggagctatgatccacaaaaacaacttattattgaagatccctattatgggaatgactctgactttgagacggtgtaccagcagtgtgtcaggtgctgcagagcgttcttggagaaggcccactgaggcaggttcgtgccctgctgcggccagcctgactagaccccaccctgaggtcctgcatttctcagtcggtgtgtaatcacgttccagggcccaaagcccagctctttgttcagttgacttactgtttcttaccttaaaaagtaattgtagatggaaatcagttgtgtttggcaggagaatcaataaaaatctttgattcagacagcttatggggtattttaagcattcttagactagttgaacatctcactttgccccagttacaaaaatagtagaacaagcaacataaaacaatgaaggaaaacctcacttgaaggcccaggtcaacatctaagcctgttgagacttagataatcgagtctacctcttcagtaggtttgtgtggatggcctggagggcaggtgccctctgctccccagtgctacctctctcttccctagggccttttgtggattgacagtagtcccctccgtaggagctcacagtctagattagaagtgttttaatttctacacacccatagtgcacacttgtatattgaaaagatagggaagagagaaacatttatggaatcagtcgttggcaccttcaatacttcatgatttttgtcgagtttacttcatgaggaggtcagcccattggctcccatctgaaccactttgcctctgaaacttaattacatccagaaagaaggacacttgtatgctagtctatggtcagttgaggaatatgactgtttttatatgcacatgtaacccaaatgtccaatataaattggcttattttttaaaataattttaaaagttgggaaaagtgttattatttggcatgcttaaatattgaataagtattcttcatcagcatttaataaatgtataggcagatgtaaggtaatttctgtgtattttgagataatgtcaaaatcatgaatatttcaaaataaactggggagttataaaaatacaactagagatataaa

SEQ ID NO: 103762 - DNA, 1552 bp, Homo sapiens
  Payload ID: 395
  Gene Symbol: ACP1
  Gene Name: acid phosphatase 1, soluble
  Uniprot ID: P24666
  ENST ID: ENST00000272067
  CDS Start-End: 97-573
actgcgcaggcgcgcggggcaagagggtggcagtgcgcctgcgccgcgtcggcgtgcggaacgccgcggtgtctcggcgcctctgcgcgcgggaagatggcggaacaggctaccaagtccgtgctgtttgtgtgtctgggtaacatttgtcgatcacccattgcagaagcagttttcaggaaacttgtaaccgatcaaaacatctcagagaattgggtcattgacagcggtgctgtttctgactggaacgtgggccggtccccagacccaagagctgtgagctgcctaagaaatcatggcattcacacagcccataaagcaagacagattaccaaagaagattttgccacatttgattatatactatgtatggatgaaagcaatctgagagatttgaatagaaaaagtaatcaagttaaaacctgcaaagctaaaattgaactacttgggagctatgatccacaaaaacaacttattattgaagatccctattatgggaatgactctgactttgagacggtgtaccagcagtgtgtcaggtgctgcagagcgttcttggagaaggcccactgaggcaggttcgtgccctgctgcggccagcctgactagaccccaccctgaggtcctgcatttctcagtcggtgtgtaatcacgttccagggcccaaagcccagctctttgttcagttgacttactgtttcttaccttaaaaagtaattgtagatggaaatcagttgtgtttggcaggagaatcaataaaaatctttgattcagacagcttatggggtattttaagcattcttagactagttgaacatctcactttgccccagttacaaaaatagtagaacaagcaacataaaacaatgaaggaaaacctcacttgaaggcccaggtcaacatctaagcctgttgagacttagataatcgagtctacctcttcagtaggtttgtgtggatggcctggagggcaggtgccctctgctccccagtgctacctctctcttccctagggccttttgtggattgacagtagtcccctccgtaggagctcacagtctagattagaagtgttttaatttctacacacccatagtgcacacttgtatattgaaaagatagggaagagagaaacatttatggaatcagtcgttggcaccttcaatacttcatgatttttgtcgagtttacttcatgaggaggtcagcccattggctcccatctgaaccactttgcctctgaaacttaattacatccagaaagaaggacacttgtatgctagtctatggtcagttgaggaatatgactgtttttatatgcacatgtaacccaaatgtccaatataaattggcttattttttaaaataattttaaaagttgggaaaagtgttattatttggcatgcttaaatattgaataagtattcttcatcagcatttaataaatgtataggcagatgtaaggtaatttctgtgtattttgagataatgtcaaaatcatgaatatttcaaaataaactggggagttataaaaatacaactagagatataaa

SEQ ID NO: 103763 - DNA, 414 bp, Homo sapiens
  Payload ID: 395
  Gene Symbol: ACP1
  Gene Name: acid phosphatase 1, soluble
  ENST ID: ENST00000405364
  CDS Start-End: 47-187
ggcgtgcggaacgccgcggtgtctcggcgcctctgcgcgcgggaagatggcggaacaggctaccaagtccgtgctgtttgtgtgtctgggtaagattttttactgctgtggaaactacagtctctgtgggaaaaaagtaacatttgtcgatcacccattgcagaagcagttttcaggaaacttgtaaccgatcaaaacatctcagagaattggagggtagacagcgcggcaacttccggtgggtcattgacagcggtgctgtttctgactggaacgtgggccggtccccagacccaagagctgtgagctgcctaagaaatcatggcattcacacagcccataaagcaagacagattaccaaagaagattttgccacatttgattatatactatgtatggatgaaagcaatctga

SEQ ID NO: 103764 - DNA, 1149 bp, Homo sapiens
  Payload ID: 395
  Gene Symbol: ACP1
  Gene Name: acid phosphatase 1, soluble
  ENST ID: ENST00000405233
  CDS Start-End: 40-252
ggaacgccgcggtgtctcggcgcctctgcgcgcgggaagatggcggaacaggctaccaagtccgtgctgtttgtgtgtctgggtaacatttgtcgatcacccattgcagaagcagttttcaggaaacttgtaaccgatcaaaacatctcagagaattggagggtagacagcgcggcaacttccggtgggtcattgacagcggtgctgtttctgactggaacgtgggccggtccccagacccaagagctgtgagctgcctaagaaatcatggcattcacacagcccataaagcaagacaggtagacaagctcttgttcaatttctaatatatagagtccagtaacttgagaagtagcgaaaggattaaccagacttgtatattaatgaatgtgtttatttagggtgagcttaaccagctatggtgtgtccattttgtttcacttctggttgcacggtgttgaaagacttgcctgactttggaatttacttattaaaatgcacataaaagctaggtaatttataatgagagagcctgactgtgagctggggctgagcggtgctctgtcttctgttccttcctgcataatttttattaaacatttaggccatagtaatcatcctgctgatattgcaagtttgttgctagaatgaggttatataatatatacaaaaacattttttcaactgtaaagtgccttagtaatatagggtaataccagcaacattatggatatataattatagtctattgggccacacttaagtttggagtctaataaagtcacaatcaaattctgcaatttcaattgaagataaccttgtctttatattatgaattagaagctaaagttgatttttctaagagttctttatttaaatgaagtactctgggactgaccttttcggaaatggaatcttcattggtcaggtgattcaacatttttatacaatttatccatcctcatctcttcaggatttgcataccttgccagtttctactggccattgttgaaaatacatttatttggagaagtccaaagccaaggggctcatggggctgtgaagtccttcttgctgcatcgtcctgtggtagaaggtggaggagtcaagagagtgccccagagtgagtgagagcgagaactagaaaaa

SEQ ID NO: 103765 - DNA, 703 bp, Homo sapiens
  Payload ID: 395
  Gene Symbol: ACP1
  Gene Name: acid phosphatase 1, soluble
  Uniprot ID: P24666
  ENST ID: ENST00000407983
  CDS Start-End: 66-404
agtgcgcctgcgccgcgtcggcgtgcggaacgccgcggtgtctcggcgcctctgcgcgcgggaagatggcggaacaggctaccaagtccgtgctgtttgtgtgtctgggtaacatttgtcgatcacccattgcagaagcagttttcaggaaacttgtaaccgatcaaaacatctcagagaattggagggtagacagcgcggcaacttccgggtatgagatagggaacccccctgactaccgagggcagagctgcatgaagaggcacggcattcccatgagccacgttgcccggcaggtaccgtccttggacttgaagttgtgtgttttgtgtttcagtgggtcattgacagcggtgctgtttctgactggaacgtgggccggtccccagacccaagagctgtgagctgcctaagaaatcatggcattcacacagcccataaagcaagacaggtagacaagctcttgttcaatttctaatatatagagtccagtaacttgagaagtagcgaaaggattaaccagacttgtatattaatgaatgtgtttatttagggtgagcttaaccagctatggtgtgtccattttgtttcacttctggttgcacggtgttgaaagacttgcctgactttggaatttacttattaaaatgcacataaaagctaggtaatttataatgagagagcctgactgtgagctggggct

SEQ ID NO: 103766 - DNA, 546 bp, Homo sapiens
  Payload ID: 395
  Gene Symbol: ACP1
  Gene Name: acid phosphatase 1, soluble
  ENST ID: ENST00000442386
  CDS Start-End: 66-206
agtgcgcctgcgccgcgtcggcgtgcggaacgccgcggtgtctcggcgcctctgcgcgcgggaagatggcggaacaggctaccaagtccgtgctgtttgtgtgtctgggtaagattttttactgctgtggaaactacagtctctgtgggaaaaaagtaacatttgtcgatcacccattgcagaagcagttttcaggaaacttgtaaccgatcaaaacatctcagagaattggagggtagacagcgcggcaacttccgggtatgagatagggaacccccctgactaccgagggcagagctgcatgaagaggcacggcattcccatgagccacgttgcccggcagattaccaaagaagattttgccacatttgattatatactatgtatggatgaaagcaatctgagagatttgaatagaaaaagtaatcaagttaaaacctgcaaagctaaaattgaactacttgggagctatgatccacaaaaacaacttattattgaagatccctattatgggaatgactctgactttgagacggtgtaccagca

SEQ ID NO: 103767 - DNA, 605 bp, Homo sapiens
  Payload ID: 395
  Gene Symbol: ACP1
  Gene Name: acid phosphatase 1, soluble
  ENST ID: ENST00000439645
  CDS Start-End: 50-307
gtcggcgtgcggaacgccgcggtgtctcggcgcctctgcgcgcgggaagatggcggaacaggctaccaagtccgtgctgtttgtgtgtctgggtaacatttgtcgatcacccattgcagaagcagttttcaggaaacttgtaaccgatcaaaacatctcagagaattgggtcattgacagcggtgctgtttctgactggaacgtgggccggtccccagacccaagagctgtgagctgcctaagaaatcatggcattcacacagcccataaagcaagacaggtagacaagctcttgttcaatttctaatatatagagtccagtaacttgagaagtagcgaaaggattaaccagacttgtatattaatgaatgtgtttatttagggtgagcttaaccagctatggtgtgtccattttgtttcacttctggttgcacggtgttgaaagacttgcctgactttggaatttacttattaaaatgcacataaaagctaggtaatttataatgagagagcctgactgtgagctggggctgagcggtgctctgtcttctgttccttcctgcataatttttattaaacatttaggccatagtaatcatcctgct

SEQ ID NO: 103768 - DNA, 689 bp, Homo sapiens
  Payload ID: 395
  Gene Symbol: ACP1
  Gene Name: acid phosphatase 1, soluble
  ENST ID: ENST00000413140
  CDS Start-End: 73-315
gggtggcagtgcgcctgcgccgcgtcggcgtgcggaacgccgcggtgtctcggcgcctctgcgcgcgggaagatggcggaacaggctaccaagtccgtgctgtttgtgtgtctgggtaacatttgtcgatcacccattgcagaagcagttttcaggaaacttgtaaccgatcaaaacatctcagagaattggagggtagacagcgcggcaacttccgggtatgagatagggaacccccctgactaccgagggcagagctgcatgaagaggcacggcattcccatgagccacgttgcccggcagagatttgaatagaaaaagtaatcaagttaaaacctgcaaagctaaaattgaactacttgggagctatgatccacaaaaacaacttattattgaagatccctattatgggaatgactctgactttgagacggtgtaccagcagtgtgtcaggtgctgcagagcgttcttggagaaggcccactgaggcaggttcgtgccctgctgcggccagcctgactagaccccaccctgaggtcctgcatttctcagtcggtgtgtaatcacgttccagggcccaaagcccagctctttgttcagttgacttactgtttcttaccttaaaaagtaattgtagatggaaatcagttgtgtttggcaggagaatcaataaaaatctttgattcaga

SEQ ID NO: 103769 - DNA, 577 bp, Homo sapiens
  Payload ID: 395
  Gene Symbol: ACP1
  Gene Name: acid phosphatase 1, soluble
  ENST ID: ENST00000453390
  CDS Start-End: 1-213
atggcggaacaggctaccaagtccgtgctgtttgtgtgtctgggtaacatttgtcgatcacccattgcagaagcagttttcaggaaacttgtaaccgatcaaaacatctcagagaattggagggtagacagcgcggcaacttccggtgggtcattgacagcggtgctgtttctgactggaacgtgggccggtccccagacccaagagctgtgagctgcctaagaaatcatggcattcacacagcccataaagcaagacagattaccaaagaagattttgccacatttgattatatactatgtatggatgaaagcaatctgagagatttgaatagaaaaagtaatcaagttaaaacctgcaaagctaaaattgaactacttgggagctatgatccacaaaaacaacttattattgaagatccctattatgggaatgactctgactttgagacggtgtaccagcagtgtgtcaggtgctgcagagcgttcttggagaaggcccactgaggcaggttcgtgccctgctgcggccagcctgactagaccccaccctgaggtcctgcatttctcagtcggtg

SEQ ID NO: 103770 - DNA, 2203 bp, Homo sapiens
  Payload ID: 396
  Gene Symbol: ACP2
  Gene Name: acid phosphatase 2, lysosomal
  Uniprot ID: P11117
  ENST ID: ENST00000256997
  CDS Start-End: 118-1389
aagtaagatggcggcgaacgcacttccggcgtgtgtccttacgggtgcgtccgggcggctgcttgcaggtgccacccagcgggttccagcttgtttgctgcatagattacaacggtgatggcgggcaagcggtccggctggagccgggcggctctcctccagctccttctcggcgtgaacctggtggtgatgccgcccacccgggcccggagtctgcgcttcgttaccttgctgtaccgccatggagaccgttcaccagtgaagacatatcccaaggacccctatcaggaagaagaatggccccaggggtttggtcagttaaccaaggaggggatgctacagcactgggaactgggccaggccctgcggcagcgctatcacggcttcctaaacacctcttatcaccggcaagaggtttatgtgcgaagcacagactttgaccggactctcatgagtgctgaggccaacctggctggactcttccctcccaacgggatgcagcgcttcaacccgaacatctcgtggcagcctattcctgtgcacactgtgcccatcactgaggacaggctgctgaagttcccgttgggcccatgtccccgttatgagcagctgcagaacgagacccggcagacaccagagtatcagaatgagagttctcggaatgcacaatttctggacatggtggccaacgagacagggcttacagacctgacactggagaccgtctggaatgtctatgacacactcttctgtgagcaaacgcacgggctgcgcctgccgccctgggcctcaccccaaaccatgcagcgtctcagccggctaaaggacttcagcttccgcttcctcttcggaatctaccagcaggcggagaaggcccggcttcaggggggagtcctgctggctcagataaggaagaacctgaccctaatggcgaccacctcccagctccccaagctgctggtttactctgcgcacgacactaccctggttgccctgcaaatggcactggatgtctacaatggtgaacaagccccctacgcctcctgccacatatttgaactgtaccaggaagattctgggaatttctcagtggagatgtactttcggaacgagagtgacaaggccccctggccgctcagcctgcctggctgccctcaccgctgcccactgcaggacttccttcgcctcacagagcccgtcgtgcccaaggattggcagcaggagtgccagctggcaagcggtcctgcagacacagaggtgattgtggccttggctgtatgtggctccatcctcttcctcctcatagtgctgctcctcaccgtcctcttccggatgcaggcccagcctcctggctaccgccacgtcgcagatggggaggaccacgcctgacaaccactcagcccccttccctccacctcctaggggaggtgggctgggccctcgctcctgactgttgctgctccccagcccatggacaggagatcctgggttgggcctccctctgatgaccccagccagatgagcgagtggggctcagcgtggcccatggtgcctgtcactcagcattcccatgcctgatgtttaccaagtgctgtgttggacactggctttctccaaacaggatttgcctcctccacgctccctacacacctgagatgtaaactggcagtcagtgttcactcaggacctaggattagaaaatggcagagttggtgctggatccaccttgcacttctatcaagccctgttctttttcctccagcctgaagtcttcggcaaatagctcagagggacacggtcttgcctctcagtgcttattttagtgggaaaaacagctaataccaggggtacaaacattggctcccaaggaactggatcacccaacagccagccagccacatttccctgtgtctggctagagccaccattagactcagacagaatgcttcaggaatcgttgtcaccccttcaactggagcaggacggaaggttgtctgtacttgggagggagtagggagtggtgggaagggagttgcttgtcacacgaatcaggaaactgctctccctcagctgggctggggtctccagggacctgagctacatgcaggttgtgagctggaaaagaaagttctagactgtggcccagaatagggctggggcagctcccagagaatgaatagtgctgtttcctattggactgata

SEQ ID NO: 103771 - DNA, 1499 bp, Homo sapiens
  Payload ID: 396
  Gene Symbol: ACP2
  Gene Name: acid phosphatase 2, lysosomal
  ENST ID: ENST00000527256
  CDS Start-End: 31-1206
agcttgtttgctgcatagattacaacggtgatggcgggcaagcggtccggctggagccgggcggctctcctccagctccttctcggcgtgaacctggtggtgatgccgcccacccgggcccggagtctgcgcttcgttaccttggaggggatgctacagcactgggaactgggccaggccctgcggcagcgctatcacggcttcctaaacacctcttatcaccggcaagaggtttatgtgcgaagcacagactttgaccggactctcatgagtgctgaggccaacctggctggactcttccctcccaacgggatgcagcgcttcaacccgaacatctcgtggcagcctattcctgtgcacactgtgcccatcactgaggacaggctgctgaagttcccgttgggcccatgtccccgttatgagcagctgcagaacgagacccggcagacaccagagtatcagaatgagagttctcggaatgcacaatttctggacatggtggccaacgagacagggcttacagacctgacactggagaccgtctggaatgtctatgacacactcttctgtgagcaaacgcacgggctgcgcctgccgccctgggcctcaccccaaaccatgcagcgtctcagccggctaaaggacttcagcttccgcttcctcttcggaatctaccagcaggcggagaaggcccggcttcaggggggagtcctgctggctcagataaggaagaacctgaccctaatggcgaccacctcccagctccccaagctgctggtttactctgcgcacgacactaccctggttgccctgcaaatggcactggatgtctacaatggtgaacaagccccctacgcctcctgccacatatttgaactgtaccaggaagattctgggaatttctcagtggagatgtactttcggaacgagagtgacaaggccccctggccgctcagcctgcctggctgccctcaccgctgcccactgcaggacttccttcgcctcacagagcccgtcgtgcccaaggattggcagcaggagtgccagctggcaagcggtcctgcagacacagaggtgattgtggccttggctgtatgtggctccatcctcttcctcctcatagtgctgctcctcaccgtcctcttccggatgcaggcccagcctcctggctaccgccacgtcgcagatggggaggaccacgcctgacaaccactcagcccccttccctccacctcctaggggaggtgggctgggccctcgctcctgactgttgctgctccccagcccatggacaggagatcctgggttgggcctccctctgatgaccccagccagatgagcgagtggggctcagcgtggcccatggtgcctgtcactcagcattcccatgcctgatgtttaccaagtgctgtgttggacactggctttctccaaacaggatttgcctcctccacgctccctacacacctgagatgtaaactggcagtcagtgttcactc

SEQ ID NO: 103772 - DNA, 1366 bp, Homo sapiens
  Payload ID: 396
  Gene Symbol: ACP2
  Gene Name: acid phosphatase 2, lysosomal
  ENST ID: ENST00000533929
  CDS Start-End: 115-1302
aaaggccagctggtggaggtcgaggatctcgggaaggaacagctggtttaggaggggacgactggcctgggtagttgggaggctggattcaggattgacctggagccctggcttatgggagtcaggatgaccgaatacgtcgggctgtaccgccatggagaccgttcaccagtgaagacatatcccaaggacccctatcaggaagaagaatggccccaggggtttggtcagttaaccaaggaggggatgctacagcactgggaactgggccaggccctgcggcagcgctatcacggcttcctaaacacctcttatcaccggcaagaggtttatgtgcgaagcacagactttgaccggactctcatgagtgctgaggccaacctggctggactcttccctcccaacgggatgcagcgcttcaacccgaacatctcgtggcagcctattcctgtgcacactgtgcccatcactgaggacaggctgctgaagttcccgttgggcccatgtccccgttatgagcagctgcagaacgagacccggcagacaccagagtatcagaatgagagttctcggaatgcacaatttctggacatggtggccaacgagacagggcttacagacctgacactggagaccgtctggaatgtctatgacacactcttctgtgagcaaacgcacgggctgcgcctgccgccctgggcctcaccccaaaccatgcagcgtctcagccggctaaaggacttcagcttccgcttcctcttcggaatctaccagcaggcggagaaggcccggcttcaggggggagtcctgctggctcagataaggaagaacctgaccctaatggcgaccacctcccagctccccaagctgctggtttactctgcgcacgacactaccctggttgccctgcaaatggcactggatgtctacaatggtgaacaagccccctacgcctcctgccacatatttgaactgtaccaggaagattctgggaatttctcagtggagatgtactttcggaacgagagtgacaaggccccctggccgctcagcctgcctggctgccctcaccgctgcccactgcaggacttccttcgcctcacagagcccgtcgtgcccaaggattggcagcaggagtgccagctggcaagcggtcctgcagacacagaggtgattgtggccttggctgtatgtggctccatcctcttcctcctcatagtgctgctcctcaccgtcctcttccggatgcaggcccagcctcctggctaccgccacgtcgcagatggggaggaccacgcctgacaaccactcagcccccttccctccacctcctaggggaggtgggctgggccctcgctcctgactg

SEQ ID NO: 103773 - DNA, 980 bp, Homo sapiens
  Payload ID: 396
  Gene Symbol: ACP2
  Gene Name: acid phosphatase 2, lysosomal
  ENST ID: ENST00000531547
  CDS Start-End: 26-508
gtttgctgcatagattacaacggtgatggcgggcaagcggtccggctggagccgggcggctctcctccagctccttctcggcgtgaacctggtggtgatgccgcccacccgggcccggagtctgcgcttcgttaccttgctgtaccgccatggagaccgttcaccagtgaagacatatcccaaggacccctatcaggaagaagaatggccccaggggtttggtcagttaaccaaggaggggatgctacagcactgggaactgggccaggccctgcggcagcgctatcacggcttcctaaacacctcttatcaccggcaagaggtttatgtgcgaagcacagactttgaccggactctcatgagtgctgaggccaacctggctggactcttccctcccaacgggatgcagcgcttcaacccgaacatctcgtggcagcctattcctgtgcacactgtgcccatcactgaggacaggagcaggactgagaccctgatccatttttcatagcaatttctggacatggtggccaacgagacagggcttacagacctgacactggagaccgtctggaatgtctatgacacactcttctgtgagcaaacgcacgggctgcgcctgccgccctgggcctcaccccaaaccatgcagcgtctcagccggctaaaggacttcagcttccgcttcctcttcggaatctaccagcaggcggagaaggcccggcttcaggggggagtcctgctggctcagataaggaagaacctgaccctaatggcgaccacctcccagctccccaagctgctggtttactctgcgcacgacactaccctggttgccctgcaaatggcactggatgtctacaatggtgaacaagccccctacgcctcctgccacatatttgaactgtaccaggaagattctgggaatttctcagtggagatgtactttcggaacgagagtgacaaggccccctggccgctca

SEQ ID NO: 103774 - DNA, 826 bp, Homo sapiens
  Payload ID: 396
  Gene Symbol: ACP2
  Gene Name: acid phosphatase 2, lysosomal
  ENST ID: ENST00000530453
  CDS Start-End: 17-505
atagattacaacggtgatggcgggcaagcggtccggctggagccgggcggctctcctccagctccttctcggcgtgaacctggtggtgatgccgcccacccgggcccggagtctgcgcttcgttaccttgctgtaccgccatggagaccgttcaccagtgaagacatatcccaaggacccctatcaggaagaagaatggccccaggggtttggtcagttaaccaaggaggggatgctacagcactgggaactgggccaggccctgcggcagcgctatcacggcttcctaaacacctcttatcaccggcaagaggtttatgtgcgaagcacagactttgaccggactctcatgagtgctgaggccaacctggctggactcttccctcccaacgggatgcagcgcttcaacccgaacatctcgtggcagcctattcctgtgcacactgtgcccatcactgaggacaggcaggcccaggtcaccaggacggtagaacacagtgcctgataccgtcacgcccctggggaggtccagggaggctgtgcttgtgaaacacgggaacttccctcatgggtgacagagatcctcagagtgggaaatggtttattaattgtcagcagtccctgctgctctccacccagagctcctttctgctgagtctcactttttgtgcctgagcttcctttcctgtgccctgaagcatccacaccgcctgccatgtctactggttccagcccctctgcctctctcccctctccctccctcacacacacaggcaccttcccactagggaagagagctgccccctggagaggctggcctaggcct

SEQ ID NO: 103775 - DNA, 1457 bp, Homo sapiens
  Payload ID: 396
  Gene Symbol: ACP2
  Gene Name: acid phosphatase 2, lysosomal
  ENST ID: ENST00000531004
  CDS Start-End: 26-481
gtttgctgcatagattacaacggtgatggcgggcaagcggtccggctggagccgggcggctctcctccagctccttctcggcgtgaacctggtggtgatgccgcccacccgggcccggagtctgcgcttcgttaccttgctgtaccgccatggagaccgttcaccagtgaagacatatcccaaggacccctatcaggaagaagaatggccccaggggtttggtcagttaaccaaggaggggatgctacagcactgggaactgggccaggccctgcggcagcgctatcacggcttcctaaacacctcttatcaccggcaagaggtttatgtgcgaagcacagactttgaccggactctcatgagtgctgaggccaacctggctggactcttccctcccaacgggatgcagcgcttcaacccgaacatctcgtggcagcctattcctgtgcacactgtgcccatcactgaggacagggactgagaccctgatccatttttcatagcaatttctggacatggtggccaacgagacagggcttacagacctgacactggagaccgtctggaatgtctatgacacactcttctgtgagcaaacgcacgggctgcgcctgccgccctgggcctcaccccaaaccatgcagcgtctcagccggctaaaggacttcagcttccgcttcctcttcggaatctaccagcaggcggagaaggcccggcttcaggggggagtcctgctggctcagataaggaagaacctgaccctaatggcgaccacctcccagctccccaagctgctggtttactctgcgcacgacactaccctggttgccctgcaaatggcactggatgtctacaatggtgaacaagccccctacgcctcctgccacatatttgaactgtaccaggaagattctgggaatttctcagtggagatgtactttcggaacgagagtgacaaggccccctggccgctcagcctgcctggctgccctcaccgctgcccactgcaggacttccttcgcctcacagagcccgtcgtgcccaaggattggcagcaggagtgccagctggcaagcggtcctgcagacacagaggtgattgtggccttggctgtatgtggctccatcctcttcctcctcatagtgctgctcctcaccgtcctcttccggatgcaggcccagcctcctggctaccgccacgtcgcagatggggaggaccacgcctgacaaccactcagcccccttccctccacctcctaggggaggtgggctgggccctcgctcctgactgttgctgctccccagcccatggacaggagatcctgggttgggcctccctctgatgaccccagccagatgagcgagtggggctcagcgtggcccatggtgcctgtcactcagcattcccatgcctgatgtttaccaagtgctgtgttggacactggctttctccaaaca

SEQ ID NO: 103776 - DNA, 967 bp, Homo sapiens
  Payload ID: 396
  Gene Symbol: ACP2
  Gene Name: acid phosphatase 2, lysosomal
  ENST ID: ENST00000529663
  CDS Start-End: 52-967
aggtgccacccagcgggttccagcttgtttgctgcatagattacaacggtgatggcgggcaagcggtccggctggagccgggcggctctcctccagctccttctcggcgtgaacctggtggtgatgccgcccacccgggcccggagtctgcgcttcgttaccttgctgtaccgccatggagaccgttcaccagtgaagacatatcccaaggacccctatcaggaagaagaatggccccaggggtttggtcagttaaccaaggaggggatgctacagcactgggaactgggccaggccctgcggcagcgctatcacggcttcctaaacacctcttatcaccggcaagaggtttatgtgcgaagcacagactttgaccggactctcatgagtgctgaggccaacctggctggactcttccctcccaacgggatgcagcgcttcaacccgaacatctcgtggcagcctattcctgtgcacactgtgcccatcactgaggacaggcaatttctggacatggtggccaacgagacagggcttacagacctgacactggagaccgtctggaatgtctatgacacactcttctgtgagcaaacgcacgggctgcgcctgccgccctgggcctcaccccaaaccatgcagcgtctcagccggctaaaggacttcagcttccgcttcctcttcggaatctaccagcaggcggagaaggcccggcttcaggggggagtcctgctggctcagataaggaagaacctgaccctaatggcgaccacctcccagctccccaagctgctggtttactctgcgcacgacactaccctggttgccctgcaaatggcactggatgtctacaatggtgaacaagccccctacgcctcctgccacatatttgaactgtaccaggaagattctgggaatttctcagtggagatgtactttcggaacgagagtgacaaggccccctggc

SEQ ID NO: 103777 - DNA, 1719 bp, Homo sapiens
  Payload ID: 396
  Gene Symbol: ACP2
  Gene Name: acid phosphatase 2, lysosomal
  ENST ID: ENST00000529444
  CDS Start-End: 14-1096
gattacaacggtgatggcgggcaagcggtccggctggagccgggcggctctcctccagctccttctcggcgtgaacctggtggtgatgccgcccacccgggcccggagtctgcgcttcgttaccttgctgtaccgccatggagaccgttcaccagtgaagacatatcccaaggacccctatcaggaagaagaatggccccaggggtttggtcagttaaccaaggaggggatgctacagcactgggaactgggccaggccctgcggcagcgctatcacggcttcctaaacacctcttatcaccggcaagaggtttatgtgcgaagcacagactttgaccggactctcatgagtgctgaggccaacctggctggactcttccctcccaacgggatgcagcgcttcaacccgaacatctcgtggcagcctattcctgtgcacactgtgcccatcactgaggacaggcaaacgcacgggctgcgcctgccgccctgggcctcaccccaaaccatgcagcgtctcagccggctaaaggacttcagcttccgcttcctcttcggaatctaccagcaggcggagaaggcccggcttcaggggggagtcctgctggctcagataaggaagaacctgaccctaatggcgaccacctcccagctccccaagctgctggtttactctgcgcacgacactaccctggttgccctgcaaatggcactggatgtctacaatggtgaacaagccccctacgcctcctgccacatatttgaactgtaccaggaagattctgggaatttctcagtggagatgtactttcggaacgagagtgacaaggccccctggccgctcagcctgcctggctgccctcaccgctgcccactgcaggacttccttcgcctcacagagcccgtcgtgcccaaggattggcagcaggagtgccagctggcaagcggtcctgcagacacagaggtgattgtggccttggctgtatgtggctccatcctcttcctcctcatagtgctgctcctcaccgtcctcttccggatgcaggcccagcctcctggctaccgccacgtcgcagatggggaggaccacgcctgacaaccactcagcccccttccctccacctcctaggggaggtgggctgggccctcgctcctgactgttgctgctccccagcccatggacaggagatcctgggttgggcctccctctgatgaccccagccagatgagcgagtggggctcagcgtggcccatggtgcctgtcactcagcattcccatgcctgatgtttaccaagtgctgtgttggacactggctttctccaaacaggatttgcctcctccacgctccctacacacctgagatgtaaactggcagtcagtgttcactcaggacctaggattagaaaatggcagagttggtgctggatccaccttgcacttctatcaagccctgttctttttcctccagcctgaagtcttcggcaaatagctcagagggacacggtcttgcctctcagtgcttattttagtgggaaaaacagctaataccaggggtacaaacattggctcccaaggaactggatcacccaacagccagccagccacatttccctgtgtctggctagagccaccattagactcagacagaatgcttcaggaatcgttgtcaccccttcaactggagcaggacggaaggttgtctgtacttgggagggagt

SEQ ID NO: 103778 - DNA, 1630 bp, Homo sapiens
  Payload ID: 397
  Gene Symbol: ACP5
  Gene Name: acid phosphatase 5, tartrate resistant
  Uniprot ID: P13686
  ENST ID: ENST00000218758
  CDS Start-End: 303-1280
gccggggctcacctgggtcagccctgagccctcgagcagggcggatcggccgctgcctgcttaaagctggggccgccaggagtgcgatcgcctgcggatctgcagctgggcaccggccgcaacgcccgccccgcgacggcagggactgaagggactcctgaatgtccgcgggacgtgtcgcggcggcgcccagcacggaggaggcaggcagggagggaataaaggctcagggaccggcagttctactctagagcccaccagcctctcagagcctccggtgactggcctgtgtctccccctggatggacatgtggacggcgctgctcatcctgcaagccttgttgctaccctccctggctgatggtgccacccctgccctgcgctttgtagccgtgggtgactggggaggggtccccaatgccccattccacacggcccgggaaatggccaatgccaaggagatcgctcggactgtgcagatcctgggtgcagacttcatcctgtctctaggggacaatttttacttcactggtgtgcaagacatcaatgacaagaggttccaggagacctttgaggacgtattctctgaccgctcccttcgcaaagtgccctggtacgtgctagccggaaaccatgaccaccttggcaatgtctctgcccagattgcatactctaagatctccaagcgctggaacttccccagccctttctaccgcctgcacttcaagatcccacagaccaatgtgtctgtggccatttttatgctggacacagtgacactatgtggcaactcagatgacttcctcagccagcagcctgagaggccccgagacgtgaagctggcccgcacacagctgtcctggctcaagaaacagctggcggcggccagggaggactacgtgctggtggctggccactaccccgtgtggtccatagccgagcacgggcctacccactgcctggtcaagcagctacggccactgctggccacatacggggtcactgcctacctgtgcggccacgatcacaatctgcagtacctgcaagatgagaatggcgtgggctacgtgctgagtggggctgggaatttcatggacccctcaaagcggcaccagcgcaaggtccccaacggctatctgcgcttccactatgggactgaagactcactgggtggctttgcctatgtggagatcagctccaaagagatgactgtcacttacatcgaggcctcgggcaagtccctctttaagaccaggctgccgaggcgagccaggccctgaactcccatgactgcccagctctgaggcccgatctccactgttgggtgggtgggccctgccgggaccctgctcacaggcaggcttttcctccaacctgtggcgctgcagcagggcaggaaggggaaacacagctgatgaactgtggtgccacatgacccttgtggcacagatgcccacgtatgtgaaacacacatggacatgtgtcccagccacagtgttatgctctgtggctggctcacctttgctgagttccggggtgcaatgggggagggagggagggaaagcttcctcctaaatcaagcatctttctgttactgatgttcaataaaagaatagttgccaaggctgaa

SEQ ID NO: 103779 - DNA, 1527 bp, Homo sapiens
  Payload ID: 397
  Gene Symbol: ACP5
  Gene Name: acid phosphatase 5, tartrate resistant
  Uniprot ID: P13686
  ENST ID: ENST00000412435
  CDS Start-End: 231-1208
cgccggggctcacctgggtcagccctgagccctcgagcagggcggatcggccgctgcctgcttaaagctggggccgccaggagtgcgatcgcctgcggatctgcagctgggcaccggccgcaacgcccgccccgcgacggcagggaataaaggctcagggaccggcagttctactctagagcccaccagcctctcagagcctccggtgactggcctgtgtctccccctggatggacatgtggacggcgctgctcatcctgcaagccttgttgctaccctccctggctgatggtgccacccctgccctgcgctttgtagccgtgggtgactggggaggggtccccaatgccccattccacacggcccgggaaatggccaatgccaaggagatcgctcggactgtgcagatcctgggtgcagacttcatcctgtctctaggggacaatttttacttcactggtgtgcaagacatcaatgacaagaggttccaggagacctttgaggacgtattctctgaccgctcccttcgcaaagtgccctggtacgtgctagccggaaaccatgaccaccttggcaatgtctctgcccagattgcatactctaagatctccaagcgctggaacttccccagccctttctaccgcctgcacttcaagatcccacagaccaatgtgtctgtggccatttttatgctggacacagtgacactatgtggcaactcagatgacttcctcagccagcagcctgagaggccccgagacgtgaagctggcccgcacacagctgtcctggctcaagaaacagctggcggcggccagggaggactacgtgctggtggctggccactaccccgtgtggtccatagccgagcacgggcctacccactgcctggtcaagcagctacggccactgctggccacatacggggtcactgcctacctgtgcggccacgatcacaatctgcagtacctgcaagatgagaatggcgtgggctacgtgctgagtggggctgggaatttcatggacccctcaaagcggcaccagcgcaaggtccccaacggctatctgcgcttccactatgggactgaagactcactgggtggctttgcctatgtggagatcagctccaaagagatgactgtcacttacatcgaggcctcgggcaagtccctctttaagaccaggctgccgaggcgagccaggccctgaactcccatgactgcccagctctgaggcccgatctccactgttgggtgggtgggccctgccgggaccctgctcacaggcaggcttttcctccaacctgtggcgctgcagcagggcaggaaggggaaacacagctgatgaactgtggtgccacatgacccttgtggcacagatgcccacgtatgtgaaacacacatggacatgtgtcccagccacagtgttatgctctgtggctggctcacctttgctgagttccggggtgcaatgggggagggagggagggaaagcttcctcctaaatcaagcatctttctgttactgat

SEQ ID NO: 103780 - DNA, 1397 bp, Homo sapiens
  Payload ID: 397
  Gene Symbol: ACP5
  Gene Name: acid phosphatase 5, tartrate resistant
  Uniprot ID: P13686
  ENST ID: ENST00000433365
  CDS Start-End: 150-1127
gctcccgggacagccctcggagaaactgcatcatcctcactaatgatccacttcctcctcagggaataaaggctcagggaccggcagttctactctagagcccaccagcctctcagagcctccggtgactggcctgtgtctccccctggatggacatgtggacggcgctgctcatcctgcaagccttgttgctaccctccctggctgatggtgccacccctgccctgcgctttgtagccgtgggtgactggggaggggtccccaatgccccattccacacggcccgggaaatggccaatgccaaggagatcgctcggactgtgcagatcctgggtgcagacttcatcctgtctctaggggacaatttttacttcactggtgtgcaagacatcaatgacaagaggttccaggagacctttgaggacgtattctctgaccgctcccttcgcaaagtgccctggtacgtgctagccggaaaccatgaccaccttggcaatgtctctgcccagattgcatactctaagatctccaagcgctggaacttccccagccctttctaccgcctgcacttcaagatcccacagaccaatgtgtctgtggccatttttatgctggacacagtgacactatgtggcaactcagatgacttcctcagccagcagcctgagaggccccgagacgtgaagctggcccgcacacagctgtcctggctcaagaaacagctggcggcggccagggaggactacgtgctggtggctggccactaccccgtgtggtccatagccgagcacgggcctacccactgcctggtcaagcagctacggccactgctggccacatacggggtcactgcctacctgtgcggccacgatcacaatctgcagtacctgcaagatgagaatggcgtgggctacgtgctgagtggggctgggaatttcatggacccctcaaagcggcaccagcgcaaggtccccaacggctatctgcgcttccactatgggactgaagactcactgggtggctttgcctatgtggagatcagctccaaagagatgactgtcacttacatcgaggcctcgggcaagtccctctttaagaccaggctgccgaggcgagccaggccctgaactcccatgactgcccagctctgaggcccgatctccactgttgggtgggtgggccctgccgggaccctgctcacaggcaggcttttcctccaacctgtggcgctgcagcagggcaggaaggggaaacacagctgatgaactgtggtgccacatgacccttgtggcacagatgcccacgtatgtgaaacacacatggacatgtgtcccagccacagtgttatgctctgtggctggctcacctttgctgagttccggggtgcaatgggggag

SEQ ID NO: 103781 - DNA, 581 bp, Homo sapiens
  Payload ID: 397
  Gene Symbol: ACP5
  Gene Name: acid phosphatase 5, tartrate resistant
  ENST ID: ENST00000591319
  CDS Start-End: 424-581
aggccgaggcgcccgccctccccgccggggctcacctgggtcagccctgagccctcgagcagggcggatcggccgctgcctgcttaaagctggggccgccaggagtgcgatcgcctgcggatctgcagctgggcaccggccgcaacgcccgccccgcgacggcagggattcccacccagtgccacgtgagaacacaggcgtgcatcgcagacaagccacacaggcctcgcaggctcagcatacatgtctgcagcaacaccatcaggtacagagccgaggcccaggtaggcatgctcagctgcacgcaggaagcaagacacacccagacacacacagggaataaaggctcagggaccggcagttctactctagagcccaccagcctctcagagcctccggtgactggcctgtgtctccccctggatggacatgtggacggcgctgctcatcctgcaagccttgttgctaccctccctggctgatggtgccacccctgccctgcgctttgtagccgtgggtgactggggaggggtccccaatgccccattccacacggcccgggaaatggccaatgccaagga

SEQ ID NO: 103782 - DNA, 583 bp, Homo sapiens
  Payload ID: 397
  Gene Symbol: ACP5
  Gene Name: acid phosphatase 5, tartrate resistant
  ENST ID: ENST00000590832
  CDS Start-End: 211-583
tcgccctctcacagaccgcgccccccttccctaagccagcttgtgcagccttgtgcagcttgtgtgtcctgagaattagggcaccaaggggttcccgcaggggcagcctgcagcaagcagtctccctctatctcagggcaggcgggggtctcaaggcctccctgcccttgtcacagcccgggccacctatgcttgtctctcttctcccagatggacatgtggacggcgctgctcatcctgcaagccttgttgctaccctccctggctgatggtgccacccctgccctgcgctttgtagccgtgggtgactggggaggggtccccaatgccccattccacacggcccgggaaatggccaatgccaaggagatcgctcggactgtgcagatcctgggtgcagacttcatcctgtctctaggggacaatttttacttcactggtgtgcaagacatcaatgacaagaggttccaggagacctttgaggacgtattctctgaccgctcccttcgcaaagtgccctggtacgtgctagccggaaaccatgaccaccttggcaatgtctctgcccagattgcatactcta

SEQ ID NO: 103783 - DNA, 803 bp, Homo sapiens
  Payload ID: 397
  Gene Symbol: ACP5
  Gene Name: acid phosphatase 5, tartrate resistant
  ENST ID: ENST00000592659
  CDS Start-End: 787-803
tcgagcagggcggatcggccgctgcctgcttaaagctggggccgccaggagtgcgatcgcctgcggatctgcagctgggcaccggccgcaacgcccgccccgcgacggcagggactgaagggactcctgaatgtccgcgggacgtgtcgcggcggcgcccagcacggaggaggcaggcagggagggattcccacccagtgccacgtgagaacacaggcgtgcatcgcagacaagccacacaggcctcgcaggctcagcatacatgtctgcagcaacaccatcaggtacagagccgaggcccaggtaggcatgctcagctgcacgcaggaagcaagacacacccagacacacacaggtaagcccttactcagagaaagaaggtgcaggagatgtgtcttgggtaatcacagccacagcctctcaagtgtgcacacacacacacactcacactgagatacacagacacacagagatacctggacgtgtcaagcctacagcacaaacaggcccctgcaggtccacccggaggctgtgtgggccgaggctgctgcacacgtgtgcccagatcctcccacccccaccccaatcccgtgtcctgctccagggaagtccagggctcacatgacccaaggggagggctcccgggacagccctcggagaaactgcatcatcctcactaatgatccacttcctcctcagggaataaaggctcagggaccggcagttctactctagagcccaccagcctctcagagcctccggtgactggcctgtgtctccccctggatggacatgtggacggc

SEQ ID NO: 103784 - DNA, 301 bp, Homo sapiens
  Payload ID: 397
  Gene Symbol: ACP5
  Gene Name: acid phosphatase 5, tartrate resistant
  ENST ID: ENST00000590420
  CDS Start-End: 41-220
ctctcagagcctccggtgactggcctgtgtctccccctggatggacatgtggacggcgctgctcatcctgcaagccttgttgctaccctccctgggaatttcatggacccctcaaagcggcaccagcgcaaggtccccaacggctatctgcgcttccactatgggactgaagactcactgggtggctttgcctatgtggagatcagctccaaagagatgactgtcacttacatcgaggcctcgggcaagtccctctttaagaccaggctgccgaggcgagccaggccctgaactcccatga

SEQ ID NO: 103785 - DNA, 372 bp, Homo sapiens
  Payload ID: 397
  Gene Symbol: ACP5
  Gene Name: acid phosphatase 5, tartrate resistant
  ENST ID: ENST00000589792
  CDS Start-End: 149-372
gcctcgcaggctcagcatacatgtctgcagcaacaccatcaggtacagagccgaggcccagggaataaaggctcagggaccggcagttctactctagagcccaccagcctctcagagcctccggtgactggcctgtgtctccccctggatggacatgtggacggcgctgctcatcctgcaagccttgttgctaccctccctggctgatggtgccacccctgccctgcgctttgtagccgtgggtgactggggaggggtccccaatgccccattccacacggcccgggaaatggccaatgccaaggagatcgctcggactgtgcagatcctgggtgcagacttcatcctgtctctaggggacaatttttactt

SEQ ID NO: 103786 - DNA, 1699 bp, Homo sapiens
  Payload ID: 397
  Gene Symbol: ACP5
  Gene Name: acid phosphatase 5, tartrate resistant
  Uniprot ID: P13686
  ENST ID: ENST00000592828
  CDS Start-End: 404-1381
gctcacctgggtcagccctgagccctcgagcagggcggatcggccgctgcctgcttaaagctggggccgccaggagtgcgatcgcctgcggatctgcagctgggcaccggccgcaacgcccgccccgcgacggcagggctgggaatgggggggaccaagcacttcgcagggtgacccggggagatctgtgagccagtggcctcagcgttgaatgagagctctctcccgggtccgcgctcgcagggactgaagggactcctgaatgtccgcgggacgtgtcgcggcggcgcccagcacggaggaggcaggcagggagggaataaaggctcagggaccggcagttctactctagagcccaccagcctctcagagcctccggtgactggcctgtgtctccccctggatggacatgtggacggcgctgctcatcctgcaagccttgttgctaccctccctggctgatggtgccacccctgccctgcgctttgtagccgtgggtgactggggaggggtccccaatgccccattccacacggcccgggaaatggccaatgccaaggagatcgctcggactgtgcagatcctgggtgcagacttcatcctgtctctaggggacaatttttacttcactggtgtgcaagacatcaatgacaagaggttccaggagacctttgaggacgtattctctgaccgctcccttcgcaaagtgccctggtacgtgctagccggaaaccatgaccaccttggcaatgtctctgcccagattgcatactctaagatctccaagcgctggaacttccccagccctttctaccgcctgcacttcaagatcccacagaccaatgtgtctgtggccatttttatgctggacacagtgacactatgtggcaactcagatgacttcctcagccagcagcctgagaggccccgagacgtgaagctggcccgcacacagctgtcctggctcaagaaacagctggcggcggccagggaggactacgtgctggtggctggccactaccccgtgtggtccatagccgagcacgggcctacccactgcctggtcaagcagctacggccactgctggccacatacggggtcactgcctacctgtgcggccacgatcacaatctgcagtacctgcaagatgagaatggcgtgggctacgtgctgagtggggctgggaatttcatggacccctcaaagcggcaccagcgcaaggtccccaacggctatctgcgcttccactatgggactgaagactcactgggtggctttgcctatgtggagatcagctccaaagagatgactgtcacttacatcgaggcctcgggcaagtccctctttaagaccaggctgccgaggcgagccaggccctgaactcccatgactgcccagctctgaggcccgatctccactgttgggtgggtgggccctgccgggaccctgctcacaggcaggcttttcctccaacctgtggcgctgcagcagggcaggaaggggaaacacagctgatgaactgtggtgccacatgacccttgtggcacagatgcccacgtatgtgaaacacacatggacatgtgtcccagccacagtgttatgctctgtggctggctcacctttgctgagttccggggtgcaatgggggagggagggagggaaagcttcctcctaaatcaagcatctttctgttactga

SEQ ID NO: 103787 - DNA, 1555 bp, Homo sapiens
  Payload ID: 398
  Gene Symbol: ACP6
  Gene Name: acid phosphatase 6, lysophosphatidic
  ENST ID: ENST00000392988
  CDS Start-End: 231-917
aaaactcccagggactcttcgctgctgccacctcttgttctctcccccgttcccactcggggtctccctcagggccgggaggcacagcggtccctgcttgctgaagggctggatgtacgcatccgcaggttcccgcggacttgggggcgcccgctgagccccggcgcccgcagaagacttgtgtttgcctcctgcagcctcaacccggagggcagcgagggcctaccaccatgatcactggtgtgttcagcatgcgcttgtggaccccagtgggcgtcctgacctcgctggcgtactgcctgcaccagcggcgggtggccctggccgagctgcaggaggccgatggccagtgtccggtcgaccgcagcctgctgaagttgaaaatggtgcaggtcgtgtttcgacacggggctcggagtcctctcaagccgctcccgctggaggagcaggggggcatgtttgctgggcagctgaccaaggtgggcatgcagcaaatgtttgccttgggagagagactgaggaagaactatgtggaagacattccctttctttcaccaaccttcaacccacaggaggtctttattcgttccactaacatttttcggaatctggagtccacccgttgtttgctggctgggcttttccagtgtcagaaagaaggacccatcatcatccacactgatgaagcagattcagaagtcttgtatcccaactaccaaagctgctggagcctgaggcagagaaccagaggccggaggcagactgcctctttacagccaggaatctcagaggatttgaaaaaggtgaaggacaggatgggcattgacagtagtgataaagtggacttcttcatcctcctggacaacgtggctgccgagcaggagaagatgggctcctgcaggttccatggaagctgatcagctgccagaatcagtaggtaagaagcatttttttctaaaactacatgtggccctttcaggcacacaacctcccaagctgccccatgctgaagagatttgcaaggatgatcgaacagagagctgtggacacatccttgtacatactgcccaaggaagacaggtgaggggctctcactgctggcatgaagtcacgcttggtcagacatccaagtgtatggggaagaggagttcatcaggcccactcacacctgacagctgatgtctcctcgtgtaaggaggctgaaccccattctgcccacctaccagtaggccctaggtcctcgcacttctacagctgggactggtggcctagtgcttctgttccctgttatgcagaaccaggagccaccaccctcatgactttatcacttgccttttccttttgctttaaggtttaaaggatttgggtggggggagctgaagaaagaatattcatttctgtctttagtcatcatgttacaatttgcaaaccattttcacattctcactgtgaggtgagagagatacctttctccctggctttatagataaagaaactgaggctgggagatattgcctacctggtctaggcccagctagcaagtgatggagccaga

SEQ ID NO: 103788 - DNA, 6923 bp, Homo sapiens
  Payload ID: 398
  Gene Symbol: ACP6
  Gene Name: acid phosphatase 6, lysophosphatidic
  ENST ID: ENST00000583509
  CDS Start-End: 449-1735
ggaggtgggtaggagcttgcttatagaaaagtggaatcgagtagtccttgctggtggagccgctgccgccagggaactcagggccggctcctgttccttcaagagtgctggaggccaaacttgaaatacaagtttaatgttcctcgtcgggcaaaagataaggatccgatctcccccggcccggtgtgcagcaggagcgaccaaccccgacccgggttaaaactcccagggactcttcgctgctgccacctcttgttctctcccccgttcccactcggggtctccctcagggccgggaggcacagcggtccctgcttgctgaagggctggatgtacgcatccgcaggttcccgcggacttgggggcgcccgctgagccccggcgcccgcagaagacttgtgtttgcctcctgcagcctcaacccggagggcagcgagggcctaccaccatgatcactggtgtgttcagcatgcgcttgtggaccccagtgggcgtcctgacctcgctggcgtactgcctgcaccagcggcgggtggccctggccgagctgcaggaggccgatggccagtgtccggtcgaccgcagcctgctgaagttgaaaatggtgcaggtcgtgtttcgacacggggctcggagtcctctcaagccgctcccgctggaggagcaggtagagtggaacccccagctattagaggtcccaccccaaactcagtttgattacacagtcaccaatctagctggtggtccgaaaccatattctccttacgactctcaataccatgagaccaccctgaaggggggcatgtttgctgggcagctgaccaaggtgggcatgcagcaaatgtttgccttgggagagagactgaggaagaactatgtggaagacattccctttctttcaccaaccttcaacccacaggaggtctttattcgttccactaacatttttcggaatctggagtccacccgttgtttgctggctgggcttttccagtgtcagaaagaaggacccatcatcatccacactgatgaagcagattcagaagtcttgtatcccaactaccaaagctgctggagcctgaggcagagaaccagaggccggaggcagactgcctctttacagccaggaatctcagaggatttgaaaaaggtgaaggacaggatgggcattgacagtagtgataaagtggacttcttcatcctcctggacaacgtggctgccgagcaggcacacaacctcccaagctgccccatgctgaagagatttgcaaggatgatcgaacagagagctgtggacacatccttgtacatactgcccaaggaagacagggaaagtcttcagatggcagtaggcccattcctccacatcctagagagcaacctgctgaaagccatggactctgccactgcccccgacaagatcagaaagctgtatctctatgcggctcatgatgtgaccttcataccgctcttaatgaccctggggatttttgaccacaaatggccaccgtttgctgttgacctgaccatggaactttaccagcacctggaatctaaggagtggtttgtgcagctctattaccacgggaaggagcaggtgccgagaggttgccctgatgggctctgcccgctggacatgttcttgaatgccatgtcagtttataccttaagcccagaaaaataccacgcactctgctctcaaactcaggtgatggaagttggaaatgaagagtaactgatttataaaagcaggatgtgttgattttaaaataaagtgcctttatacaatgcctcctgctttgtgtgtttgggaagaggagagagcaaggggtaatgtactttaatataatgtaaggatatttcctttctgtgggtttactaagatttcttcctgaacggaaaaggggtataatattgagaccaaaaggatatttctctattttgtgagttggtttctaaggttagaagcatctttgtgtgacacgggctggggacatcatgaccctgtagaattgtgtcggttttggactttagttcttttctcctatattaatttcacatgtattgagctacctactaagtagtgatcattataaaggtgaaaacactctgccctcaagttgttgcagtccagtgggagaggcagccgagtaaatcagtgatacagtgctgtatgttttatgctgtaataggtatttgaggggctatttgggtatagagaagaaacttcctgctcacatggcaggggatgtggggaacagtcaaggaaggcttctgaaaaagtcctggcctgatctgagtagagaaaggtgggtaggagttaaccaggaaagcaaggatgaaagcgtgttgcgtttagataaaggataggcttcaaggtcagggaacgttgctgggtggtgagatggaaccctgatgtggaggctcagcaggaagaagcaggaaggacactgggcccctggtggttttagttccagaaacaaatgtgggccccagggctctgcaatggtaaggctggaactactcaacataagagctccacctttaactgtgccccctaagagtacctgatgatccccctatctccttgtcaatgttgctgttcttctccagaatctatttcaacccttctctgatttcaaaccaccagtccctttacctctcagagaaaacagcaaccacaaaagcctctccacttcctactatcttaatattgacaacttccagatcagggagctgagatatctcaagctcaggtttctcttctgagcttcagacacttttatccacttggatttcactggcacaaaactttccatgttagaatcaaacccccctcctcccagacctgcttctcccacacacttccctatctgaatgaaagacacctccactctccacccagttgccaaatcagaaatctgtctttgttttctttgtctcacattttcctatgtctaatcagttaagttttatcaatactacctgtttatttctttaatctattcacatatctttatcctcaatcttcagcatccccttcccatcctcagtctgctggttactgtatttcctattttactaagaatctaaaagagatcagaagaaaacttccacatcccccaacacccaaccaccaaatctgctaacccagttgcattggtgcttttatagccttccttcctccctcttactaagaatgaaccaacactattcctatcaaagcccaaccctctagctttacattgactcctagtgtcttttttctggattgtcaatttttttcctgaccaattattctattagcaatacaaatatgctgtaaaatctcttaaacttttttctctgcatctttgaactgctgttctcttttccttctccccttcatagcagaactcctcaaaagagttgctacctctaattcttcccttccagttctctcatgaaccagctacaattaagtattcacccccaccactccatggaaactgctcttgtcaaaatcatcaatagcctttgtgtggtgaatccaatagccagttttcattcttcttactaagcttctcatcagtattcctagactatttccttcactggcttcgacaaatgctttcttggttttcctccaatttctcgactttgttcctgctgaatctacctttttctaatccgtaagtgttggggtgtcccagggcttactccttggaccttttttccaccttttcccctacactcacccactaggtgatctcaagaatttccagtttgaggccgggcgcggtggctcacgcctgtaatcccagcactttgggaggccaaggcaggcagatcacctgaggccaggagttcgagaccagcctggccaacatggcaaaaccctgtctccactaaacctgcctctactaaaaatacaaaaattattatatttttataaaattattataattttataaaattattatatttatggagtacaatgtgatgtaatcccagctactcggaaggctgtatgtgtctatttatggagtacaatgtgcctgtaatcccagctacttgggaggctgaggcaggagaatcacttcaacctaggaggcagaggttgtgctgagccaagatcgtgccattgcactccagcctgggcaacaagagagaaataacatctcaaaaaaaaaaaaagaatttccagttttaaatatttacacaatgtctcctaaatttataccttcaacctagacctttccctgtgaatcccagtctcatttccaacagtctaatcaatgtctctatttggatgtttaagatatacaataggtatcaaacttcccattgtccacaataaactctcaatttccgtgccttttcaaacttactccttccacaggctttcccatctaggtaaatgacaccaccattcaccctgttgctttggccaagaactttagaactgcccttgactcccctctttttctcatatcctacctctactacatcagtaactcctgttgtatctctcttcaaactatatccagaattgaccatgtcccaatacttccattgctactgtcttagtcccagtgtcatcttttacctggattattgtaaaggcctcgtaactagtcttcctgtttctgcccttcccttctctgcccatctattctcaacacagtgttgcttttaaaacaaagtaagatcgtgccactcttctgctctaaattccccattggtttctcatctcaaactaagggccagtcataatgccctcacggtcctatgacatctcactgcaccccagccatactcgccatcttaccattcttcttcttttttgtaataaaaactttttactttctttttagttgacagataataattgcgtatatttatggagtacaatgtgatgttttgatatatgtatgcatgagggaatgattaaatcaagctaattaacatattcatcacttcatctactcatcactttcttgtggtgaaaatgtttcagatatactctttagtagttttcaggtgtacagtcgctgtggtttgagtgcttttgtcttctctaaatttgatgttgacacttagtgcccagtacaatgttactgggaggtggagcctaatggggatgtttaatggattaatgccattataaaaagggcttgcaggaatgggttccttctcttttgcttttctgccatatgatgacaaagtgttcctcctctctggaggatgcagcaacaggcaccatctttgaagcagagagaccaggccctaaccttctggtgccttgatcttggacttctcagcttccagaactgtgagataataaatttctgttcattacaaattaccccatctgtggtattctgttatagcaacacaaaatggactaagacaacagtatactgttatgaactatggtcaccatgctgtgcactagatcacaaaaacttatttctactgtttaactgaaactttgtacattttgactaacatctccctttttcccatcatcccatcccattcttactatcgttgaagatggagtatgccaagtagtcctgagccatgtcctcacctcggggtgagcacctgttgttcctgtgcctggaatgctctcctagacatttgcgtggctagctccctcttttcattcagatctcagctcattgtcatctcagagaggccctccttgccctccttctacctcctgccttaggtatactctgccaccttctgtcatgggctgaattgtgtcccccctaaatccatatgttgacatcttaacccctagtacagtaagtcctcacttgatgctatcaataggctcttggaaatgtcggctttcagtgaaaggacatatagcaggtccttgaataacattgtgttttgttcaacatcgttgccttgtaacactgatgagcaaaacagttggttctctaatatgttgttttacttaaagctacagtttccaagaacctatcaatgatgttgaggactgaatgtacctcaggtgtaatgtatttggagatagggccttttaagaggtaaagtaaatgaggtcatatgggtaggctgtaatccaatatgactggaatccttataagaagaggaaatgaggacacagacacagagggaagatgactatctgcaagtcaaggagagaggcctcagaagaaaccaatgctgctgacaccacgatcttggacttctagcctctagcactgtgaggaaataaatttctgttgtttaagccacctagtctgtgatactttgctacggcaggccctagcaaatgaatacacttgtcttgtctttcccccgccctgtgatatttatcagtgccggatattacatatttgtgtatctatatgcttatttccctgactaaaatggaagctccatgaaggcagatttcctcttgttcactgatgtgtccccagcacctggaatagtgcctagtgcatgccagtgctcagacacttggacatttgaatgacatatcccctctgtcacttctctccggggcccaaggccaccctcctaggttaccacagtggcttcctaatgggccataccctcacttgctttccatcaccccctgagacctggcccctgcatacctctccagcttcacccctcacatatctccctagccagacctatagtatgtttaaaaaaaaaggaaatcgcactcctctggcctctttaccttggcacacatttttccatcacctgacccctgacccacactcccttttcctgtgtaatccaattatctctaggcctcccgtgtttctgtttgtccttcaatagaaggttgtttgtcttgtcttttattgtatttctagaaccaagtgcagagactgtacaaagtggacctcagcaaagatttaccgaatgaataaatgagttcagaacgctga

SEQ ID NO: 103789 - DNA, 1874 bp, Homo sapiens
  Payload ID: 398
  Gene Symbol: ACP6
  Gene Name: acid phosphatase 6, lysophosphatidic
  ENST ID: ENST00000609196
  CDS Start-End: 1-473
cccgttgtttgctggctgggcttttccagtgtcagaaagaaggacccatcatcatccacactgatgaagcagattcagaagtcttgtatcccaactaccaaagctgctggagcctgaggcagagaaccagaggccggaggcagactgcctctttacagccaggaatctcagaggatttgaaaaaggtgaaggacaggatgggcattgacagtagtgataaagtggacttcttcatcctcctggacaacgtggctgccgagcaggcacacaacctcccaagctgccccatgctgaagagatttgcaaggatgatcgaacagagagctgtggacacatccttgtacatactgcccaaggaagacagggaaagtcttcagatggcagtaggcccattcctccacatcctagagagcaacctgctgaaagccatggactctgccactgcccccgacaagatcaggacttgcaggtagcaagcataacaggaatgaagaaaattctagggcttttccagcctcattgacaaggaaaaagcaaactactcttcattgcagtgttgacatttcaaaactggcatttaattatttacatactttcatatattaaggtacatatacatgtgtataagtaaatctgtatgtgtatatgtgtgtataaaagttttcaatagctcgactactcacagctatcctagagaattttaccaaagcccaggagatcttctgcagtttggagaacaaaataaatcacagtaatccaccatcccctgtaatcaaatacattttgactgaacccaataacaatgactcagtttctagcaaggtgccagacgcagcccttgtcttcatttgacgctgagaaccgagcagccagaagccagtactccagagcccgtaaagcaccgccaaaagcgtggccttagatcacagattgattcatggggatgggcaggagtctccagggaaaacagctcatggggtagctgttgagcttctatgtgggaagtgaggaaaatgaaagctcctggaagcttggtaaagatgagaaacaaacatgagctcctggggtctttaataaagagaacttcggctgtagaaaacaaaaagattattgaaaactaaattcaccctcaacactaattaattggacactggatataactgagatttgtaagctgtttctgcccttgaccctggctccagcctctggagaatggaagagtgtggctagcacagagctgcgggtcagcccctcatgagagggagttgctggtctaggtgcaggtgctgaggtatgagaaacccagccgcccagagccacacagcaacacgcccagctggccccggtgaagacatgcagtttcctagggctgggtctctttaacctgttctttggaaccccagggtacccacataattgttcgtggacactaagcaggtattttgcaagagaaatctggtttctttcgtgtttggtgaaataactgaattttcccatgctttaactatgtgtgaggaaataatttctggttcttctgtttattttctctttctatggtcatacatacactcaccgtcttcctctgacagtattgattaccaagcacaattaagcactgagacagaaagttaacagctgaagtggggtcacctataggcagaaaatagattcgtgtctgtttaacagtaacccaaataagaagccatgttaaatagagacaacttttattacaatccttatagcataccttccttttaacattatttttatgatttagctccctccaataggaaatgtttggccacccactggttttgtgctttatatacttattgctttaaatgtgttattaaaatcttaccaccaaattagga

SEQ ID NO: 103790 - DNA, 543 bp, Homo sapiens
  Payload ID: 398
  Gene Symbol: ACP6
  Gene Name: acid phosphatase 6, lysophosphatidic
  ENST ID: ENST00000493129
  CDS Start-End: 115-543
tccttgctggtggagccgctgccgccagggaactcagggccggctcctgttccttcaagactgcaggaggccgatggccagtgtccggtcgaccgcagcctgctgaagttgaaaatggtgcaggtcgtgtttcgacacggggctcggagtcctctcaagccgctcccgctggaggagcaggtagagtggaacccccagctattagaggtcccaccccaaactcagtttgattacacagtcaccaatctagctggtggtccgaaaccatattctccttacgactctcaataccatgagaccaccctgaaggggggcatgtttgctgggcagctgaccaaggtgggcatgcagcaaatgtttgccttgggagagagactgaggaagaactatgtggaagacattccctttctttcaccaaccttcaacccacaggaggtctttattcgttccactaacatttttcggaatctggagtccacccgttgtttgctggctgggcttttccagtgtcagaaagaaggacccatcatcatccacactgat

SEQ ID NO: 103791 - DNA, 885 bp, Homo sapiens
  Payload ID: 398
  Gene Symbol: ACP6
  Gene Name: acid phosphatase 6, lysophosphatidic
  ENST ID: ENST00000620634
  CDS Start-End: 232-465
taaaactcccagggactcttcgctgctgccacctcttgttctctcccccgttcccactcggggtctccctcagggccgggaggcacagcggtccctgcttgctgaagggctggatgtacgcatccgcaggttcccgcggacttgggggcgcccgctgagccccggcgcccgcagaagacttgtgtttgcctcctgcagcctcaacccggagggcagcgagggcctaccaccatgatcactggtgtgttcagcatgcgcttgtggaccccagtgggcgtcctgacctcgctggcgtactgcctgcaccagcggcgggtggccctggccgagctgcaggaggccgatggccagtgtccggtcgaccgcagcctgctgaagttgaaaatggtgcaggtcgtgtttcgacacggggctcggagtcctctcaagccgctcccgctggaggagcagtattcgttccactaacatttttcggaatctggagtccacccgttgtttgctggctgggcttttccagtgtcagaaagaaggacccatcatcatccacactgatgaagcagattcagaagtcttgtatcccaactaccaaagctgctggagcctgaggcagagaaccagaggccggaggcagactgcctctttacagccaggaatctcagaggatttgaaaaaggtgaaggacaggatgggcattgacagtagtgataaagtggacttcttcatcctcctggacaacgtggctgccgagcaggagaagatgggctcctgcaggttccatggaagctgatcagctgccagaatcagtaggtaagaagcatttttttctaaaactacatgtggccctttcaggcacacaacctcccaagctgccccatgctgaagaga

SEQ ID NO: 103792 - DNA, 1258 bp, Homo sapiens
  Payload ID: 398
  Gene Symbol: ACP6
  Gene Name: acid phosphatase 6, lysophosphatidic
  Uniprot ID: Q9NPH0
  ENST ID: ENST00000487562
  CDS Start-End: 1-816
atgatcactggtgtgttcagcatgcgcttgtggaccccagtgggcgtcctgacctcgctggcgtactgcctgcaccagcggcgggtggccctggccgagctgcaggaggccgatggccagtgtccggtcgaccgcagcctgctgaagttgaaaatggtgcaggtcgtgtttcgacacggggctcggagtcctctcaagccgctcccgctggaggagcaggtagagtggaacccccagctattagaggtcccaccccaaactcagtttgattacacagtcaccaatctagctggtggtccgaaaccatattctccttacgactctcaataccatgagaccaccctgaaggggggcatgtttgctgggcagctgaccaaggtgggcatgcagcaaatgtttgccttgggagagagactgaggaagaactatgtggaagacattccctttctttcaccaaccttcaacccacaggaggtctttattcgttccactaacatttttcggaatctggagtccacccgttgtttgctggctgggcttttccagtgtcagaaagaaggacccatcatcatccacactgatgaagcagattcagaagtcttgtatcccaactaccaaagctgctggagcctgaggcagagaaccagaggccggaggcagactgcctctttacagccaggaatctcagaggatttgaaaaaggtgaaggacaggatgggcattgacagtagtgataaagtggacttcttcatcctcctggacaacgtggctgccgagcaggagaagatgggctcctgcaggttccatggaagctgatcagctgccagaatcagtagggaaagtcttcagatggcagtaggcccattcctccacatcctagagagcaacctgctgaaagccatggactctgccactgcccccgacaagatcaggtacctggcacagcaactctgctttgtgcagctaagggccgtgggaacttctggctgtagggagggaacccaaatcttagtgaggcaagaaccaggctgtcagtgaccgaaggtagatgtttaacaggcctcaagtgtcaaagaggttcacaatcttttaacctttcttcctgctgcacccctcctaccatgttttgaaaattttatttttgctttctctctctcttttttttattaattgaagatatgtcaaacagtagccaattatgatgtcacactgatttgatatgataatagtccaaaacaaagataaattgcttaatgga

SEQ ID NO: 103793 - DNA, 562 bp, Homo sapiens
  Payload ID: 398
  Gene Symbol: ACP6
  Gene Name: acid phosphatase 6, lysophosphatidic
  ENST ID: ENST00000611629
  CDS Start-End: 1-499
cgactctcaataccatgagaccaccctgaaggggggcatgtttgctgggcagctgaccaaggtgggcatgcagcaaatgtttgccttgggagagagactgaggaagaactatgtggaagacattccctttctttcaccaaccttcaacccacaggaggtctttattcgttccactaacatttttcggaatctggagtccacccgttgtttgctggctgggcttttccagtgtcagaaagaaggacccatcatcatccacactgatgaagcagattcagaagtcttgtatcccaactaccaaagctgctggagcctgaggcagagaaccagaggccggaggcagactgcctctttacagccaggaatctcagaggatttgaaaaaggtgaaggacaggatgggcattgacagtagtgataaagtggacttcttcatcctcctggacaacgtggctgccgagcaggagaagatgggctcctgcaggttccatggaagctgatcagctgccagaatcagtaggtaagaagcatttttttctaaaactacatgtggccctttcagg

SEQ ID NO: 103794 - DNA, 1783 bp, Homo sapiens
  Payload ID: 399
  Gene Symbol: ACPP
  Gene Name: acid phosphatase, prostate
  Uniprot ID: P15309
  ENST ID: ENST00000351273
  CDS Start-End: 51-1307
gaagtggtagcagttcctcctaactcctgccagaaacagctctcctcaacatgagagctgcacccctcctcctggccagggcagcaagccttagccttggcttcttgtttctgctttttttctggctagaccgaagtgtactagccaaggagttgaagtttgtgactttggtgtttcggcatggagaccgaagtcccattgacacctttcccactgaccccataaaggaatcctcatggccacaaggatttggccaactcacccagctgggcatggagcagcattatgaacttggagagtatataagaaagagatatagaaaattcttgaatgagtcctataaacatgaacaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcagttgctatacctgcctttcaggaactgccctcgttttcaagaacttgagagtgagactttgaaatcagaggaattccagaagaggctgcacccttataaggattttatagctaccttgggaaaactttcaggattacatggccaggacctttttggaatttggagtaaagtctacgaccctttatattgtgagagtgttcacaatttcactttaccctcctgggccactgaggacaccatgactaagttgagagaattgtcagaattgtccctcctgtccctctatggaattcacaagcagaaagagaaatctaggctccaagggggtgtcctggtcaatgaaatcctcaatcacatgaagagagcaactcagataccaagctacaaaaaactcatcatgtattctgcgcatgacactactgtgagtggcctacagatggcgctagatgtttacaacggactccttcctccctatgcttcttgccacttgacggaattgtactttgagaagggggagtactttgtggagatgtactatcggaatgagacgcagcacgagccgtatcccctcatgctacctggctgcagccccagctgtcctctggagaggtttgctgagctggttggccctgtgatccctcaagactggtccacggagtgtatgaccacaaacagccatcaagttctaaaggtcatctttgctgttgccttttgcctgatatctgctgtcctaatggtactactgtttatccacattcgccgtggactctgctggcagagagaatcctatgggaacatctgaacagacagctggataagccaggccaacctcctgtgacacagcatctctcagtggtgccgcatctaaaggacaggcttttgccatgtgggcattgccatcctcacaccctgccttttgaatctgcccagagcagggtctgaactcacagtgacccacaggctgctgctggatgaacactcaggctacctaggtcttctcataatggagtggtagtgcaggctgcttgttcagctagaaagaggctgttatgcataggatggttgtattctctgccacagttgtccggagagaaataagaagccaaactccaatcagccttttacctgcaaagagtgaagggtgagaaggtggacaaagacatagattagaaaaatactggatattgggggaagttagactagaagtattattatacagggtgattcttacgaaagaagacccaatcataaattataaataaactttttatttagcta

SEQ ID NO: 103795 - DNA, 3125 bp, Homo sapiens
  Payload ID: 399
  Gene Symbol: ACPP
  Gene Name: acid phosphatase, prostate
  Uniprot ID: P15309
  ENST ID: ENST00000336375
  CDS Start-End: 91-1251
tcaatcccttaattaaatagcttcccctctacaggcttttgaagtggtagcagttcctcctaactcctgccagaaacagctctcctcaacatgagagctgcacccctcctcctggccagggcagcaagccttagccttggcttcttgtttctgctttttttctggctagaccgaagtgtactagccaaggagttgaagtttgtgactttggtgtttcggcatggagaccgaagtcccattgacacctttcccactgaccccataaaggaatcctcatggccacaaggatttggccaactcacccagctgggcatggagcagcattatgaacttggagagtatataagaaagagatatagaaaattcttgaatgagtcctataaacatgaacaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcagttgctatacctgcctttcaggaactgccctcgttttcaagaacttgagagtgagactttgaaatcagaggaattccagaagaggctgcacccttataaggattttatagctaccttgggaaaactttcaggattacatggccaggacctttttggaatttggagtaaagtctacgaccctttatattgtgagagtgttcacaatttcactttaccctcctgggccactgaggacaccatgactaagttgagagaattgtcagaattgtccctcctgtccctctatggaattcacaagcagaaagagaaatctaggctccaagggggtgtcctggtcaatgaaatcctcaatcacatgaagagagcaactcagataccaagctacaaaaaactcatcatgtattctgcgcatgacactactgtgagtggcctacagatggcgctagatgtttacaacggactccttcctccctatgcttcttgccacttgacggaattgtactttgagaagggggagtactttgtggagatgtactatcggaatgagacgcagcacgagccgtatcccctcatgctacctggctgcagccccagctgtcctctggagaggtttgctgagctggttggccctgtgatccctcaagactggtccacggagtgtatgaccacaaacagccatcaaggtactgaagacagtacagattagtgtgcacagagatctctgtagaaggagtagctgccctttctcagggcagatgatgctttgagaacatactttggccattacccccagctttgaggaaaatgggctttggatgattattttatgttttagggacccccaacctcaggcaattcctacctcttcacctgaccctgcccccacttgccataaaacttagctaagttttgttttgtttttcagcgttaatgtaaaggggcagcagtgccaaaatataatcagagataaagcttaggtcaaagttcatagagttcccatgaactatatgactggccacacaggatcttttgtatttaaggattctgagattttgcttgagcaggattagataaggctgttctttaaatgtctgaaatggaacagatttcaaaaaaaaaccccacaatctaggatgggaacaaggaaggaaagatgtgaataggctgatgggcaaaaaaccaatttacccatcagttccagccttctctcaaggagaggcaaagaaaggagatacagtggagacatctggaaagttttctccactggaaaactgctactatctgtttttatatttctgttaaaatatatgaggctacagaactaaaaattaaaacctctttgtgtcccttggtcctggaacatttatgttccttttaaagaaacaaaaatcaaactttacagaaagatttgatgtatgtaatacatatagcagctcttgaagtatatatatcatagcaaataagtcatctgatgagaacaagctatttgggcacaacacatcaggaaagagagcaccacgtgatggagtttctctagaagctccagtgataagagatgttgactctaaagttgatttaaggccaggcatggtggtttacgcctataatcccagcattttgggagtccgaggtgggcagatcacttgagctcaggaggtcaagatcagcctgggcaacatggtgaaacctggtctctacataaaatacaaaaacttagatgggcatggtggtgtgtgcctatagtcccactacttgtggggctaaggcaggaggatcacttgagccccggaggtcgaggctacagtgagccaagagtgcactactgtactccagccagggcaagagagcgagaccctgtctcaataaataaataaataaataaataaataaataaataaataaataaaaacaaagttgattaagaaaggaagtataggccaggcacagtggctcacacctgtaatccttgcattttggaaggctgaggcaggaggatcactttaggcctggtgtgttcaagaccagcctggtcaacatagtgagacactgtctctaccaaaaaaaggaaggaagggacacatatcaaactgaaacaaaattagaaatgtaattatgttctaagtgcctccaagttcaaaacttattggaatgttgagagtgtggttacgaaatacgttaggaggacaaaaggaatgtgtaagtctttaatgccgatatcttcagaaaacctaagcaaacttacaggtcctgctgaaactgcccactctgcaagaagaaatcatgatatagctttgccatgtggcagatctacatgtctagagaacactgtgctctattaccattatggataaagatgagatggtttctagagatggtttctactggctgccagaatctagagcaaagccatccccgctcctggttggtcacagaatgactgacaaagacatcgattgatatgcttctttgtgttatttccctcccaagtaaatgtttgtccttgggtccattttctatgcttgtaactgtcttctagcagtgagccaaatgtaaaatagtgaataaagtcattattaggaa

SEQ ID NO: 103796 - DNA, 1242 bp, Homo sapiens
  Payload ID: 399
  Gene Symbol: ACPP
  Gene Name: acid phosphatase, prostate
  Uniprot ID: P15309
  ENST ID: ENST00000475741
  CDS Start-End: 52-1113
tgaagtggtagcagttcctcctaactcctgccagaaacagctctcctcaacatgagagctgcacccctcctcctggccagggcagcaagccttagccttggcttcttgtttctgctttttttctggctagaccgaagtgtactagccaaggagttgaagtttgtgactttggtgtttcggcatggagaccgaagtcccattgacacctttcccactgaccccataaaggaatcctcatggccacaaggatttggccaactcacccagctgggcatggagcagcattatgaacttggagagtatataagaaagagatatagaaaattcttgaatgagtcctataaacatgaacaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcaggattttatagctaccttgggaaaactttcaggattacatggccaggacctttttggaatttggagtaaagtctacgaccctttatattgtgagagtgttcacaatttcactttaccctcctgggccactgaggacaccatgactaagttgagagaattgtcagaattgtccctcctgtccctctatggaattcacaagcagaaagagaaatctaggctccaagggggtgtcctggtcaatgaaatcctcaatcacatgaagagagcaactcagataccaagctacaaaaaactcatcatgtattctgcgcatgacactactgtgagtggcctacagatggcgctagatgtttacaacggactccttcctccctatgcttcttgccacttgacggaattgtactttgagaagggggagtactttgtggagatgtactatcggaatgagacgcagcacgagccgtatcccctcatgctacctggctgcagccccagctgtcctctggagaggtttgctgagctggttggccctgtgatccctcaagactggtccacggagtgtatgaccacaaacagccatcaaggtactgaagacagtacagattagtgtgcacagagatctctgtagaaggagtagctgccctttctcagggcagatgatgctttgagaacatactttggccattacccccagctttgaggaaaatgggctttggatgattattttatgttttag

SEQ ID NO: 103797 - DNA, 584 bp, Homo sapiens
  Payload ID: 399
  Gene Symbol: ACPP
  Gene Name: acid phosphatase, prostate
  ENST ID: ENST00000495911
  CDS Start-End: 89-584
aatcccttaattaaatagcttcccctctacaggcttttgaagtggtagcagttcctcctaactcctgccagaaacagctctcctcaacatgagagctgcacccctcctcctggccagggcagcaagccttagccttggcttcttgtttctgctttttttctggctagaccgaagtgtactagccaaggagttgaagtttgtgactttggtgtttcggcatggagaccgaagtcccattgacacctttcccactgaccccataaaggaatcctcatggccacaaggatttggccaactcacccaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcagttgctatacctgcctttcaggaactgccctcgttttcaagaacttgagagtgagactttgaaatcagaggaattccagaagaggctgcacccttataaggattttatagctaccttgggaaaacttt

SEQ ID NO: 103798 - DNA, 496 bp, Homo sapiens
  Payload ID: 399
  Gene Symbol: ACPP
  Gene Name: acid phosphatase, prostate
  ENST ID: ENST00000507647
  CDS Start-End: 1-299
cggaattgtactttgagaagggggagtactttgtggagatgtactatcggaatgagacgcagcacgagccgtatcccctcatgctacctggctgcagccccagctgtcctctggagaggtttgctgagctggttggccctgtgatccctcaagactggtccacggagtgtatgaccacaaacagccatcaaggtcctgctgaaactgcccactctgcaagaagaaatcatgatatagctttgccatgtggcagatctacatgtctagagaacactgtgctctattaccattatggataaagatgagatggtttctagagatggtttctactggctgccagaatctagagcaaagccatccccgctcctggttggtcacagaatgactgacaaagacatcgattgatatgcttctttgtgttatttccctcccaagtaaatgtttgtccttgggtccattttctatgcttgtaactgtcttctagcagtgagccaaa

SEQ ID NO: 103799 - DNA, 1347 bp, Homo sapiens
  Payload ID: 400
  Gene Symbol: ACPT
  Gene Name: acid phosphatase, testicular
  Uniprot ID: Q9BZG2
  ENST ID: ENST00000270593
  CDS Start-End: 1-1281
atggccggcctggggttttggggccaccctgctggacctctcctgctgctgctgctgctggtgctgccaccccgggccctgccagaaggacccctggtgttcgtggctctggtattccgccatggcgaccgggccccgctggcctcctaccccatggacccacacaaggaggtggcctccaccctgtggccacgaggcctgggccagctgaccacggagggggtccgccagcagctggagctgggccgcttcctgaggagccgctacgaggccttcctgagtccggagtaccggcgggaggaggtgtacatccgcagcacggactttgaccgcacgctggagagtgcccaggccaaccttgccgggctgtttcccgaggctgctccagggagccccgaggcccgctggaggccgatcccggtgcacacggtgcccgtggctgaggataagctgctgaggttccccatgcgcagctgtccccgataccacgagctgctgcgggaggccaccgaggccgccgagtaccaggaggccctggagggctggacgggcttcctgagtcgcctggagaacttcacgggactgtcgctggttggagagccactgcgcagggcatggaaggttctggacaccctcatgtgccagcaagcccacggtcttccactaccagcctgggcctccccagatgtcctgcggactcttgcccagatctcggctttggatattggagcccacgtgggcccaccccgggcagcagagaaggcccagctgacaggggggatcctgctgaatgctatccttgcaaacttctcccgggtccagcgcctggggctgcccctcaagatggtcatgtactcagctcatgacagcaccctgctggccctccagggggccctgggcctctatgatggacacaccccgccatatgctgcctgcctcggctttgagttccggaagcacctggggaatcccgccaaagatggagggaatgtcaccgtctccctcttctaccgcaatgactccgcccacctgcccctgcctctcagcctccccgggtgcccggccccctgtccactaggccgcttctaccagctgactgccccggcccggcctcccgcccatggggtctcctgccatggcccctatgaggctgccatccccccagctccagtggtgcccctgctggccggagctgtagctgtgctggtggcactcagcttggggctgggcctgctggcctggagaccagggtgcctgcgggccttggggggccccgtgtgagccagaaaccagggcttccctacccccagctgacactggaccccaacatgtatgctcagtagctgc

SEQ ID NO: 103800 - DNA, 4072 bp, Homo sapiens
  Payload ID: 401
  Gene Symbol: ASIC1
  Gene Name: acid sensing (proton gated) ion channel 1
  Uniprot ID: P78348
  ENST ID: ENST00000228468
  CDS Start-End: 386-2110
agacagcctcgcagacactcgtaggcgcgcacgcgcaccctctcccctccccctcccctcccgccgcctcccggccggacgatggatccctgcagatcccagggctgagagcaccgcgcaccgcgccgagcccgggcagaccgagccgaggcgagcgagccagcgagccagcgcgcgcgggcgggcggacagatcggagccgagcggggccgggcggggcgctccctgcagggctctgcgcggcgtgccgcggcggccgcgggctccggccccgggccatgagcccctccgcgactcggcgctgagcccgccaccggtccagcgccccaggacccgccgccggctgccggcttgccgaagccccctcaggatcccctcaacaaggatggaactgaaggccgaggaggaggaggtgggtggcgtccagccggtgagcatccaggccttcgccagcagctccacactgcacggcctggcccacatcttctcctacgagcggctgtctctgaagcgggcactgtgggccctgtgcttcctgggctccctggctgtgctgctgtgtgtgtgcacggagcgtgtgcagtactacttccactaccaccatgtcaccaagctcgacgaggtggctgcctctcagcttaccttccctgctgtcacgctgtgcaacctcaacgagttccgctttagccaagtctccaagaatgacctgtatcatgctggggagctgctggccctgctcaacaacaggtatgagataccagacacacagatggcagatgaaaagcagctggagatactgcaggacaaagccaacttccgcagcttcaaacccaaacccttcaacatgcgtgagttctacgaccgagctgggcacgacattcgagacatgctgctctcctgccacttccggggggaggtctgcagcgctgaagacttcaaggtggtcttcacacgctatggaaagtgctacacgttcaactcgggccgagatgggcggccgcggctgaagaccatgaagggtgggacgggcaatgggctggaaatcatgctggacatccagcaggacgagtacctgcctgtgtggggggagactgacgagacgtccttcgaagcaggcatcaaagtgcagatccatagtcaggatgaacctcctttcatcgaccagctgggctttggcgtggccccaggcttccagacctttgtggcctgccaggagcagcggctcatctacctgcccccaccctggggcacctgcaaagctgttaccatggactcggatttggatttcttcgactcctacagcatcactgcctgccgcatcgactgtgagacgcgctacctggtggagaactgcaactgccgcatggtgcacatgccaggggatgccccatactgtactccagagcagtacaaggagtgtgcagatcctgctctggacttcctggtggagaaggaccaggagtactgcgtgtgtgaaatgccttgcaacctgacccgctatggcaaagagctgtccatggtcaagatccccagcaaagcctcagccaagtacctggccaagaagttcaacaaatctgagcaatacataggggagaacatcctggtgctggacattttctttgaagtcctcaactatgagaccattgaacagaagaaggcctatgagattgcagggctcctgggtgagctgctgatgacacctgtccccttctcatgccatgggcatggcgtggctccctatcatccaaaagcagggtgctcacttctgtcccatgagggtcctccaccccagaggcccttccccaaaccctgttgtcttggtgacatcgggggccagatggggctgttcatcggggccagcatcctcacggtgctggagctctttgactacgcctacgaggtcattaagcacaagctgtgccgacgaggaaaatgccagaaggaggccaaaaggagcagtgcggacaagggcgtggccctcagcctggacgacgtcaaaagacacaacccgtgcgagagccttcggggccaccctgccgggatgacatacgctgccaacatcctacctcaccatccggcccgaggcacgttcgaggactttacctgctgagccccgcaggccgctgaaccaaaggcctagatggggaggactaggagagcgagggggcccccagctgcctcctcacatctgccctggggactccccacactccggggcagatctttcctcttgtctgtggtaaggaaggagtcttgaccatagagtcctctctctgcctctatcccattctttttacatttaacaaaactaatctaaaaaagaactaaaaagggagaacggggcaagggacctcaggctgcccctctctcctccatgctgcctcccctagctcccagcctgaattctgtctatctagctgtctgccatctgagtgtccatctacattctgctgccaccagtcaccaaaggcccttcccagtgaggggtggaagggatctctggggtctggaatttggccccaaaccagagaatgtaccttaagggggagggctagtgtgggggagggaggcttccccagccttaagagaccctctcagcccagtgactgtccccaaacccaagtctcctggcaggaactaaaacctcagccccactctctcacaccatgtggaatctcgtgggggtcggggatccccttaagaagtggtaatggggacaagatgcggccctggtgctgtaggctacatcctgatacctataagttcacccccaccccacagctgctggagagaaatcccaagaggcagcccttcctcaccatcccattaaagaccgggctggttagcgtccagctcagggagaagggcgctagtgcctaacctcactggtccctctcccggaggcccttgtagagggccacgtccataaattttcttatggaactctcccacatcctcttccccaacttcatttgcttctctcaacaacctcatctgcattttctatttctatatgatacagactctatattgctatatctctgtatatactttcccagccctgtctgtctccaccccatcccctcttgtctctgagaaccattctcccaccccaagttccaccttctatgtttctactccctccctggtctctgaatgccttcgcctgtataaagagttggactctctcccctggtgtctgtactgtgtacacacatccctctgagaagcacaaggagacgacacgcgcattgtaacctttgcactgtctcagtggcgacaaaggaagctgtgaatcacaagctctgcctctttctggcctcaccctctcccccaacccgggcaccctcggccctccctgcagccttaacattctcttcccctgctcctcctatcccattgccctctgcccagctgacagtggcatccccagggaaggggttgctgtagagatagcccccacccaggggatggaggtctaccctggacactaagccaagtgtgtcagagacagaagggagctggggattggcgactcctgaagttggggcagtgggatgctgacaggcagaagctgaggtcctcagtcagtggcctttcctccttctgggtgcccagccccctttcctcacctgatacccaagcccaccacttttattttctggtgaggtgggtttgggaggaaagagaggcctagaggaggagttgaaagctctgctgttgtctcaccctatcttaatgagagacaagtgaggtggagggcctgccccccctccctccaccagacactccttccaggcctgagccccaacccctcttcaggccttccttccctagctgtgtcttggtcttcaatcccagaacaggacctgtgagcagctgcattggcctggagctggagagtaaggctgtaggatctttggaatctcttggttcctaagagtttcctcagagatcatacctccccagagggaagcaggaatgaggccaaaaagtgtgcattggataggggaacagcaggcagggctctgggtgacgcatgcctctggtctaataaactgggtttcaacca

SEQ ID NO: 103801 - DNA, 3778 bp, Homo sapiens
  Payload ID: 401
  Gene Symbol: ASIC1
  Gene Name: acid sensing (proton gated) ion channel 1
  Uniprot ID: P78348
  ENST ID: ENST00000447966
  CDS Start-End: 230-1816
gagccagcgagccagcgcgcgcgggcgggcggacagatcggagccgagcggggccgggcggggcgctccctgcagggctctgcgcggcgtgccgcggcggccgcgggctccggccccgggccatgagcccctccgcgactcggcgctgagcccgccaccggtccagcgccccaggacccgccgccggctgccggcttgccgaagccccctcaggatcccctcaacaaggatggaactgaaggccgaggaggaggaggtgggtggcgtccagccggtgagcatccaggccttcgccagcagctccacactgcacggcctggcccacatcttctcctacgagcggctgtctctgaagcgggcactgtgggccctgtgcttcctgggctccctggctgtgctgctgtgtgtgtgcacggagcgtgtgcagtactacttccactaccaccatgtcaccaagctcgacgaggtggctgcctctcagcttaccttccctgctgtcacgctgtgcaacctcaacgagttccgctttagccaagtctccaagaatgacctgtatcatgctggggagctgctggccctgctcaacaacaggtatgagataccagacacacagatggcagatgaaaagcagctggagatactgcaggacaaagccaacttccgcagcttcaaacccaaacccttcaacatgcgtgagttctacgaccgagctgggcacgacattcgagacatgctgctctcctgccacttccggggggaggtctgcagcgctgaagacttcaaggtggtcttcacacgctatggaaagtgctacacgttcaactcgggccgagatgggcggccgcggctgaagaccatgaagggtgggacgggcaatgggctggaaatcatgctggacatccagcaggacgagtacctgcctgtgtggggggagactgacgagacgtccttcgaagcaggcatcaaagtgcagatccatagtcaggatgaacctcctttcatcgaccagctgggctttggcgtggccccaggcttccagacctttgtggcctgccaggagcagcggctcatctacctgcccccaccctggggcacctgcaaagctgttaccatggactcggatttggatttcttcgactcctacagcatcactgcctgccgcatcgactgtgagacgcgctacctggtggagaactgcaactgccgcatggtgcacatgccaggggatgccccatactgtactccagagcagtacaaggagtgtgcagatcctgctctggacttcctggtggagaaggaccaggagtactgcgtgtgtgaaatgccttgcaacctgacccgctatggcaaagagctgtccatggtcaagatccccagcaaagcctcagccaagtacctggccaagaagttcaacaaatctgagcaatacataggggagaacatcctggtgctggacattttctttgaagtcctcaactatgagaccattgaacagaagaaggcctatgagattgcagggctcctgggtgacatcgggggccagatggggctgttcatcggggccagcatcctcacggtgctggagctctttgactacgcctacgaggtcattaagcacaagctgtgccgacgaggaaaatgccagaaggaggccaaaaggagcagtgcggacaagggcgtggccctcagcctggacgacgtcaaaagacacaacccgtgcgagagccttcggggccaccctgccgggatgacatacgctgccaacatcctacctcaccatccggcccgaggcacgttcgaggactttacctgctgagccccgcaggccgctgaaccaaaggcctagatggggaggactaggagagcgagggggcccccagctgcctcctcacatctgccctggggactccccacactccggggcagatctttcctcttgtctgtggtaaggaaggagtcttgaccatagagtcctctctctgcctctatcccattctttttacatttaacaaaactaatctaaaaaagaactaaaaagggagaacggggcaagggacctcaggctgcccctctctcctccatgctgcctcccctagctcccagcctgaattctgtctatctagctgtctgccatctgagtgtccatctacattctgctgccaccagtcaccaaaggcccttcccagtgaggggtggaagggatctctggggtctggaatttggccccaaaccagagaatgtaccttaagggggagggctagtgtgggggagggaggcttccccagccttaagagaccctctcagcccagtgactgtccccaaacccaagtctcctggcaggaactaaaacctcagccccactctctcacaccatgtggaatctcgtgggggtcggggatccccttaagaagtggtaatggggacaagatgcggccctggtgctgtaggctacatcctgatacctataagttcacccccaccccacagctgctggagagaaatcccaagaggcagcccttcctcaccatcccattaaagaccgggctggttagcgtccagctcagggagaagggcgctagtgcctaacctcactggtccctctcccggaggcccttgtagagggccacgtccataaattttcttatggaactctcccacatcctcttccccaacttcatttgcttctctcaacaacctcatctgcattttctatttctatatgatacagactctatattgctatatctctgtatatactttcccagccctgtctgtctccaccccatcccctcttgtctctgagaaccattctcccaccccaagttccaccttctatgtttctactccctccctggtctctgaatgccttcgcctgtataaagagttggactctctcccctggtgtctgtactgtgtacacacatccctctgagaagcacaaggagacgacacgcgcattgtaacctttgcactgtctcagtggcgacaaaggaagctgtgaatcacaagctctgcctctttctggcctcaccctctcccccaacccgggcaccctcggccctccctgcagccttaacattctcttcccctgctcctcctatcccattgccctctgcccagctgacagtggcatccccagggaaggggttgctgtagagatagcccccacccaggggatggaggtctaccctggacactaagccaagtgtgtcagagacagaagggagctggggattggcgactcctgaagttggggcagtgggatgctgacaggcagaagctgaggtcctcagtcagtggcctttcctccttctgggtgcccagccccctttcctcacctgatacccaagcccaccacttttattttctggtgaggtgggtttgggaggaaagagaggcctagaggaggagttgaaagctctgctgttgtctcaccctatcttaatgagagacaagtgaggtggagggcctgccccccctccctccaccagacactccttccaggcctgagccccaacccctcttcaggccttccttccctagctgtgtcttggtcttcaatcccagaacaggacctgtgagcagctgcattggcctggagctggagagtaaggctgtaggatctttggaatctcttggttcctaagagtttcctcagagatcatacctccccagagggaagcaggaatgaggccaaaaagtgtgcattggataggggaacagcaggcagggctctgggtgacgcatgcctctggtctaataaactgggtttcaacca

SEQ ID NO: 103802 - DNA, 1481 bp, Homo sapiens
  Payload ID: 401
  Gene Symbol: ASIC1
  Gene Name: acid sensing (proton gated) ion channel 1
  ENST ID: ENST00000453327
  CDS Start-End: 1-1190
acattcgagacatgctgctctcctgccacttccggggggaggtctgcagcgctgaagacttcaaggtgaagcccatgcaggtggcaaaggagctcaggcgatgcaccctaccaggaacagttttccagggcacacagagggcaagaaagggtgagaaacaggtcttcacacgctatggaaagtgctacacgttcaactcgggccgagatgggcggccgcggctgaagaccatgaagggtgggacgggcaatgggctggaaatcatgctggacatccagcaggacgagtacctgcctgtgtggggggagactgacgagacgtccttcgaagcaggcatcaaagtgcagatccatagtcaggatgaacctcctttcatcgaccagctgggctttggcgtggccccaggcttccagacctttgtggcctgccaggagcagcggctcatctacctgcccccaccctggggcacctgcaaagctgttaccatggactcggatttggatttcttcgactcctacagcatcactgcctgccgcatcgactgtgagacgcgctacctggtggagaactgcaactgccgcatggtgcacatgccaggggatgccccatactgtactccagagcagtacaaggagtgtgcagatcctgctctggacttcctggtggagaaggaccaggagtactgcgtgtgtgaaatgccttgcaacctgacccgctatggcaaagagctgtccatggtcaagatccccagcaaagcctcagccaagtacctggccaagaagttcaacaaatctgagcaatacataggggagaacatcctggtgctggacattttctttgaagtcctcaactatgagaccattgaacagaagaaggcctatgagattgcagggctcctgggtgacatcgggggccagatggggctgttcatcggggccagcatcctcacggtgctggagctctttgactacgcctacgaggtcattaagcacaagctgtgccgacgaggaaaatgccagaaggaggccaaaaggagcagtgcggacaagggcgtggccctcagcctggacgacgtcaaaagacacaacccgtgcgagagccttcggggccaccctgccgggatgacatacgctgccaacatcctacctcaccatccggcccgaggcacgttcgaggactttacctgctgagccccgcaggccgctgaaccaaaggcctagatggggaggactaggagagcgagggggcccccagctgcctcctcacatctgccctggggactccccacactccggggcagatctttcctcttgtctgtggtaaggaaggagtcttgaccatagagtcctctctctgcctctatcccattctttttacatttaacaaaactaatctaaaaaagaactaaaaagggagaacggggcaagggacctcaggctgcccctctctcctccatgctgcctcccctagctcccagcctg

SEQ ID NO: 103803 - DNA, 614 bp, Homo sapiens
  Payload ID: 401
  Gene Symbol: ASIC1
  Gene Name: acid sensing (proton gated) ion channel 1
  ENST ID: ENST00000552633
  CDS Start-End: 1-382
ggagaacatcctggtgctggacattttctttgaagtcctcaactatgagaccattgaacagaagaaggcctatgagattgcagggctcctgggtgacatcgggggccagatggggctgttcatcggggccagcatcctcacggtgctggagctctttgactacgcctacgaggtcattaagcacaagctgtgccgacgaggaaaatgccagaaggaggccaaaaggagcagtgcggacaagggcgtggccctcagcctggacgacgtcaaaagacacaacccgtgcgagagccttcggggccaccctgccgggatgacatacgctgccaacatcctacctcaccatccggcccgaggcacgttcgaggactttacctgctgagccccgcaggccgctgaaccaaaggcctagatggggaggactaggagagcgagggggcccccagctgcctcctcacatctgccctggggactccccacactccggggcagatctttcctcttgtctgtgagttggactctctcccctggtgtctgtactgtgtacacacatccctctgagaagcacaaggagacgacacgcgcattgtaacctttgcactgtctcagtggcg

SEQ ID NO: 103804 - DNA, 3819 bp, Homo sapiens
  Payload ID: 401
  Gene Symbol: ASIC1
  Gene Name: acid sensing (proton gated) ion channel 1
  ENST ID: ENST00000550558
  CDS Start-End: 189-980
agccgagcggggccgggcggggcgctccctgcagggctctgcgcggcgtgccgcggcggccgcgggctccggccccgggccatgagcccctccgcgactcggcgctgagcccgccaccggtccagcgccccaggacccgccgccggctgccggcttgccgaagccccctcaggatcccctcaacaaggatggaactgaaggccgaggaggaggaggtgggtggcgtccagccggtgagcatccaggccttcgccagcagctccacactgcacggcctggcccacatcttctcctacgagcggctgtctctgaagcgggcactgtgggccctgtgcttcctgggctccctggctgtgctgctgtgtgtgtgcacggagcgtgtgcagtactacttccactaccaccatgtcaccaagctcgacgaggtggctgcctctcagcttaccttccctgctgtcacgctgtgcaacctcaacgagttccgctttagccaagtctccaagaatgacctgtatcatgctggggagctgctggccctgctcaacaacaggtatgagataccagacacacagatggcagatgaaaagcagctggagatactgcaggacaaagccaacttccgcagcttcaaacccaaacccttcaacatgcgtgagttctacgaccgagctgggcacgacattcgagacatgctgctctcctgccacttccggggggaggtctgcagcgctgaagacttcaaggtgaagcccatgcaggtggcaaaggagctcaggcgatgcaccctaccaggaacagttttccagggcacacagagggcaagaaagggtcttcacacgctatggaaagtgctacacgttcaactcgggccgagatgggcggccgcggctgaagaccatgaagggtgggacgggcaatgggctggaaatcatgctggacatccagcaggacgagtacctgcctgtgtggggggagactgacgagacgtccttcgaagcaggcatcaaagtgcagatccatagtcaggatgaacctcctttcatcgaccagctgggctttggcgtggccccaggcttccagacctttgtggcctgccaggagcagcggctcatctacctgcccccaccctggggcacctgcaaagctgttaccatggactcggatttggatttcttcgactcctacagcatcactgcctgccgcatcgactgtgagacgcgctacctggtggagaactgcaactgccgcatggtgcacatgccaggggatgccccatactgtactccagagcagtacaaggagtgtgcagatcctgctctggacttcctggtggagaaggaccaggagtactgcgtgtgtgaaatgccttgcaacctgacccgctatggcaaagagctgtccatggtcaagatccccagcaaagcctcagccaagtacctggccaagaagttcaacaaatctgagcaatacataggggagaacatcctggtgctggacattttctttgaagtcctcaactatgagaccattgaacagaagaaggcctatgagattgcagggctcctgggtgacatcgggggccagatggggctgttcatcggggccagcatcctcacggtgctggagctctttgactacgcctacgaggtcattaagcacaagctgtgccgacgaggaaaatgccagaaggaggccaaaaggagcagtgcggacaagggcgtggccctcagcctggacgacgtcaaaagacacaacccgtgcgagagccttcggggccaccctgccgggatgacatacgctgccaacatcctacctcaccatccggcccgaggcacgttcgaggactttacctgctgagccccgcaggccgctgaaccaaaggcctagatggggaggactaggagagcgagggggcccccagctgcctcctcacatctgccctggggactccccacactccggggcagatctttcctcttgtctgtggtaaggaaggagtcttgaccatagagtcctctctctgcctctatcccattctttttacatttaacaaaactaatctaaaaaagaactaaaaagggagaacggggcaagggacctcaggctgcccctctctcctccatgctgcctcccctagctcccagcctgaattctgtctatctagctgtctgccatctgagtgtccatctacattctgctgccaccagtcaccaaaggcccttcccagtgaggggtggaagggatctctggggtctggaatttggccccaaaccagagaatgtaccttaagggggagggctagtgtgggggagggaggcttccccagccttaagagaccctctcagcccagtgactgtccccaaacccaagtctcctggcaggaactaaaacctcagccccactctctcacaccatgtggaatctcgtgggggtcggggatccccttaagaagtggtaatggggacaagatgcggccctggtgctgtaggctacatcctgatacctataagttcacccccaccccacagctgctggagagaaatcccaagaggcagcccttcctcaccatcccattaaagaccgggctggttagcgtccagctcagggagaagggcgctagtgcctaacctcactggtccctctcccggaggcccttgtagagggccacgtccataaattttcttatggaactctcccacatcctcttccccaacttcatttgcttctctcaacaacctcatctgcattttctatttctatatgatacagactctatattgctatatctctgtatatactttcccagccctgtctgtctccaccccatcccctcttgtctctgagaaccattctcccaccccaagttccaccttctatgtttctactccctccctggtctctgaatgccttcgcctgtataaagagttggactctctcccctggtgtctgtactgtgtacacacatccctctgagaagcacaaggagacgacacgcgcattgtaacctttgcactgtctcagtggcgacaaaggaagctgtgaatcacaagctctgcctctttctggcctcaccctctcccccaacccgggcaccctcggccctccctgcagccttaacattctcttcccctgctcctcctatcccattgccctctgcccagctgacagtggcatccccagggaaggggttgctgtagagatagcccccacccaggggatggaggtctaccctggacactaagccaagtgtgtcagagacagaagggagctggggattggcgactcctgaagttggggcagtgggatgctgacaggcagaagctgaggtcctcagtcagtggcctttcctccttctgggtgcccagccccctttcctcacctgatacccaagcccaccacttttattttctggtgaggtgggtttgggaggaaagagaggcctagaggaggagttgaaagctctgctgttgtctcaccctatcttaatgagagacaagtgaggtggagggcctgccccccctccctccaccagacactccttccaggcctgagccccaacccctcttcaggccttccttccctagctgtgtcttggtcttcaatcccagaacaggacctgtgagcagctgcattggcctggagctggagagtaaggctgtaggatctttggaatctcttggttcctaagagtttcctcagagatcatacctccccagagggaagcaggaatgaggccaaaaagtgtgcattggataggggaacagcaggcagggctctgggtgacgcatgcctctggtctaataaactgggtttcaacca

SEQ ID NO: 103805 - DNA, 3327 bp, Homo sapiens
  Payload ID: 401
  Gene Symbol: ASIC1
  Gene Name: acid sensing (proton gated) ion channel 1
  Uniprot ID: P78348
  ENST ID: ENST00000552438
  CDS Start-End: 11-1699
cctggagaaaatgcccatccagatcttctgctccatgtcattctcctctggagaggaagccccagggcccttgggagatatttggggtccccaccaccatcagcagcagcaggacatctcagaatcggaagaggaggaagaagagaaggaaaaggaggcagtgaggaaggaggccagtgaggggcattcacccatggacttggtggcctttgccaacagctgcaccctccatggcaccaaccacatttttgtggaggggggtccagggccaaggcaggtgctgtgggcggtggcctttgtcctggcactgggtgccttcctgtgccaggtaggggaccgcgttgcttattacctcagctacccacacgtgacccttctaaacgaagtggccaccacggagctggccttcccggcagtcaccctctgcaacactaatgctgtgcggctgtcccagctcagctaccctgacttgctttatttggcccccatgctgggactggatgaaagtgatgaccccggggtgcccctcgctccaccgggccctgaggccttctctggggagccctttaacctgcaccgcttctacaatcgctcctgccaccggctggaggacatgctgctctattgctcctaccaagggggaccctgcggccctcacaacttctcagtggtcttcacacgctatggaaagtgctacacgttcaactcgggccgagatgggcggccgcggctgaagaccatgaagggtgggacgggcaatgggctggaaatcatgctggacatccagcaggacgagtacctgcctgtgtggggggagactgacgagacgtccttcgaagcaggcatcaaagtgcagatccatagtcaggatgaacctcctttcatcgaccagctgggctttggcgtggccccaggcttccagacctttgtggcctgccaggagcagcggctcatctacctgcccccaccctggggcacctgcaaagctgttaccatggactcggatttggatttcttcgactcctacagcatcactgcctgccgcatcgactgtgagacgcgctacctggtggagaactgcaactgccgcatggtgcacatgccaggggatgccccatactgtactccagagcagtacaaggagtgtgcagatcctgctctggacttcctggtggagaaggaccaggagtactgcgtgtgtgaaatgccttgcaacctgacccgctatggcaaagagctgtccatggtcaagatccccagcaaagcctcagccaagtacctggccaagaagttcaacaaatctgagcaatacataggggagaacatcctggtgctggacattttctttgaagtcctcaactatgagaccattgaacagaagaaggcctatgagattgcagggctcctgggtgacatcgggggccagatggggctgttcatcggggccagcatcctcacggtgctggagctctttgactacgcctacgaggtcattaagcacaagctgtgccgacgaggaaaatgccagaaggaggccaaaaggagcagtgcggacaagggcgtggccctcagcctggacgacgtcaaaagacacaacccgtgcgagagccttcggggccaccctgccgggatgacatacgctgccaacatcctacctcaccatccggcccgaggcacgttcgaggactttacctgctgagccccgcaggccgctgaaccaaaggcctagatggggaggactaggagagcgagggggcccccagctgcctcctcacatctgccctggggactccccacactccggggcagatctttcctcttgtctgtggtaaggaaggagtcttgaccatagagtcctctctctgcctctatcccattctttttacatttaacaaaactaatctaaaaaagaactaaaaagggagaacggggcaagggacctcaggctgcccctctctcctccatgctgcctcccctagctcccagcctgaattctgtctatctagctgtctgccatctgagtgtccatctacattctgctgccaccagtcaccaaaggcccttcccagtgaggggtggaagggatctctggggtctggaatttggccccaaaccagagaatgtaccttaagggggagggctagtgtgggggagggaggcttccccagccttaagagaccctctcagcccagtgactgtccccaaacccaagtctcctggcaggaactaaaacctcagccccactctctcacaccatgtggaatctcgtgggggtcggggatccccttaagaagtggtaatggggacaagatgcggccctggtgctgtaggctacatcctgatacctataagttcacccccaccccacagctgctggagagaaatcccaagaggcagcccttcctcaccatcccattaaagaccgggctggttagcgtccagctcagggagaagggcgctagtgcctaacctcactggtccctctcccggaggcccttgtagagggccacgtccataaattttcttatggaactctcccacatcctcttccccaacttcatttgcttctctcaacaacctcatctgcattttctatttctatatgatacagactctatattgctatatctctgtatatactttcccagccctgtctgtctccaccccatcccctcttgtctctgagaaccattctcccaccccaagttccaccttctatgtttctactccctccctggtctctgaatgccttcgcctgtataaagagttggactctctcccctggtgtctgtactgtgtacacacatccctctgagaagcacaaggagacgacacgcgcattgtaacctttgcactgtctcagtggcgacaaaggaagctgtgaatcacaagctctgcctctttctggcctcaccctctcccccaacccgggcaccctcggccctccctgcagccttaacattctcttcccctgctcctcctatcccattgccctctgcccagctgacagtggcatccccagggaaggggttgctgtagagatagcccccacccaggggatggaggtctaccctggacactaagccaagtgtgtcagagacagaagggagctggggattggcgactcctgaagttggggcagtgggatgctgacaggcagaagctgaggtcctcagtcagtggcctttcctccttctgggtgcccagccccctttcctcacctgatacccaagcccaccacttttattttctggtgaggtgggtttgggaggaaagagaggcctagaggaggagttgaaagctctgctgttgtctcaccctatctta

SEQ ID NO: 103806 - DNA, 3443 bp, Homo sapiens
  Payload ID: 402
  Gene Symbol: ASIC2
  Gene Name: acid sensing (proton gated) ion channel 2
  Uniprot ID: Q16515
  ENST ID: ENST00000225823
  CDS Start-End: 874-2565
cacctgggagagccgaggcgagaagcgacacttccctgcggctagcatccttgaaggaccccggcggcgaacagcctcccgcaggacgccctgagaagctctcagccccaggcgagagcgggcgcctggcaggacttaggcgcaggacttggggaagcctaagcaggtctctgccgagcgcagcccagggagcagtaacaaggaagggtcctggaggggaagggaaagaaggcggcagccggcaaggcgaccactcacccccgtacacacccaccccgcccgcccagccaggagccgcggtgcgcctctgggggcgctcgttccttggcgccttctctcccgtgtcccagcaccgctgggctacgggccgggctggtggggtccctggggatgtccagatcaggcatggtggccgagtggcccttctcccaggaccagcgtaaaagctggggttaggcggggcaggggggactcggctcagggtcccccgaggtccaggacgagggaaggcgggcgcagcacccagggactggagaggcggctcccagtgggacccctccagaagtagtgccgggcgccgggcatcctccaggaagaccaggggccgggaaagcctgggaggcgctcgggagaggccactgccaggggctgcgggctgaggcggcgctcagccccgggcgggcgcccgcggaggcggcagcggcggcgccgggcgggcatgccgcgccaccggagctcctttcgggcgcacgcttccctggcgcgggctgcgcgcggctgccgctgctgctgcttccactgctgctgcggactcccatggcggctccgcccggccggggccgccgccgctgccgccagccgcgggctgaatgaatgagccggattggcggagccgggctgcccgcagccgcgctcaccggcccgggacgcttccgcatggcccgcgaggagccggcgcccgcggcgttggcggctgccgggcagcccgggggcggcagaggcggcgagcgggcgctgcaggggccaggggtcgcccgcagggggcggccatcgctgagccgcgctaaactgcacgggctgcggcacatgtgtgccgggcgcacggcggctgggggctccttccagcggcgggcgctgtgggtgctggccttctgtacatccttcggcttgctgctgtcctggtcctcgaaccgcttgctctactggctcagcttcccgtcacacacgcgggtgcaccgcgagtggagccgccagttacccttccccgccgtcactgtgtgcaacaacaacccgctgcgcttcccgcgcctctccaagggggacctctactatgccggccactggctcgggctgctgctgcccaaccgcaccgcgcgcccgcttgtcagcgagctgctgcggggcgacgagccgcgccgccagtggttccgcaagctggcggacttccgcctcttcctgcctccgcgccacttcgagggaatcagcgccgccttcatggaccgcctgggccaccagctggaggacatgctgctctcctgcaagtaccgcggcgagctctgcgggccgcacaacttctcctccgtgtttacaaaatatgggaagtgttacatgtttaactcaggcgaggatggcaaacctctgctcaccacggtcaagggggggacaggcaacgggctggagatcatgctggacattcagcaggatgagtacctgcccatctggggagagacagaggaaacgacatttgaagcaggagtgaaagttcagatccacagtcagtctgagccacctttcatccaagagctgggctttggggtggctccagggttccagacctttgtggccacacaggagcagaggctcacatacctgcccccaccgtggggtgagtgccgatcctcagagatgggcctcgacttttttcctgtttacagcatcaccgcctgtaggattgactgtgagacccgctacattgtggaaaactgcaactgccgcatggttcacatgccaggggatgcccctttttgtacccctgagcagcacaaggagtgtgcagagcctgccctaggtctgttggcggaaaaggacagcaattactgtctctgcaggacaccctgcaacctaacccgctacaacaaagagctctccatggtgaagatccccagcaagacatcagccaagtaccttgagaagaaatttaacaaatcagaaaaatatatctcagagaacatccttgttctggatatattttttgaagctctcaattatgagacaattgaacagaagaaggcgtatgaagttgctgccttacttggtgatattggtggtcagatgggattgttcattggtgctagtatccttacaatactagagctctttgattatatttatgagctgatcaaagagaagctattagacctgcttggcaaagaggaggacgaagggagccacgatgagaatgtgagtacttgtgacacaatgccaaaccactctgaaaccatcagtcacactgtgaacgtgcccctgcagacgaccctggggaccttggaggagattgcctgctgacacccctcgagtcacccagcactccctccaaacagaccttgaggcccaagacccaggacaaggaacagcaagctcaggtgggatggccccagtgctggaaagaagcaagagccccctatgcacacattgcagactagctgcctagacctcgctccggccacgtccaacacgacgcatccttgggccccgccgtgcgtccctcttaggagagatgagtcacactctggaactgtccaagaacgaacctgccatcacatctcactgccagatgtataaagcacctgcatgctcagacttcttgtggcgccacctccacgtctgtcttgtacatgacactcctccacgcggtttccagtgtccacactgctgcccgtgcagtgggaccagattccaggtccaaagtcaccatgaggccaccctggaatcagaactgcacaatcaagagggaacccatgggactctctgctacattcagttcttgtgtcgtttgtgaaagttcttaacctgcccaaaaacccccttttccccaagctgcccatggggcttcggcgccaaaggtgacccgcgccaacctccctcccccccagtgcctatgacggcggcacagcagccagcgggtgggggacgcctgtgttcacccatggtgcccatgtcgttcttctctccctgtgacacagcttgtacagtctgattctttttatctggggtaggggggcttttatgtttgtccgatggagatttgttttgttttgcttcattttatgcttttttattttagttttgatgttctgaggtttgctttggtttttccattttctttggcatttatttattcgtgcttcaaatcacagtcatattaaaagctggtcttgtggaaa

SEQ ID NO: 103807 - DNA, 3179 bp, Homo sapiens
  Payload ID: 402
  Gene Symbol: ASIC2
  Gene Name: acid sensing (proton gated) ion channel 2
  Uniprot ID: Q16515
  ENST ID: ENST00000359872
  CDS Start-End: 763-2301
ttttttcccaggaggcgaggagagaatggatcccggtctgagctccccgcttccgtccccagtctccagataccggtcctcgcctctccgcgccgcgcgctgcctcctctccccggtgctagcagcggccgctggcatttggaattctgcccacaaaagggggcctggaggaggaggagaggagggacggaggccggcggcgagaaacggcattcggagtccaaaacatcatgggaaaaggaaccgagcggcggcggctctgaaggctgtgccgctgcgcccgaccgcagtgcatcagcgtggccgccctgacatcccccaggatggttaacatggggcattatgcgctggttaacaggctccgagctgctcagcgacttgttttaagcattttctctctcgctctcgcttttaatcttgtctctagtggcgtgtgtaggggggaggactttatttccattggctaagctctcccttcccacccacatctcttccacatcaccttggtgtctccctaaataaaaccagccctccttatcgcctggaaaaaatcaagagctagagtttgaatgggttttatataaacactcacccctgtcagcgtgcggctgggctctcaggataaactcacagcatctggcgcgatgcttgccttgcgttctctcccctgaacgtcaaggtttaagcagagcccgaggactgggagctcttctctgaaattcgatcaacctgaagccagttgcggaactgcacggggtcccgatggacctcaaggaaagccccagtgagggcagcctgcaaccttctagcatccagatctttgccaacacctccaccctccatggcatccgccacatcttcgtgtatgggccgctgaccatccggcgtgtgctgtgggcagtggccttcgtgggctctctgggcctgctgctggtggagagctctgagagggtgtcctactacttctcctaccagcatgtcactaaggtggacgaagtggtggctcaaagcctggtcttcccagctgtgaccctctgtaacctgaatggcttccggttctccaggctcaccaccaatgacctgtaccatgctggggagctgctggccctgctggatgtcaacctgcagatcccggacccccatctggctgacccctccgtgctggaggccctgcggcagaaggccaacttcaagcactacaaacccaagcagttcagcatgctggagttcctgcaccgtgtgggccatgacctgaaggatatgatgctctactgcaagttcaaagggcaggagtgcggccaccaagacttcaccacagtgtttacaaaatatgggaagtgttacatgtttaactcaggcgaggatggcaaacctctgctcaccacggtcaagggggggacaggcaacgggctggagatcatgctggacattcagcaggatgagtacctgcccatctggggagagacagaggaaacgacatttgaagcaggagtgaaagttcagatccacagtcagtctgagccacctttcatccaagagctgggctttggggtggctccagggttccagacctttgtggccacacaggagcagaggctcacatacctgcccccaccgtggggtgagtgccgatcctcagagatgggcctcgacttttttcctgtttacagcatcaccgcctgtaggattgactgtgagacccgctacattgtggaaaactgcaactgccgcatggttcacatgccaggggatgcccctttttgtacccctgagcagcacaaggagtgtgcagagcctgccctaggtctgttggcggaaaaggacagcaattactgtctctgcaggacaccctgcaacctaacccgctacaacaaagagctctccatggtgaagatccccagcaagacatcagccaagtaccttgagaagaaatttaacaaatcagaaaaatatatctcagagaacatccttgttctggatatattttttgaagctctcaattatgagacaattgaacagaagaaggcgtatgaagttgctgccttacttggtgatattggtggtcagatgggattgttcattggtgctagtatccttacaatactagagctctttgattatatttatgagctgatcaaagagaagctattagacctgcttggcaaagaggaggacgaagggagccacgatgagaatgtgagtacttgtgacacaatgccaaaccactctgaaaccatcagtcacactgtgaacgtgcccctgcagacgaccctggggaccttggaggagattgcctgctgacacccctcgagtcacccagcactccctccaaacagaccttgaggcccaagacccaggacaaggaacagcaagctcaggtgggatggccccagtgctggaaagaagcaagagccccctatgcacacattgcagactagctgcctagacctcgctccggccacgtccaacacgacgcatccttgggccccgccgtgcgtccctcttaggagagatgagtcacactctggaactgtccaagaacgaacctgccatcacatctcactgccagatgtataaagcacctgcatgctcagacttcttgtggcgccacctccacgtctgtcttgtacatgacactcctccacgcggtttccagtgtccacactgctgcccgtgcagtgggaccagattccaggtccaaagtcaccatgaggccaccctggaatcagaactgcacaatcaagagggaacccatgggactctctgctacattcagttcttgtgtcgtttgtgaaagttcttaacctgcccaaaaacccccttttccccaagctgcccatggggcttcggcgccaaaggtgacccgcgccaacctccctcccccccagtgcctatgacggcggcacagcagccagcgggtgggggacgcctgtgttcacccatggtgcccatgtcgttcttctctccctgtgacacagcttgtacagtctgattctttttatctggggtaggggggcttttatgtttgtccgatggagatttgttttgttttgcttcattttatgcttttttattttagttttgatgttctgaggtttgctttggtttttccattttctttggcatttatttattcgtgcttcaaatcacagtcatattaaaagctggtcttgtggaaa

SEQ ID NO: 103808 - DNA, 1718 bp, Homo sapiens
  Payload ID: 403
  Gene Symbol: ASIC3
  Gene Name: acid sensing (proton gated) ion channel 3
  Uniprot ID: Q9UHC3
  ENST ID: ENST00000297512
  CDS Start-End: 1-1650
atgaagcccacctcaggcccagaggaggcccggcggccagcctcggacatccgcgtgttcgccagcaactgctcgatgcacgggctgggccacgtcttcgggccaggcagcctgagcctgcgccgggggatgtgggcagcggccgtggtcctgtcagtggccaccttcctctaccaggtggctgagagggtgcgctactacagggagttccaccaccagactgccctggatgagcgagaaagccaccggctcatcttcccggctgtcaccctgtgcaacatcaacccactgcgccgctcgcgcctaacgcccaacgacctgcactgggctgggtctgcgctgctgggcctggatcccgcagagcacgccgccttcctgcgcgccctgggccggccccctgcaccgcccggcttcatgcccagtcccacctttgacatggcgcaactctatgcccgtgctgggcactccctggatgacatgctgctggactgtcgcttccgtggccaaccttgtgggcctgagaacttcaccacgatcttcacccggatgggaaagtgctacacatttaactctggcgctgatggggcagagctgctcaccactactaggggtggcatgggcaatgggctggacatcatgctggacgtgcagcaggaggaatatctacctgtgtggagggacaatgaggagaccccgtttgaggtggggatccgagtgcagatccacagccaggaggagccgcccatcatcgatcagctgggcttgggggtgtccccgggctaccagacctttgtttcttgccagcagcagcagctgagcttcctgccaccgccctggggcgattgcagttcagcatctctgaaccccaactatgagccagagccctctgatcccctaggctcccccagccccagccccagccctccctatacccttatggggtgtcgcctggcctgcgaaacccgctacgtggctcggaagtgcggctgccgaatggtgtacatgccaggcgacgtgccagtgtgcagcccccagcagtacaagaactgtgcccacccggccatagatgccatgcttcgcaaggactcgtgcgcctgccccaacccgtgcgccagcacgcgctacgccaaggagctctccatggtgcggatcccgagccgcgccgccgcgcgcttcctggcccggaagctcaaccgcagcgaggcctacatcgcggagaacgtgctggccctggacatcttctttgaggccctcaactatgagaccgtggagcagaagaaggcctatgagatgtcagagctgcttggtgacattgggggccagatggggctgttcatcggggccagcctgctcaccatcctcgagatcctagactacctctgtgaggtgttccgagacaaggtcctgggatatttctggaaccgacagcactcccaaaggcactccagcaccaatctgcttcaggaagggctgggcagccatcgaacccaagttccccacctcagcctgggccccagcactctgctctgttccgaagacctcccacccctccctgtgccgtcaccaagactctctccgcctcccaccgcacctgctaccttgtcacacagctctagacctgctgtctgtgtcctcggagccccgccctgacatcctggacatgcctagcctgcacgtagcttttccgtcttcaccccaaataaagtcctaatgcatca

SEQ ID NO: 103809 - DNA, 1895 bp, Homo sapiens
  Payload ID: 403
  Gene Symbol: ASIC3
  Gene Name: acid sensing (proton gated) ion channel 3
  Uniprot ID: Q9UHC3
  ENST ID: ENST00000349064
  CDS Start-End: 199-1794
acctgaccggccagatcacctcctccaatcctgccaggctagtgcctccctgccttccaaccttggctgtctcccaccctctcttctcctctccttgcctggcctcctgaatcctatcttagcctccttagccccctgactgactctctctcgcttcttccaagcctctgtagctggttccgctcctgggttctggccatgaagcccacctcaggcccagaggaggcccggcggccagcctcggacatccgcgtgttcgccagcaactgctcgatgcacgggctgggccacgtcttcgggccaggcagcctgagcctgcgccgggggatgtgggcagcggccgtggtcctgtcagtggccaccttcctctaccaggtggctgagagggtgcgctactacagggagttccaccaccagactgccctggatgagcgagaaagccaccggctcatcttcccggctgtcaccctgtgcaacatcaacccactgcgccgctcgcgcctaacgcccaacgacctgcactgggctgggtctgcgctgctgggcctggatcccgcagagcacgccgccttcctgcgcgccctgggccggccccctgcaccgcccggcttcatgcccagtcccacctttgacatggcgcaactctatgcccgtgctgggcactccctggatgacatgctgctggactgtcgcttccgtggccaaccttgtgggcctgagaacttcaccacgatcttcacccggatgggaaagtgctacacatttaactctggcgctgatggggcagagctgctcaccactactaggggtggcatgggcaatgggctggacatcatgctggacgtgcagcaggaggaatatctacctgtgtggagggacaatgaggagaccccgtttgaggtggggatccgagtgcagatccacagccaggaggagccgcccatcatcgatcagctgggcttgggggtgtccccgggctaccagacctttgtttcttgccagcagcagcagctgagcttcctgccaccgccctggggcgattgcagttcagcatctctgaaccccaactatgagccagagccctctgatcccctaggctcccccagccccagccccagccctccctatacccttatggggtgtcgcctggcctgcgaaacccgctacgtggctcggaagtgcggctgccgaatggtgtacatgccaggcgacgtgccagtgtgcagcccccagcagtacaagaactgtgcccacccggccatagatgccatgcttcgcaaggactcgtgcgcctgccccaacccgtgcgccagcacgcgctacgccaaggagctctccatggtgcggatcccgagccgcgccgccgcgcgcttcctggcccggaagctcaaccgcagcgaggcctacatcgcggagaacgtgctggccctggacatcttctttgaggccctcaactatgagaccgtggagcagaagaaggcctatgagatgtcagagctgcttggtgacattgggggccagatggggctgttcatcggggccagcctgctcaccatcctcgagatcctagactacctctgtgaggtgttccgagacaaggtcctgggatatttctggaaccgacagcactcccaaaggcactccagcaccaatctgcttcaggaagggctgggcagccatcgaacccaagttccccacctcagcctgggccccagacctcccacccctccctgtgccgtcaccaagactctctccgcctcccaccgcacctgctaccttgtcacacagctctagacctgctgtctgtgtcctcggagccccgccctgacatcctggacatgcctagcctgcacgtagcttttccgtcttcaccccaaataaagtcctaatgcatc

SEQ ID NO: 103810 - DNA, 2232 bp, Homo sapiens
  Payload ID: 403
  Gene Symbol: ASIC3
  Gene Name: acid sensing (proton gated) ion channel 3
  Uniprot ID: Q9UHC3
  ENST ID: ENST00000357922
  CDS Start-End: 595-2226
tacaggggttgcaactgggagcctagggggccccaaggcatctccaggcccaatctacctctgggcttttctcaagctctccctaggattactgcggtttcctcctggcgcctctcgtcttggacagccatgcccccctccatgctgcactaatggctcagcctggggccctagggacctctcctaccccccagactgctctgtcggccccctttcccccctactgctgaaacccaatcctctgcagcagcgccggctcagcaccgccggctcagcaccgctccgcagcccctgcctgccacggtcagctacgtcccacctggtctgctgcggagtccccagcccagtgcctagcccagtggagccaccgcctgttcctcgggaaggaacagtgggacctgaccggccagatcacctcctccaatcctgccaggctagtgcctccctgccttccaaccttggctgtctcccaccctctcttctcctctccttgcctggcctcctgaatcctatcttagcctccttagccccctgactgactctctctcgcttcttccaagcctctgtagctggttccgctcctgggttctggccatgaagcccacctcaggcccagaggaggcccggcggccagcctcggacatccgcgtgttcgccagcaactgctcgatgcacgggctgggccacgtcttcgggccaggcagcctgagcctgcgccgggggatgtgggcagcggccgtggtcctgtcagtggccaccttcctctaccaggtggctgagagggtgcgctactacagggagttccaccaccagactgccctggatgagcgagaaagccaccggctcatcttcccggctgtcaccctgtgcaacatcaacccactgcgccgctcgcgcctaacgcccaacgacctgcactgggctgggtctgcgctgctgggcctggatcccgcagagcacgccgccttcctgcgcgccctgggccggccccctgcaccgcccggcttcatgcccagtcccacctttgacatggcgcaactctatgcccgtgctgggcactccctggatgacatgctgctggactgtcgcttccgtggccaaccttgtgggcctgagaacttcaccacgatcttcacccggatgggaaagtgctacacatttaactctggcgctgatggggcagagctgctcaccactactaggggtggcatgggcaatgggctggacatcatgctggacgtgcagcaggaggaatatctacctgtgtggagggacaatgaggagaccccgtttgaggtggggatccgagtgcagatccacagccaggaggagccgcccatcatcgatcagctgggcttgggggtgtccccgggctaccagacctttgtttcttgccagcagcagcagctgagcttcctgccaccgccctggggcgattgcagttcagcatctctgaaccccaactatgagccagagccctctgatcccctaggctcccccagccccagccccagccctccctatacccttatggggtgtcgcctggcctgcgaaacccgctacgtggctcggaagtgcggctgccgaatggtgtacatgccaggcgacgtgccagtgtgcagcccccagcagtacaagaactgtgcccacccggccatagatgccatgcttcgcaaggactcgtgcgcctgccccaacccgtgcgccagcacgcgctacgccaaggagctctccatggtgcggatcccgagccgcgccgccgcgcgcttcctggcccggaagctcaaccgcagcgaggcctacatcgcggagaacgtgctggccctggacatcttctttgaggccctcaactatgagaccgtggagcagaagaaggcctatgagatgtcagagctgcttggtgacattgggggccagatggggctgttcatcggggccagcctgctcaccatcctcgagatcctagactacctctgtgaggtgttccgagacaaggtcctgggatatttctggaaccgacagcactcccaaaggcactccagcaccaatctgacctcccacccctccctgtgccgtcaccaagactctctccgcctcccaccgcacctgctaccttgtcacacagctctagacctgctgtctgtgtcctcggagccccgccctgacatcctggacatgcctagcctgcacgtagcttttccgtcttcaccccaaataaagtcctaatgcatc

SEQ ID NO: 103811 - DNA, 2096 bp, Homo sapiens
  Payload ID: 403
  Gene Symbol: ASIC3
  Gene Name: acid sensing (proton gated) ion channel 3
  Uniprot ID: Q9UHC3
  ENST ID: ENST00000377904
  CDS Start-End: 369-1592
ctgaaacccaatcctctgcagcagcgccggctcagcaccgccggctcagcaccgctccgcagcccctgcctgccacggtcagctacgtcccacctggtctgctgcggagtccccagcccagtgcctagcccagtggagccaccgcctgttcctcgggaaggaacagtgggacctgaccggccagatcacctcctccaatcctgccaggctagtgcctccctgccttccaaccttggctgtctcccaccctctcttctcctctccttgcctggcctcctgaatcctatcttagcctccttagccccctgactgactctctctcgcttcttccaagcctctgtagctggttccgctcctgggttctggccatgaagcccacctcaggcccagaggaggcccggcggccagcctcggacatccgcgtgttcgccagcaactgctcgatgcacgggctgggccacgtcttcgggccaggcagcctgagcctgcgccgggggatgtgggcagcggccgtggtcctgtcagtggccaccttcctctaccaggtggctgagagggtgcgctactacagggagttccaccaccagactgccctggatgagcgagaaagccaccggctcatcttcccggctgtcaccctgtgcaacatcaacccactgcgccgctcgcgcctaacgcccaacgacctgcactgggctgggtctgcgctgctgggcctggatcccgcagagcacgccgccttcctgcgcgccctgggccggccccctgcaccgcccggcttcatgcccagtcccacctttgacatggcgcaactctatgcccgtgctgggcactccctggatgacatgctgctggactgtcgcttccgtggccaaccttgtgggcctgagaacttcaccacgatcttcacccggatgggaaagtgctacacatttaactctggcgctgatggggcagagctgctcaccactactaggggtggcatgggcaatgggctggacatcatgctggacgtgcagcaggaggaatatctacctgtgtggagggacaatgaggagaccccgtttgaggtggggatccgagtgcagatccacagccaggaggagccgcccatcatcgatcagctgggcttgggggtgtccccgggctaccagacctttgtttcttgccagcagcagcagctgagcttcctgccaccgccctggggcgattgcagttcagcatctctgaaccccaactatgagccagagccctctgatcccctaggctcccccagccccagccccagccctccctatacccttatggggtgtcgcctggcctgcgaaacccgctacgtggctcggaagtgcggctgccgaatggtgtacatgccaggcgacgtgccagtgtgcagcccccagcagtacaagaactgtgcccacccggccatagggagaacgtgctggccctggacatcttctttgaggccctcaactatgagaccgtggagcagaagaaggcctatgagatgtcagagctgcttggtgacattgggggccagatggggctgttcatcggggccagcctgctcaccatcctcgagatcctagactacctctgtgaggtgttccgagacaaggtcctgggatatttctggaaccgacagcactcccaaaggcactccagcaccaatctggtaacagcccctcttctggagcccttgcctgctccaagggtgctagggcccacccctgaagcctagaccaccatcccgccccagctgaggagaaacaggcaggagggtgtgcagtgacctcgactggtccctgggaggaggaccactccccacctctgaccctctcgtcctcacacagcttcaggaagggctgggcagccatcgaacccaagttccccacctcagcctgggccccagacctcccacccctccctgtgccgtcaccaagactctctccgcctcccaccgcacctgctaccttgtcacacagctctagacctgctgtctgtgtcctcggagccccgccctgacatcctggacatgcctagcctgcacgtagcttttccgtcttcaccccaaataaagtcctaatgcatca

SEQ ID NO: 103812 - DNA, 520 bp, Homo sapiens
  Payload ID: 403
  Gene Symbol: ASIC3
  Gene Name: acid sensing (proton gated) ion channel 3
  ENST ID: ENST00000490540
  CDS Start-End: 1-450
tgcgccagcacgcgctacgccaaggagctctccatggtgcggatcccgagccgcgccgccgcgcgcttcctggcccggaagctcaaccgcagcgaggcctacatcgcggagaacgtgctggccctggacatcttctttgaggccctcaactatgagaccgtggagcagaagaaggcctatgagatgtcagagctgcttggtgacattgggggccagatggggctgttcatcggggccagcctgctcaccatcctcgagatcctagactacctctgtgaggtgttccgagacaaggtcctgggatatttctggaaccgacagcactcccaaaggcactccagcaccaatctgcttcaggaagggctgggcagccatcgaacccaagttccccacctcagcctgggccccagctctagacctgctgtctgtgtcctcggagccccgccctgacatcctggacatgcctagcctgcacgtagcttttccgtcttcaccccaaataaagtcctaatgcatcagc

SEQ ID NO: 103813 - DNA, 1668 bp, Homo sapiens
  Payload ID: 403
  Gene Symbol: ASIC3
  Gene Name: acid sensing (proton gated) ion channel 3
  Uniprot ID: Q9UHC3
  ENST ID: ENST00000468325
  CDS Start-End: 120-1343
tctcttctcctctccttgcctggcctcctgaatcctatcttagcctccttagccccctgactgactctctctcgcttcttccaagcctctgtagctggttccgctcctgggttctggccatgaagcccacctcaggcccagaggaggcccggcggccagcctcggacatccgcgtgttcgccagcaactgctcgatgcacgggctgggccacgtcttcgggccaggcagcctgagcctgcgccgggggatgtgggcagcggccgtggtcctgtcagtggccaccttcctctaccaggtggctgagagggtgcgctactacagggagttccaccaccagactgccctggatgagcgagaaagccaccggctcatcttcccggctgtcaccctgtgcaacatcaacccactgcgccgctcgcgcctaacgcccaacgacctgcactgggctgggtctgcgctgctgggcctggatcccgcagagcacgccgccttcctgcgcgccctgggccggccccctgcaccgcccggcttcatgcccagtcccacctttgacatggcgcaactctatgcccgtgctgggcactccctggatgacatgctgctggactgtcgcttccgtggccaaccttgtgggcctgagaacttcaccacgatcttcacccggatgggaaagtgctacacatttaactctggcgctgatggggcagagctgctcaccactactaggggtggcatgggcaatgggctggacatcatgctggacgtgcagcaggaggaatatctacctgtgtggagggacaatgaggagaccccgtttgaggtggggatccgagtgcagatccacagccaggaggagccgcccatcatcgatcagctgggcttgggggtgtccccgggctaccagacctttgtttcttgccagcagcagcagctgagcttcctgccaccgccctggggcgattgcagttcagcatctctgaaccccaactatgagccagagccctctgatcccctaggctcccccagccccagccccagccctccctatacccttatggggtgtcgcctggcctgcgaaacccgctacgtggctcggaagtgcggctgccgaatggtgtacatgccaggcgacgtgccagtgtgcagcccccagcagtacaagaactgtgcccacccggccatagggagaacgtgctggccctggacatcttctttgaggccctcaactatgagaccgtggagcagaagaaggcctatgagatgtcagagctgcttggtgacattgggggccagatggggctgttcatcggggccagcctgctcaccatcctcgagatcctagactacctctgtgaggtgttccgagacaaggtcctgggatatttctggaaccgacagcactcccaaaggcactccagcaccaatctgcttcaggaagggctgggcagccatcgaacccaagttccccacctcagcctgggccccagacctcccacccctccctgtgccgtcaccaagactctctccgcctcccaccgcacctgctaccttgtcacacagctctagacctgctgtctgtgtcctcggagccccgccctgacatcctggacatgcctagcctgcacgtagcttttccgtcttcaccccaaataaagtcctaatgcatc

SEQ ID NO: 103814 - DNA, 502 bp, Homo sapiens
  Payload ID: 403
  Gene Symbol: ASIC3
  Gene Name: acid sensing (proton gated) ion channel 3
  ENST ID: ENST00000485929
  CDS Start-End: 1-434
cggaagtgcggctgccgaatggtgtacatgccaggcgacgtgccagtgtgcagcccccagcagtacaagaactgtgcccacccggccatagggagaacgtgctggccctggacatcttctttgaggccctcaactatgagaccgtggagcagaagaaggcctatgagatgtcagagctgcttggtgacattgggggccagatggggctgttcatcggggccagcctgctcaccatcctcgagatcctagactacctctgtgaggtgttccgagacaaggtcctgggatatttctggaaccgacagcactcccaaaggcactccagcaccaatctgcttcaggaagggctgggcagccatcgaacccaagttccccacctcagcctgggccccagctctagacctgctgtctgtgtcctcggagccccgccctgacatcctggacatgcctagcctgcacgtagcttttccgtcttcaccccaaataaagtcctaatgcatca

SEQ ID NO: 103815 - DNA, 2684 bp, Homo sapiens
  Payload ID: 404
  Gene Symbol: ASIC4
  Gene Name: acid sensing (proton gated) ion channel family member 4
  Uniprot ID: Q96FT7
  ENST ID: ENST00000347842
  CDS Start-End: 15-1958
gggctccggagcacatgctgagcggagcggctggggctgcgcggcgtggcggagcagcgctcgctccctcgctcactcgctcgctcgcagggacacacgcaggggctgacagctgtgctggtgctgataagggaagccacaaggagacgatcgaggagagagacaagcggcagcagaggcagcagcggcagaggcagcaccagggctgcggagctgctgggagtgggagtgactcccccacctcgggcccccaccctgtccctgtcctcttcccgcttgccctgagtttagaagagcagccgctgccaccactgccactcgggagggcaccagggctgctggctagggagggacagggcagggaggctctggccagtcccagcagccggggacagatgccgatcgagattgtgtgcaaaatcaaatttgctgaggaggatgcgaaacccaaggagaaggaggcaggggatgagcagagcctcctcggggctgttgcccctggagcagccccccgagacctggccacctttgccagcaccagcaccctgcatggactgggccgggcctgtggcccaggcccccacggactgcgcagaaccctgtgggcactggccctactcacctcgctggctgccttcctgtaccaggcggctggcctggcccggggctacctgacccggcctcacctggtggcaatggaccccgctgccccagccccagtggcgggcttcccggctgtcaccctctgcaatatcaaccgcttccggcattcggcactcagcgatgccgacatcttccacctggccaatctgacagggctgccccccaaagaccgggatgggcaccgtgcggctggcctgcgctacccagagcctgacatggtagacatcctcaaccgcactggccaccagctcgccgacatgcttaagagctgcaacttcagtgggcatcactgctccgccagcaacttctctgtggtctatactcgctatgggaagtgttacaccttcaacgcggacccgcggagctcgctgcccagccgggcagggggcatgggcagtggcctggagatcatgctggacatccagcaggaggagtacctgcccatctggagggagacaaatgagacgtcgtttgaggcaggtattcgggtgcagatccacagccaggaggagccgccctacatccaccagctggggttcggggtgtccccaggcttccagacctttgtgtcctgccaggaacagcggctgacctacctgccccagccctggggcaactgccgcgcagagagtgagctcagggagcctgagcttcagggctactcggcctacagtgtgtctgcctgccggctgcgctgtgaaaaggaggccgtgcttcagcgctgccactgccggatggtgcacatgccagactccctgggtgggggccctgagggcccgtgcttctgccccaccccctgcaacctgacacgctatgggaaagagatctccatggtcaggatccccaacaggggctcagcccggtacctggcgaggaagtacaaccgcaacgagacctacatacgggagaacttcctggtcctagatgtcttctttgaggccctgacctctgaagccatggagcagcgagcagcctatggcctgtcagccctgctgggagacctcgggggacagatgggcctgttcattggggccagcatcctcacgttgctggagatcctcgactacatctatgaggtgtcctgggatcgactgaagcgggtatggaggcgtcccaagacccccctgcggacctccactgggggcatctccactttggggcttcaggagctgaaggaacagagtccctgcccgagccggggccgagtggagggtgggggggtcagcagtctgctccccaatcaccaccacccccacggtcccccaggaggtctctttgaagattttgcttgctaggacggtgctgtgactgaaaggacccaggagtctgggacccctcctgggatccccagcacattctcctgctcctgggagaggcctgggggcggtgctcactgggagggccaggactcagttcctgctctcatcctcccctgccctgatgtcagctgctttgcacaaaggtccttcttgtccacaccccttatccccaggctggtgccccgggagggctggagaccaggccatgggccctcacggagaggaagggaaggaaggagagggagggggaggatagagcccatcccagccggggagggggagccctctgtacatttgtaaatatttagggaaagccgggtggggggaggggatacagatgtagaaggtgggtagggctacaggggtgggtgatttagggacagccagggtcccagccccaatgtcagcaggatagggagagccccaggactcaggagtgctgggctggtcctacttcctgcccctctccaggcccagctcccctcttggcagggggagaggatggcccagcaggcctggcccagctcccagttccccctgcaccagccccacccctagagtcccttctatagggagggggcaggagaccttccagacttcggctgagcttggagggtgggaagggagccttctcagtcctctctccctccagtctgattttataaagtgctgacgagattgggaataaagaggcataaagaa

SEQ ID NO: 103816 - DNA, 2741 bp, Homo sapiens
  Payload ID: 404
  Gene Symbol: ASIC4
  Gene Name: acid sensing (proton gated) ion channel family member 4
  Uniprot ID: Q96FT7
  ENST ID: ENST00000358078
  CDS Start-End: 15-2015
gggctccggagcacatgctgagcggagcggctggggctgcgcggcgtggcggagcagcgctcgctccctcgctcactcgctcgctcgcagggacacacgcaggggctgacagctgtgctggtgctgataagggaagccacaaggagacgatcgaggagagagacaagcggcagcagaggcagcagcggcagaggcagcaccagggctgcggagctgctgggagtgggagtgactcccccacctcgggcccccaccctgtccctgtcctcttcccgcttgccctgagtttagaagagcagccgctgccaccactgccactcgggagggcaccagggctgctggctagggagggacagggcagggaggctctggccagtcccagcagccggggacagatgccgatcgagattgtgtgcaaaatcaaatttgctgaggaggatgcgaaacccaaggagaaggaggcaggggatgagcagagcctcctcggggctgttgcccctggagcagccccccgagacctggccacctttgccagcaccagcaccctgcatggactgggccgggcctgtggcccaggcccccacggactgcgcagaaccctgtgggcactggccctactcacctcgctggctgccttcctgtaccaggcggctggcctggcccggggctacctgacccggcctcacctggtggcaatggaccccgctgccccagccccagtggcgggcttcccggctgtcaccctctgcaatatcaaccgcttccggcattcggcactcagcgatgccgacatcttccacctggccaatctgacagggctgccccccaaagaccgggatgggcaccgtgcggctggcctgcgctacccagagcctgacatggtagacatcctcaaccgcactggccaccagctcgccgacatgcttaagagctgcaacttcagtgggcatcactgctccgccagcaacttctctgtggtctatactcgctatgggaagtgttacaccttcaacgcggacccgcggagctcgctgcccagccgggcagggggcatgggcagtggcctggagatcatgctggacatccagcaggaggagtacctgcccatctggagggagacaaatgagacgtcgtttgaggcaggtattcgggtgcagatccacagccaggaggagccgccctacatccaccagctggggttcggggtgtccccaggcttccagacctttgtgtcctgccaggaacagcggctgacctacctgccccagccctggggcaactgccgcgcagagagtgagctcagggagcctgagcttcagggctactcggcctacagtgtgtctgcctgccggctgcgctgtgaaaaggaggccgtgcttcagcgctgccactgccggatggtgcacatgccaggcaatgagaccatctgcccaccaaatatctacatcgagtgtgcagaccacacactggactccctgggtgggggccctgagggcccgtgcttctgccccaccccctgcaacctgacacgctatgggaaagagatctccatggtcaggatccccaacaggggctcagcccggtacctggcgaggaagtacaaccgcaacgagacctacatacgggagaacttcctggtcctagatgtcttctttgaggccctgacctctgaagccatggagcagcgagcagcctatggcctgtcagccctgctgggagacctcgggggacagatgggcctgttcattggggccagcatcctcacgttgctggagatcctcgactacatctatgaggtgtcctgggatcgactgaagcgggtatggaggcgtcccaagacccccctgcggacctccactgggggcatctccactttggggcttcaggagctgaaggaacagagtccctgcccgagccggggccgagtggagggtgggggggtcagcagtctgctccccaatcaccaccacccccacggtcccccaggaggtctctttgaagattttgcttgctaggacggtgctgtgactgaaaggacccaggagtctgggacccctcctgggatccccagcacattctcctgctcctgggagaggcctgggggcggtgctcactgggagggccaggactcagttcctgctctcatcctcccctgccctgatgtcagctgctttgcacaaaggtccttcttgtccacaccccttatccccaggctggtgccccgggagggctggagaccaggccatgggccctcacggagaggaagggaaggaaggagagggagggggaggatagagcccatcccagccggggagggggagccctctgtacatttgtaaatatttagggaaagccgggtggggggaggggatacagatgtagaaggtgggtagggctacaggggtgggtgatttagggacagccagggtcccagccccaatgtcagcaggatagggagagccccaggactcaggagtgctgggctggtcctacttcctgcccctctccaggcccagctcccctcttggcagggggagaggatggcccagcaggcctggcccagctcccagttccccctgcaccagccccacccctagagtcccttctatagggagggggcaggagaccttccagacttcggctgagcttggagggtgggaagggagccttctcagtcctctctccctccagtctgattttataaagtgctgacgagattgggaataaagaggcataaagaa

SEQ ID NO: 103817 - DNA, 1692 bp, Homo sapiens
  Payload ID: 405
  Gene Symbol: ASIC5
  Gene Name: acid sensing (proton gated) ion channel family member 5
  Uniprot ID: Q9NY37
  ENST ID: ENST00000537611
  CDS Start-End: 48-1565
atgaaaattgggttaccctgaggactcttgcttaactgaaatcacaaatggagcagacagaaaaatcaaaagtatatgctgagaacggactcttagaaaagataaagctttgcctttcaaagaaaccactgccatctcccactgagcgaaagaagtttgaccatgactttgccatctccacttcctttcatgggatacacaatattgttcagaaccggagcaaaattcgcagggtgctctggttggtggtggttctgggctcagtctcacttgtgacatggcagatctacattcgcttgctcaactacttcacatggccaaccacaacgtccattgaggttcaatatgtggaaaagatggagttcccagctgtgacattttgtaatttgaacaggttccaaacagatgctgtagccaaatttggtgttatttttttcttatggcacattgtatccaaagtcctccatcttcaagaaattactgccaattccactggctctagagaggctactgattttgctgcaagtcaccaaaacttcagcattgtggaatttatcaggaacaaaggtttttatctcaacaatagcactttgttggactgtgagttttttggaaagccatgtagcccaaaggattttgcacatgtcttcactgaatatggaaattgttttacttttaatcatggtgaaactctccaagcaaagagaaaagtgagtgtctctggaagaggtttgagcttactcttcaatgtgaatcaggaggcattcactgataacccagcccttggtttcgttgatgctgggatcatctttgttatccattcaccaaagaaggtgccacagtttgatgggttaggcttgttgtcacctgtgggaatgcacgcaagggtaaccatccgccaagtgaagacagttcatcaagaatacccttggggagaatgcaatcctaacatcaagctgcagaattttagcagctacagcacttctggttgcttgaaggaatgcaaagcccagcacataaaaaagcaatgtggatgtgtgccttttcttcttcctggatatgggatagaatgtgacctacaaaagtacttcagctgtgtttctcctgtacttgaccacattgaatttaaggatttatgtacagtaggaacacataactctagctgccccgtttcttgtgaagaaatagaatacccggccactatttcttattcctcttttccaagtcaaaaagctttgaaatatctttccaagaagttgaatcaaagccggaaatacatcagggagaatcttgtaaaaattgaaattaactatagtgacctaaactataagataacccagcagcaaaaggcggtgagtgtgtctgagttacttgcagatcttggtggtcagctgggtctattttgtggggccagtctgatcacgatcatagaaattattgaatatctattcaccaatttctactggatatgcattttctttttgctgaagatatctgaaatgacccagtggactcctccacctcagaatcatctgggaaataaaaataggatagaggagtgttaatggtcacttagaataaaatagtttccttttcatgataccttcagatttatcttgactaattcattgttacgtcacttttctatagttttgagagttcgataaaagccattaaagatatgtatctctt

SEQ ID NO: 103818 - DNA, 1282 bp, Homo sapiens
  Payload ID: 406
  Gene Symbol: ASIC5
  Gene Name: Acid sensing ion channel subunit family member 5
  ENST ID: ENST00000572394
  CDS Start-End: 48-1282
atgaaaattgggttaccctgaggactcttgcttaactgaaatcacaaatggagcagacagaaaaatcaaaagtatatgctgagaacggactcttagaaaagataaagctttgcctttcaaagaaaccactgccatctcccactgagcgaaagaagtttgaccatgactttgccatctccacttcctttcatgggatacacaatattgttcagaaccggagcaaaattcgcagggtgctctggttggtggtggttctgggctcagtctcacttgtgacatggcagatctacattcgcttgctcaactacttcacatggccaaccacaacgtccattgaggttcaatatgtggaaaagatggagttcccagctgtgacattttgtaatttgaacaggttccaaacagatgctgtagccaaatttggtgttatttttttcttatggcacattgtatccaaagtcctccatcttcaagaaattactgccaattccactggctctagagaggctactgattttgctgcaagtcaccaaaacttcagcattgtggaatttatcaggaacaaaggtttttatctcaacaatagcactttgttggactgtgagttttttggaaagccatgtagcccaaaggattttgcacatgtcttcactgaatatggaaattgttttacttttaatcatggtgaaactctccaagcaaagagaaaagtgagtgtctctggaagaggtttgagcttactcttcaatgtgaatcaggaggcattcactgataacccagcccttggtttcgttgatgctgggatcatctttgttatccattcaccaaagaaggtgccacagtttgatgggttaggcttgttgtcacctgtgggaatgcacgcaagggtaaccatccgccaagtgaagacagttcatcaagaatacccttggggagaatgcaatcctaacatcaagctgcagaattttagcagctacagcacttctggttgcttgaaggaatgcaaagcccagcacataaaaaagcaatgtggatgtgtgccttttcttcttcctggatatgggatagaatgtgacctacaaaagtacttcagctgtgtttctcctgtacttgaccacattgaatttaaggatttatgtacagtaggaacacataactctagctgccccgtttcttgtgaagaaatagaatacccggccactatttcttattcctcttttccaagtcaaaaagctttgaaatatctttccaagaagttgaatcaaagccggaaatacatcag

SEQ ID NO: 103819 - DNA, 2001 bp, Homo sapiens
  Payload ID: 407
  Gene Symbol: ANP32A
  Gene Name: acidic (leucine-rich) nuclear phosphoprotein 32 family, member A
  ENST ID: ENST00000409628
  CDS Start-End: 118-357
gagaaccgagcggagctggttgagccttcaaagtcctaaaacgcgcggccgtgggttcggggtttattgattgaattccgccggcgcgggagcctctgcagagagagagcgcgagagatggagatgggcagacggattcatttagagctgcggaacaggacgccctctgatgtgaaagaacttgtcctggacaacagtcggtcgaatgaaggcaaactcgaaggcctcacagatgaatttgaagaactggaattcttaagtacaatcaacgtaggcctcacctcaatcgcaaacttaccaaagttaaacaaacttaagaagtattggcagaaaagtgtccgaacctcacgcatctaaatttaagtggcaacaaaattaaagacctcagcacaatagagccactgaaaaagttagaaaacctcaagagcttagaccttttcaattgcgaggtaaccaacctgaacgactaccgagaaaatgtgttcaagctcctcccgcaactcacatatctcgacggctatgaccgggacgacaaggaggcccctgactcggatgctgagggctacgtggagggcctggatgatgaggaggaggatgaggatgaggaggagtatgatgaagatgctcaggtagtggaagacgaggaggacgaggatgaggaggaggaaggtgaagaggaggacgtgagtggagaggaggaggaggatgaagaaggttataacgatggagaggtagatgacgaggaagatgaagaagagcttggtgaagaagaaaggggtcagaagcgaaaacgagaacctgaagatgagggagaagatgatgactaagtggaataacctattttgaaaaattcctattgtgatttgactgtttttacccatatcccctctcccccccccctccaatcctgccccctgaaacttatttttttctgattgtaacgttgctgtgggaacgagaggggaagagtgtactgggggttgcggggggagggatggcgggtgggggtggaataaaatactatttttactgccactctttatttttttcccctactttttctttgtgtccggtttttgtccctgtaaatgcgatagctaagtacacactaagtgagcatttgttcctgactctcaaagaggatggtttggagttctcttacgtttcctggtatttcccaagtctcttgggttggttggaaggctgtggctggtctcagtttggttactcaatgcccaggaggggctgagcaccagccatatcttttgctttggttcacatgatgatacctgcttttctcaggcctgctagaggcatccaacgccctggtttgtaaatagcaacctaaaggcgtattttggcactggtctggggacattccccatctctcatcccttttcccccttcacagatggtggtgggcttcgctctacaaagaggactctgatgttactcttgagcttatgagccagagagctgaaaaccgcaggcttgttgtgttaagttacaaggaaaatggatttggtaattaaaattagaagaaacacaccttcaaacttcaacttctttaaaagaaaaaaaaaactgtcctatcttgttctgtaaaatattagaacgctttgttttacaaaaaatgatgagagaattcttccacatgtacttctgtgcttagaacatttttacggacctaagcgctggagacgttgctgcatgtcggctgggttttttttttcatacacccgagcacggaaaaactaacgcaaaattgtattttcttacctagtggaaatctgaaatgactgcaaattcctagtgaatgtacaggtttgctttcgtgtccctcttctggttgctttagaagtgacgtgtaatttctgaacccatgtttcatctgtataaaagaacatctgcaccagtttttctcctgcccctcagaagagccaaactttgagttttatgtctgtttgtcattgataaatttcaataaatctttttatacaa

SEQ ID NO: 103820 - DNA, 2440 bp, Homo sapiens
  Payload ID: 407
  Gene Symbol: ANP32A
  Gene Name: acidic (leucine-rich) nuclear phosphoprotein 32 family, member A
  Uniprot ID: P39687
  ENST ID: ENST00000465139
  CDS Start-End: 145-894
agtgtgcgccgcgggtgctgggggctcgagaaccgagcggagctggttgagccttcaaagtcctaaaacgcgcggccgtgggttcggggtttattgattgaattccgccggcgcgggagcctctgcagagagagagcgcgagagatggagatgggcagacggattcatttagagctgcggaacaggacgccctctgatgtgaaagaacttgtcctggacaacagtcggtcgaatgaaggcaaactcgaaggcctcacagatgaatttgaagaactggaattcttaagtacaatcaacgtaggcctcacctcaatcgcaaacttaccaaagttaaacaaacttaagaagcttgaactaagcgataacagagtctcagggggcctggaagtattggcagaaaagtgtccgaacctcacgcatctaaatttaagtggcaacaaaattaaagacctcagcacaatagagccactgaaaaagttagaaaacctcaagagcttagaccttttcaattgcgaggtaaccaacctgaacgactaccgagaaaatgtgttcaagctcctcccgcaactcacatatctcgacggctatgaccgggacgacaaggaggcccctgactcggatgctgagggctacgtggagggcctggatgatgaggaggaggatgaggatgaggaggagtatgatgaagatgctcaggtagtggaagacgaggaggacgaggatgaggaggaggaaggtgaagaggaggacgtgagtggagaggaggaggaggatgaagaaggttataacgatggagaggtagatgacgaggaagatgaagaagagcttggtgaagaagaaaggggtcagaagcgaaaacgagaacctgaagatgagggagaagatgatgactaagtggaataacctattttgaaaaattcctattgtgatttgactgtttttacccatatcccctctcccccccccctccaatcctgccccctgaaacttatttttttctgattgtaacgttgctgtgggaacgagaggggaagagtgtactgggggttgcggggggagggatggcgggtgggggtggaataaaatactatttttactgccactctttatttttttcccctactttttctttgtgtccggtttttgtccctgtaaatgcgatagctaagtacacactaagtgagcatttgttcctgactctcaaagaggatggtttggagttctcttacgtttcctggtatttcccaagtctcttgggttggttggaaggctgtggctggtctcagtttggttactcaatgcccaggaggggctgagcaccagccatatcttttgctttggttcacatgatgatacctgcttttctcaggcctgctagaggcatccaacgccctggtttgtaaatagcaacctaaaggcgtattttggcactggtctggggacattccccatctctcatcccttttcccccttcacagatggtggtgggcttcgctctacaaagaggactctgatgttactcttgagcttatgagccagagagctgaaaaccgcaggcttgttgtgttaagttacaaggaaaatggatttggtaattaaaattagaagaaacacaccttcaaacttcaacttctttaaaagaaaaaaaaaactgtcctatcttgttctgtaaaatattagaacgctttgttttacaaaaaatgatgagagaattcttccacatgtacttctgtgcttagaacatttttacggacctaagcgctggagacgttgctgcatgtcggctgggttttttttttcatacacccgagcacggaaaaactaacgcaaaattgtattttcttacctagtggaaatctgaaatgactgcaaattcctagtgaatgtacaggtttgctttcgtgtccctcttctggttgctttagaagtgacgtgtaatttctgaacccatgtttcatctgtataaaagaacatctgcaccagtttttctcctgcccctcagaagagccaaactttgagttttatgtctgtttgtcattgataaatttcaataaatctttttatacaatttttttggggatggcttctttgagtccaacaggccattgatcttttcaagatgcattccagatgaactgctaggtgagggggaagcttcatttttgttacctgatagaatagcttttcttatgagatatatataatgtgatactatgtttggatatttttggtcttaaagcaagactcagtggtgtatcttcattaaaagcttcctttaaaaaagttacagagttactaaaaaaacaagtacccaaacaatcaagttgggccaaccttggaaccttgttttgaatatctttcattgttttgtttgtcgtattgtaaaaagaatgtatggttgaaaactcaggaatgtttataaaacaaattatttcacaaa

SEQ ID NO: 103821 - DNA, 724 bp, Homo sapiens
  Payload ID: 407
  Gene Symbol: ANP32A
  Gene Name: acidic (leucine-rich) nuclear phosphoprotein 32 family, member A
  ENST ID: ENST00000560303
  CDS Start-End: 136-669
cgcgggtgctgggggctcgagaaccgagcggagctggttgagccttcaaagtcctaaaacgcgcggccgtgggttcggggtttattgattgaattccgccggcgcgggagcctctgcagagagagagcgcgagagatggagatgggcagacggattcatttagagctgcggaacaggacgccctctgatgtgaaagaacttgtcctggacaacagtcggtcgaatgaaggcaaactcgaaggcctcacagatgaatttgaagaactggaattcttaagtacaatcaacgtaggcctcacctcaatcgcaaacttaccaaagttaaacaaacttaagaagcttgaactaagcgataacagagtctcagggggcctggaagtattggcagaaaagtgtccgaacctcacgcatctaaatttaagtggcaacaaaattaaagacctcagcacaatagagccactgaaaaagttagaaaacctcaagagcttagaccttttcaattgcgaggtaaccaacctgaacgactaccgagaaaatgtgttcaagctcctcccgcaactcacatatctcgacggctatgaccgggacgacaaggaggcccctgactcggatgctgagggctacgtggagggcctggatgatgaggaggaggatgaggatggtgggtgacagggatgaagaaggttataacgatggagaggtagatgacgaggaagatgaagaa

SEQ ID NO: 103822 - DNA, 1463 bp, Homo sapiens
  Payload ID: 408
  Gene Symbol: ANP32B
  Gene Name: acidic (leucine-rich) nuclear phosphoprotein 32 family, member B
  Uniprot ID: Q92688
  ENST ID: ENST00000339399
  CDS Start-End: 196-951
ctccgctcccgtgagtaacttggctccgggggctccgctcgcctgcccgcacgccgcccgccacccaggaccgcgccgccggcctccgccgctagcaaacccttccgacggccctcgctgcgcaagccgggacgcctctcccccctccgcccccgccgcggaaagttaagtttgaagaggggggaagaggggaacatggacatgaagaggaggatccacctggagctgaggaaccggaccccggcagctgttcgagaacttgtcttggacaattgcaaatcaaatgatggaaaaattgagggcttaacagctgaatttgtgaacttagagttcctcagtttaataaatgtaggcttgatctcagtttcaaatctccccaagctgcctaaattgaaaaagcttgaactcagtgaaaatagaatctttggaggtctggacatgttagctgaaaaacttccaaatctcacacatctaaacttaagtggaaataaactgaaagatatcagcaccttggaacctttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagatgaggaagacgaggacgatgaggatggtgaagaagaggagtttgatgaagaagatgatgaagatgaagatgtagaaggggatgaggacgacgatgaagtcagtgaggaggaagaagaatttggacttgatgaagaagatgaagatgaggatgaggatgaagaggaggaagaaggtgggaaaggtgaaaagaggaagagagaaacagatgatgaaggagaagatgattaagaccccagatgacctgcagaaacagaactgttcagtattggttggactgctcatggattttgtagctgtttaaaaaaaaaaaaaaggtagctgtgatacaaaccccaggacacccacccacccaaagagccaaagaatagttcctgtgacattccgccttccttccatgtagtccctcttggtaatctaccaccaagcttgtggacttcaccccaacaaaattgtaagcgttgttaggtttttgtgtaagattcttgctgtagcgtggatagctgtgattggtgagtcaaccgtctgtggctaccagttacactgagattgtaacagcatttttactttctgtacaacaaaaaagctttgtaaataaaatcttaacattttgggtctgttttttcatgctttgctttttaattattattattattttttttacattaggacattttatgtgacaactgccaaaaaagtatttttaagaatttaagcgaaataaacagttactctttggtaaa

SEQ ID NO: 103823 - DNA, 960 bp, Homo sapiens
  Payload ID: 409
  Gene Symbol: ANP32D
  Gene Name: acidic (leucine-rich) nuclear phosphoprotein 32 family, member D
  Uniprot ID: O95626
  ENST ID: ENST00000266594
  CDS Start-End: 1-396
atggagatgggcaaatggattcatttagagctgcggaacaggacgccctccgatgtgaaagaacttttcctggacaacagtcagtcaaatgaaggcaaattggaaggcctcacagatgaatttgaagaactggaattattaaatacaatcaacataggcctcacctcaattgcaaacttgccaaagttaaacaaacttaagaagcttgaactaagcagtaacagagcctcagtgggcctagaagtattggcagaaaagtgtccaaacctcatacatctaaatttaagtggcaacaaaattaaagacctcagcacaatagagcccctgaaaaagttagaaaacctcgagagcttagaccttttcacttgcgaggtaaccaacctgaacaactactgagaaaagatgttcaagctcctcctgcaactcacatatctcaacggctgtgacccggatgacaaggaggcccctaactcggatggtgagggctttgtggagtgcctggatgacaaggaggaggatgaggatgaggaggagtatgatgaagatgctcaggtaatggaagatgaggaggacgaggatgaggaggaggaacgtgaagaggaggacgtgagtggagacgaggaggagaaggatgaaggttataacaatggagaggtagatgatgaggaagatgaagaagagcttggtgaagaagaaaggggtcagaagcgaaaataagaaactgaagatgagggagaagacgatgcctaagtggaataatctattttgaaaaattccttttgtgattttactgtttttagccgtatcccctcccccactccaatcctgccccctgaaacttatttttttctgattgtaacgttgctgtgggagcaagagaggaaaagtgtactgggggttgtgagggaagggaggggaggagggggtggaataaaatactatttttactgccactcttta

SEQ ID NO: 103824 - DNA, 1048 bp, Homo sapiens
  Payload ID: 410
  Gene Symbol: ANP32E
  Gene Name: acidic (leucine-rich) nuclear phosphoprotein 32 family, member E
  ENST ID: ENST00000369114
  CDS Start-End: 300-749
ggaactgcgggtgtgtgtgtgtatgtgtgtgtgtatgtgtgtgcgcgcgtgcgtgcgtgtgtgtgcgcgcgctagtgtgtggacaaggaggtgggggcagctgagttagagtcccaactcttggactccatttgctattctcttctttctcccccacacctatctggtggtggtagtgggcgtttatatttgcgttccttttcattcatttctaaatctcttaaaaattttgggttgggggtattggggaaggcaggaaagggaaaaggagagtagtagctgaagagcaagaggaggacatggagatgaagaagaagattaacctggagttaaggaacagatccccggaggaggtgacagagttagtccttgataattgcctgtgtgtcaatggggaaattgaaggcctgaatgatactttcaaagaactagaatttctgagtatggctaatgtggaactaagttcgctggcccggcttcccagcttaaataaacttcgaaaattggagcttagtgataatataatttctggaggcttggaagtcctggcagagaaatgtccaaatcttacctacctcaatctgagtggaaacaaaataaaagatctcagtacagtagaagctctggatgaagaagatgatgatgactatgttgaagaaggggaagaagaggaagaagaggaaggaggtcttcgaggggagaagaggaaacgagatgctgaagacgatggagaggaagaagatgactagatcattctaagaccagattctctaatgtttctgggtgtgcaatagagtgatcacatctttgtttcttcatgtacgatagctatccctacagaagataatgtgtaactttttataggaaaagtgtggttttactatttttgccttatcattccaaataagaactagtctgttaatgatcatattgtatgtagagaaaaattttcattgactcccattgtggaattccctagcaatttatttagacttaattttttaaattcaagcttactgtattagtcatttttagcccataattaaaa

SEQ ID NO: 103825 - DNA, 708 bp, Homo sapiens
  Payload ID: 410
  Gene Symbol: ANP32E
  Gene Name: acidic (leucine-rich) nuclear phosphoprotein 32 family, member E
  ENST ID: ENST00000369115
  CDS Start-End: 68-478
ccattgaaggggaaggaactgcgggaaagggaaaaggagagtagtagctgaagagcaagaggaggacatggagatgaagaagaagattaacctggagttaaggaacagatccccggaggaggaggataatgaagcgccggactctgaagaggaggatgatgaggatggcgatgaagatgatgaagaggaagaggaaaatgaagctggtccaccggaaggatatgaggaagaggaggaggaagaggaagaggaggatgaggatgaggatgaagatgaagatgaagcaggttcagagttgggagagggagaagaggaagtgggcctctcatacttaatgaaagaagaaattcaggatgaagaagatgatgatgactatgttgaagaaggggaagaagaggaagaagaggaagaaggaggtcttcgaggggagaagaggaaacgagatgctgaagacgatggagaggaagaagatgactagatcattctaagaccagattctctaatgtttctgggtgtgcaatagagtgatcacatctttgtttcttcatgtacgatagctatccctacagaagataatgtgtaactttttataggaaaagtgtggttttactatttttgccttatcattccaaataagaactagtctgttaatgatcatattgtatgtagagaaaaattttcattgactcccattgtggaattccctag

SEQ ID NO: 103826 - DNA, 1339 bp, Homo sapiens
  Payload ID: 410
  Gene Symbol: ANP32E
  Gene Name: acidic (leucine-rich) nuclear phosphoprotein 32 family, member E
  Uniprot ID: Q9BTT0
  ENST ID: ENST00000436748
  CDS Start-End: 237-920
tgcgcgcgctagtgtgtggacaaggaggtgggggcagctgagttagagtcccaactcttggactccatttgctattctcttctttctcccccacacctatctggtggtggtagtgggcgtttatatttgcgttccttttcattcatttctaaatctcttaaaaattttgggttgggggtattggggaaggcaggaaagggaaaaggagagtagtagctgaagagcaagaggaggacatggagatgaagaagaagattaacctggagttaaggaacagatccccggaggaggtgacagagttagtccttgataattgcctgtgtgtcaatggggaaattgaaggcctgaatgatactttcaaagaactagaatttctgagtatggctaatgtggaactaagttcgctggcccggcttcccagcttaaataaacttcgaaaacaaaatcttaaaaatttgaaaagtcttgacctgtttaactgtgagatcacaaacctggaagattatagagaaagtatttttgaactactgcagcaaatcacatacttagatggatttgatcaggaggataatgaagcgccggactctgaagaggaggatgatgaggatggcgatgaagatgatgaagaggaagaggaaaatgaagctggtccaccggaaggatatgaggaagaggaggaggaagaggaagaggaggatgaggatgaggatgaagatgaagatgaagcaggttcagagttgggagagggagaagaggaagtgggcctctcatacttaatgaaagaagaaattcaggatgaagaagatgatgatgactatgttgaagaaggggaagaagaggaagaagaggaagaaggaggtcttcgaggggagaagaggaaacgagatgctgaagacgatggagaggaagaagatgactagatcattctaagaccagattctctaatgtttctgggtgtgcaatagagtgatcacatctttgtttcttcatgtacgatagctatccctacagaagataatgtgtaactttttataggaaaagtgtggttttactatttttgccttatcattccaaataagaactagtctgttaatgatcatattgtatgtagagaaaaattttcattgactcccattgtggaattccctagcaatttatttagacttaattttttaaattcaagcttactgtattagtcatttttagcccataattaaaacatgatcacttttacacaggtgtagtatggtgcatttcattccttatttataaattaactgaaattacagtttgctataatataaaatgacaatagtctcttgagtggtaagttggttat

SEQ ID NO: 103827 - DNA, 616 bp, Homo sapiens
  Payload ID: 410
  Gene Symbol: ANP32E
  Gene Name: acidic (leucine-rich) nuclear phosphoprotein 32 family, member E
  ENST ID: ENST00000534437
  CDS Start-End: 1-303
gaggaggaggaagaggaagaggaggatgaggatgaggatgaagatgaagatgaagcaggttcagagttgggagagggagaagaggaagtgggcctctcatacttaatgaaagaagaaattcagagtgaaaaatcatatggatttttcaatcttcaaactgaatatttgaatttcaaggatgaagaagatgatgatgactatgttgaagaaggggaagaagaggaagaagaggaagaaggaggtcttcgaggggagaagaggaaacgagatgctgaagacgatggagaggaagaagatgactagatcattctaagaccagattctctaatgtttctgggtgtgcaatagagtgatcacatctttgtttcttcatgtacgatagctatccctacagaagataatgtgtaactttttataggaaaagtgtggttttactatttttgccttatcattccaaataagaactagtctgttaatgatcatattgtatgtagagaaaaattttcattgactcccattgtggaattccctagcaatttatttagacttaattttttaaattcaagcttactgtattagtcatttttagcccataattaaaacatgatcactttta

SEQ ID NO: 103828 - DNA, 621 bp, Homo sapiens
  Payload ID: 410
  Gene Symbol: ANP32E
  Gene Name: acidic (leucine-rich) nuclear phosphoprotein 32 family, member E
  ENST ID: ENST00000532744
  CDS Start-End: 279-621
tatgtgtgtgtgtatgtgtgtgcgcgcgtgcgtgcgtgtgtgtgcgcgcgctagtgtgtggacaaggaggtgggggcagctgagttagagtcccaactcttggactccatttgctattctcttctttctcccccacacctatctggtggtggtagtgggcgtttatatttgcgttccttttcattcatttctaaatctcttaaaaattttgggttgggggtattggggaaggcaggaaagggaaaaggagagtagtagctgaagagcaagaggaggacatggagatgaagaagaagattaacctggagttaaggaacagatccccggaggagttggagcttagtgataatataatttctggaggcttggaagtcctggcagagaaatgtccaaatcttacctacctcaatctgagtggaaacaaaataaaagatctcagtacagtagaagctctgcaaaatcttaaaaatttgaaaagtcttgacctgtttaactgtgagatcacaaacctggaagattatagagaaagtatttttgaactactgcagcaaatcacatacttagatggatttgatcaggaggataatgaagcgccggactctgaagaggaggatgatgagg

SEQ ID NO: 103829 - DNA, 908 bp, Homo sapiens
  Payload ID: 410
  Gene Symbol: ANP32E
  Gene Name: acidic (leucine-rich) nuclear phosphoprotein 32 family, member E
  ENST ID: ENST00000533654
  CDS Start-End: 170-667
tttgctattctcttctttctcccccacacctatctggtggtggtagtgggcgtttatatttgcgttccttttcattcatttctaaatctcttaaaaattttgggttgggggtattggggaaggcaggaaagggaaaaggagagtagtagctgaagagcaagaggaggacatggagatgaagaagaagattaacctggagttaaggaacagatccccggaggaggtgacagagttagtccttgataattgcctgtgtgtcaatggggaaattgaaggcctgaatgatactttcaaagaactagaatttctgagtatggctaatgtggaactaagttcgctggcccggcttcccagcttaaataaacttcgaaaattggagcttagtgataatataatttctggaggcttggaagtcctggcagagaaatgtccaaatcttacctacctcaatctgagtggaaacaaaataaaagatctcagtacagtagaagctctgatggcgatgaagatgatgaagaggaagaggaaaatgaagctggtccaccggaaggatatgaggaagaggaggaggaagaggaagaggaggatgaggatgaggatgaagatgaagatgaagcaggttcagagttgggagagggagaagaggaagtgggcctctcatacttaatgaaagaagaaattcagaagaaggaggtcttcgaggggagaagaggaaacgagatgctgaagacgatggagaggaagaagatgactagatcattctaagaccagattctctaatgtttctgggtgtgcaatagagtgatcacatctttgtttcttcatgtacgatagctatccctacagaagataatgtgtaactttttataggaaaagtgtggttttactatttttgccttatcattcca

SEQ ID NO: 103830 - DNA, 512 bp, Homo sapiens
  Payload ID: 410
  Gene Symbol: ANP32E
  Gene Name: acidic (leucine-rich) nuclear phosphoprotein 32 family, member E
  ENST ID: ENST00000534220
  CDS Start-End: 198-512
gagttagagtcccaactcttggactccatttgctattctcttctttctcccccacacctatctggtggtggtagtgggcgtttatatttgcgttccttttcattcatttctaaatctcttaaaaattttgggttgggggtattggggaaggcaggaaagggaaaaggagagtagtagctgaagagcaagaggaggacatggagatgaagaagaagattaacctggagttaaggaacagatccccggaggagcaaatcacatacttagatggatttgatcaggaggataatgaagcgccggactctgaagaggaggatgatgaggatggcgatgaagatgatgaagaggaagaggaaaatgaagctggtccaccggaaggatatgaggaagaggaggaggaagaggaagaggaggatgaggatgaggatgaagatgaagatgaagcaggttcagagttgggagagggagaagaggaagtgggcctctcatacttaatgaaagaagaaattcag

SEQ ID NO: 103831 - DNA, 3451 bp, Homo sapiens
  Payload ID: 410
  Gene Symbol: ANP32E
  Gene Name: acidic (leucine-rich) nuclear phosphoprotein 32 family, member E
  Uniprot ID: Q9BTT0
  ENST ID: ENST00000583931
  CDS Start-End: 371-1177
ggagtgtaggccagggggttggcggtgccgtgtcatggaggctcagtctctgagcagccattgaaggggaaggaactgcgggtgtgtgtgtgtatgtgtgtgtgtatgtgtgtgcgcgcgtgcgtgcgtgtgtgtgcgcgcgctagtgtgtggacaaggaggtgggggcagctgagttagagtcccaactcttggactccatttgctattctcttctttctcccccacacctatctggtggtggtagtgggcgtttatatttgcgttccttttcattcatttctaaatctcttaaaaattttgggttgggggtattggggaaggcaggaaagggaaaaggagagtagtagctgaagagcaagaggaggacatggagatgaagaagaagattaacctggagttaaggaacagatccccggaggaggtgacagagttagtccttgataattgcctgtgtgtcaatggggaaattgaaggcctgaatgatactttcaaagaactagaatttctgagtatggctaatgtggaactaagttcgctggcccggcttcccagcttaaataaacttcgaaaattggagcttagtgataatataatttctggaggcttggaagtcctggcagagaaatgtccaaatcttacctacctcaatctgagtggaaacaaaataaaagatctcagtacagtagaagctctgcaaaatcttaaaaatttgaaaagtcttgacctgtttaactgtgagatcacaaacctggaagattatagagaaagtatttttgaactactgcagcaaatcacatacttagatggatttgatcaggaggataatgaagcgccggactctgaagaggaggatgatgaggatggcgatgaagatgatgaagaggaagaggaaaatgaagctggtccaccggaaggatatgaggaagaggaggaggaagaggaagaggaggatgaggatgaggatgaagatgaagatgaagcaggttcagagttgggagagggagaagaggaagtgggcctctcatacttaatgaaagaagaaattcaggatgaagaagatgatgatgactatgttgaagaaggggaagaagaggaagaagaggaagaaggaggtcttcgaggggagaagaggaaacgagatgctgaagacgatggagaggaagaagatgactagatcattctaagaccagattctctaatgtttctgggtgtgcaatagagtgatcacatctttgtttcttcatgtacgatagctatccctacagaagataatgtgtaactttttataggaaaagtgtggttttactatttttgccttatcattccaaataagaactagtctgttaatgatcatattgtatgtagagaaaaattttcattgactcccattgtggaattccctagcaatttatttagacttaattttttaaattcaagcttactgtattagtcatttttagcccataattaaaacatgatcacttttacacaggtgtagtatggtgcatttcattccttatttataaattaactgaaattacagtttgctataatataaaatgacaatagtctcttgagtggtaagttggttatttttttagtaggtgatccaggaatctttagtttgaaggcagttacctttttttttttttttttttgactaagagtgtttggttgcttttttgtcacaagtaacttggaaaatagaagcagaatagtaaaggttctattcagcaacatagttcatggattttgtggaggttctattcagtaatatggttcatggatttagtggtgactgataagattttatttttgaaggaaaaattgcttatactaagtccagagacatgcaggtgagcccttttgtcaggctgcaaatcatgacatgccgatggttgtttattttgtttttaggtgtgcattctttttcttcttagcaattcctttatgatcaccttcccttcttgtttcactccctcccgctctctcaaaaggaacttgggaaacttgtgaaacccaggaaaacctttagtcttatacctcaactacctttcagtcctgtctgggttttaaataagtgaagtagaagaaattgagtattttctgacataagaatatattatcaatacagttttatgcagtaagctctccttaccataaatgtttcttggttgacaacatctaagacaatattagtgggatgaagaaagaaaagcaggggtgcttttggaagcagtgttagtgttcctcaaaagtcggaacaattgcctgttgatatattaataagacattaaagtcaaattttaatgttggcctctcaaatgatttggataccactctgcaaagtatttctaacctttaattcccagttttaaaacagatataataatagcatttaattggaatatactaggcagctggaaaagtatttgaaactaaattgacattaaaattaagatttgttttcaagtggatgtccattaaaagtagaaaaatatttgggataagtgagtgtgtgtttccttacatggctactaaataaaatataatgagtatacaagtatatctcctcttttgctatggaggctccatgttcaaggcaatggctttttaaatcttggctatctaaaattttttccctttgttttgaatatttgtaagtttttaagaagttagtgtcagcaaattaattgaagttatgcttctatactgggacatatttaaatactgagtatagtactgctgctactgcttctacaatgtaaaatgtatgacttggtgttttaaagtaaaaattatgatgttacttgtggagaaactaaaaatgttgtacaactgaccgaaagaaaacccttggggataagtttagtgaggggattggaatccccaaaaagataacatttttcttctgcttttaaaaactgaaattccctgttctagttcctaacaattctcattacatactatgccagattacaaaatacttatttttaaaatgaaatctatatattgactttcttatcaatcatcttactgtgcaatcaaaattagagtactttggtttgaaaacaacacttagagcctccagataacttttaagacttatttagctttgtgggtggtattttcatgcaaataagtaagggtgggttttatattttgtagaagttttcggtcctattttaatgctctttgtatggcagtatgtatatattgtgttaagttcctcaagaatctccttaaaaactttgaagttaatacttttgtgcaactgtgttttgaataaagccatgacagtgttaaaaacaaacaaaaaaatttgcagtactcctgattattcttttattgtttttgactgttccctgtttttttctgtgactgctgtaacttaaagtttttgaaactgaattgcttcaaataaattgaagatttgttataatgatta

SEQ ID NO: 103832 - DNA, 2989 bp, Homo sapiens
  Payload ID: 410
  Gene Symbol: ANP32E
  Gene Name: acidic (leucine-rich) nuclear phosphoprotein 32 family, member E
  Uniprot ID: Q9BTT0
  ENST ID: ENST00000616917
  CDS Start-End: 191-853
gtcagtcggagcggcaggtcgcgagagcagggctggtggccagcggggagcctcgcagaggaaagcatcagtcttgctgaaataagcctagaattggaacgtgacagagttagtccttgataattgcctgtgtgtcaatggggaaattgaaggcctgaatgatactttcaaagaactagaatttctgagtatggctaatgtggaactaagttcgctggcccggcttcccagcttaaataaacttcgaaaattggagcttagtgataatataatttctggaggcttggaagtcctggcagagaaatgtccaaatcttacctacctcaatctgagtggaaacaaaataaaagatctcagtacagtagaagctctgcaaaatcttaaaaatttgaaaagtcttgacctgtttaactgtgagatcacaaacctggaagattatagagaaagtatttttgaactactgcagcaaatcacatacttagatggatttgatcaggaggataatgaagcgccggactctgaagaggaggatgatgaggatggcgatgaagatgatgaagaggaagaggaaaatgaagctggtccaccggaaggatatgaggaagaggaggaggaagaggaagaggaggatgaggatgaggatgaagatgaagatgaagcaggttcagagttgggagagggagaagaggaagtgggcctctcatacttaatgaaagaagaaattcaggatgaagaagatgatgatgactatgttgaagaaggggaagaagaggaagaagaggaagaaggaggtcttcgaggggagaagaggaaacgagatgctgaagacgatggagaggaagaagatgactagatcattctaagaccagattctctaatgtttctgggtgtgcaatagagtgatcacatctttgtttcttcatgtacgatagctatccctacagaagataatgtgtaactttttataggaaaagtgtggttttactatttttgccttatcattccaaataagaactagtctgttaatgatcatattgtatgtagagaaaaattttcattgactcccattgtggaattccctagcaatttatttagacttaattttttaaattcaagcttactgtattagtcatttttagcccataattaaaacatgatcacttttacacaggtgtagtatggtgcatttcattccttatttataaattaactgaaattacagtttgctataatataaaatgacaatagtctcttgagtggtaagttggttatttttttagtaggtgatccaggaatctttagtttgaaggcagttacctttttttttttttttttttgactaagagtgtttggttgcttttttgtcacaagtaacttggaaaatagaagcagaatagtaaaggttctattcagcaacatagttcatggattttgtggaggttctattcagtaatatggttcatggatttagtggtgactgataagattttatttttgaaggaaaaattgcttatactaagtccagagacatgcaggtgagcccttttgtcaggctgcaaatcatgacatgccgatggttgtttattttgtttttaggtgtgcattctttttcttcttagcaattcctttatgatcaccttcccttcttgtttcactccctcccgctctctcaaaaggaacttgggaaacttgtgaaacccaggaaaacctttagtcttatacctcaactacctttcagtcctgtctgggttttaaataagtgaagtagaagaaattgagtattttctgacataagaatatattatcaatacagttttatgcagtaagctctccttaccataaatgtttcttggttgacaacatctaagacaatattagtgggatgaagaaagaaaagcaggggtgcttttggaagcagtgttagtgttcctcaaaagtcggaacaattgcctgttgatatattaataagacattaaagtcaaattttaatgttggcctctcaaatgatttggataccactctgcaaagtatttctaacctttaattcccagttttaaaacagatataataatagcatttaattggaatatactaggcagctggaaaagtatttgaaactaaattgacattaaaattaagatttgttttcaagtggatgtccattaaaagtagaaaaatatttgggataagtgagtgtgtgtttccttacatggctactaaataaaatataatgagtatacaagtatatctcctcttttgctatggaggctccatgttcaaggcaatggctttttaaatcttggctatctaaaattttttccctttgttttgaatatttgtaagtttttaagaagttagtgtcagcaaattaattgaagttatgcttctatactgggacatatttaaatactgagtatagtactgctgctactgcttctacaatgtaaaatgtatgacttggtgttttaaagtaaaaattatgatgttacttgtggagaaactaaaaatgttgtacaactgaccgaaagaaaacccttggggataagtttagtgaggggattggaatccccaaaaagataacatttttcttctgcttttaaaaactgaaattccctgttctagttcctaacaattctcattacatactatgccagattacaaaatacttatttttaaaatgaaatctatatattgactttcttatcaatcatcttactgtgcaatcaaaattagagtactttggtttgaaaacaacacttagagcctccagataacttttaagacttatttagctttgtgggtggtattttcatgcaaataagtaagggtgggttttatattttgtagaagttttcggtcctattttaatgctctttgtatggcagtatgtatatattgtgttaagttcctcaagaatctccttaaaaactttgaagttaatacttttgtgcaactgtgttttgaataaagccatgacagtgttaaaaac

SEQ ID NO: 103833 - DNA, 3054 bp, Homo sapiens
  Payload ID: 410
  Gene Symbol: ANP32E
  Gene Name: acidic (leucine-rich) nuclear phosphoprotein 32 family, member E
  ENST ID: ENST00000629042
  CDS Start-End: 371-781
ggagtgtaggccagggggttggcggtgccgtgtcatggaggctcagtctctgagcagccattgaaggggaaggaactgcgggtgtgtgtgtgtatgtgtgtgtgtatgtgtgtgcgcgcgtgcgtgcgtgtgtgtgcgcgcgctagtgtgtggacaaggaggtgggggcagctgagttagagtcccaactcttggactccatttgctattctcttctttctcccccacacctatctggtggtggtagtgggcgtttatatttgcgttccttttcattcatttctaaatctcttaaaaattttgggttgggggtattggggaaggcaggaaagggaaaaggagagtagtagctgaagagcaagaggaggacatggagatgaagaagaagattaacctggagttaaggaacagatccccggaggaggaggataatgaagcgccggactctgaagaggaggatgatgaggatggcgatgaagatgatgaagaggaagaggaaaatgaagctggtccaccggaaggatatgaggaagaggaggaggaagaggaagaggaggatgaggatgaggatgaagatgaagatgaagcaggttcagagttgggagagggagaagaggaagtgggcctctcatacttaatgaaagaagaaattcaggatgaagaagatgatgatgactatgttgaagaaggggaagaagaggaagaagaggaagaaggaggtcttcgaggggagaagaggaaacgagatgctgaagacgatggagaggaagaagatgactagatcattctaagaccagattctctaatgtttctgggtgtgcaatagagtgatcacatctttgtttcttcatgtacgatagctatccctacagaagataatgtgtaactttttataggaaaagtgtggttttactatttttgccttatcattccaaataagaactagtctgttaatgatcatattgtatgtagagaaaaattttcattgactcccattgtggaattccctagcaatttatttagacttaattttttaaattcaagcttactgtattagtcatttttagcccataattaaaacatgatcacttttacacaggtgtagtatggtgcatttcattccttatttataaattaactgaaattacagtttgctataatataaaatgacaatagtctcttgagtggtaagttggttatttttttagtaggtgatccaggaatctttagtttgaaggcagttacctttttttttttttttttttgactaagagtgtttggttgcttttttgtcacaagtaacttggaaaatagaagcagaatagtaaaggttctattcagcaacatagttcatggattttgtggaggttctattcagtaatatggttcatggatttagtggtgactgataagattttatttttgaaggaaaaattgcttatactaagtccagagacatgcaggtgagcccttttgtcaggctgcaaatcatgacatgccgatggttgtttattttgtttttaggtgtgcattctttttcttcttagcaattcctttatgatcaccttcccttcttgtttcactccctcccgctctctcaaaaggaacttgggaaacttgtgaaacccaggaaaacctttagtcttatacctcaactacctttcagtcctgtctgggttttaaataagtgaagtagaagaaattgagtattttctgacataagaatatattatcaatacagttttatgcagtaagctctccttaccataaatgtttcttggttgacaacatctaagacaatattagtgggatgaagaaagaaaagcaggggtgcttttggaagcagtgttagtgttcctcaaaagtcggaacaattgcctgttgatatattaataagacattaaagtcaaattttaatgttggcctctcaaatgatttggataccactctgcaaagtatttctaacctttaattcccagttttaaaacagatataataatagcatttaattggaatatactaggcagctggaaaagtatttgaaactaaattgacattaaaattaagatttgttttcaagtggatgtccattaaaagtagaaaaatatttgggataagtgagtgtgtgtttccttacatggctactaaataaaatataatgagtatacaagtatatctcctcttttgctatggaggctccatgttcaaggcaatggctttttaaatcttggctatctaaaattttttccctttgttttgaatatttgtaagtttttaagaagttagtgtcagcaaattaattgaagttatgcttctatactgggacatatttaaatactgagtatagtactgctgctactgcttctacaatgtaaaatgtatgacttggtgttttaaagtaaaaattatgatgttacttgtggagaaactaaaaatgttgtacaactgaccgaaagaaaacccttggggataagtttagtgaggggattggaatccccaaaaagataacatttttcttctgcttttaaaaactgaaattccctgttctagttcctaacaattctcattacatactatgccagattacaaaatacttatttttaaaatgaaatctatatattgactttcttatcaatcatcttactgtgcaatcaaaattagagtactttggtttgaaaacaacacttagagcctccagataacttttaagacttatttagctttgtgggtggtattttcatgcaaataagtaagggtgggttttatattttgtagaagttttcggtcctattttaatgctctttgtatggcagtatgtatatattgtgttaagttcctcaagaatctccttaaaaactttgaagttaatacttttgtgcaactgtgttttgaataaagccatgacagtgttaaaaacaaacaaaaaaatttgcagtactcctgattattcttttattgtttttgactgttccctgtttttttctgtgactgctgtaacttaaagtttttgaaactgaattgcttcaaataaattgaagatttgttataatgatt

SEQ ID NO: 103834 - DNA, 3213 bp, Homo sapiens
  Payload ID: 411
  Gene Symbol: ACRC
  Gene Name: acidic repeat containing
  Uniprot ID: Q96QF7
  ENST ID: ENST00000373695
  CDS Start-End: 538-2613
gattggggtggtagaggcctgagtgggaaaagtttgcaacaaaacaaatttaaatccttttcattttgcagagcaaagtttcggctttaaggtggggaagatacccaaagataaatgcagaatgtaaatgtagagatgtctctgcttttgagttctggctttcttttttttttctttttattttattttctttttctttttcttttttgagatggagtctagctctgtggcccaggctggagtgcagtggcacaatctcggctcactgcaagctctgcctcccgggttcacgccattttcctgcctcagcctctcgagtagctgggactacaggcgcccgccaccacgcctggctaattttttgtatttttaatagagatagggtttcaccgtgttagccaggatggtctcgatctcatgacattgtgatctgcccgcctcggcctcccaaagtgctgggattataggcgtgagccactgcgcccggccgagttctggctttcttaagaaagtgtatctttgtctttcactacagacatggatgggtgcaaaaaagagctgccccgcttgcaagagccggaggaggacgaggattgttacatccttaatgttcagtcaagcagtgatgacaccagtgggtcttctgtggccagaagagctccgaagagacaggcgagttgcatccttaatgtccagtcaaggagtggtgacaccagtgggtcttctgtggccagaagagctccgaagagacaggcgagctccgtggtagtgattgactctgattctgatgaggaatgtcacacccatgaagagaagaaagctaagttattggaaataaacagcgacgatgagagtccggagtgttgtcatgtgaagcctgccatccaggaacctccaatagttattagtgatgatgacaatgacgatgacaacggtaatgatttggaagttcccgacgacaacagtgatgattcagaagctcccgacgacaacagtgatgattcggaagctcctgacgacaacagtgatgattcggaagctcccgacgacaacagtgatgattcggaagctcccgacgacaatagtgatgattcggatgttcccgacgacaacagtgatgattcatccgacgacaacagtgatgattcatccgacgacaacagtgatgattcggatgttcccgacgacaagagtgatgattcggatgttcccgacgacagcagtgatgattcggatgttcccgacgacagcagtgatgattcggaagctcccgacgacagcagtgatgattcggaagctcccgacgacagcagtgatgattcggaagctcccgacgacagcagtgatgattcggaagctcccgacgacagcagtgatgattcggaagcttccgacgacagcagtgatgattcggaagcttccgacgacagcagtgatgattcggaagctcccgacgacaagagtgatgattcggatgttcccgaagacaagagtgatgattcggatgttcccgatgacaatagtgatgatttggaagttcctgtgccagcagaagatttgtgtaatgaaggccaaattgcttcagatgaagaagagctggttgaggctgctgctgctgtctcccagcatgattcatctgatgatgctggtgagcaggatcttggtgagaatctcagcaaaccaccaagtgatcctgaggctaaccctgaagtttcagagagaaagctgccaactgaggaagagcctgcacctgtggtggaacaatcagggaaaaggaagtcaaaaaccaaaactattgtggagccaccgaggaaaaggcagacaaagaccaaaaatatagtggagccaccaaggaaaaggcagacaaagaccaaaaatatagtggagccactgaggaagaggaaggcgaaaaccaaaaatgtatctgtgacacctggacataagaagcgtgggccttcaaagaagaaacccggtgcagcaaaagttgaaaaacgcaagactaggactcctaaatgcaaagtccctggatgtttcttgcaagaccttgaaaagtcaaagaaatactctggaaaaaatttaaagcgaaataaggatgaattggttcagagaatctacgacctgtttaacagatccgtctgtgataaaaagctgccagagaaactacgcataggctggaataacaagatggtgaaaactgctggcttatgcagcactggtgagatgtggtacccaaagtggcggcgctttgccaagatccagattggcttgaaagtctgcgactctgcagaccgaatccgggataccttgatccatgaaatgtgccatgctgcctcctggctgattgatggtatccatgattctcatggtgacgcatggaagtattatgccaggaaatccaacaggatacacccggagctgcccagggtcacccgttgccataactataagattaactacaaggtccattatgaatgtactggatgcaaaacgaggattggctgctacaccaaatcgttggacaccagccgcttcatctgtgccaaatgcaaggggtctctggtcatggtgccattaactcagaaagatgggacccgtattgtgccccacgtgtgaccatttgctgtgtatgtgcagaagtattatagaaaaattatgcaggagatggctaggattagccttggggatgtgatgaaaacacttggcaggaattacaaggcaatgaagaattcttaaggttatcttagagtatattaatgtgagctatatcctttactggtaagaagttttagaaaagtttgttttgtgaagttaggaatattagaatttaggtactgttaagtaagtaatgttagaatttaagattcatgttattaacgatgattgaccttaaatagggactctattgctaaccattctgtgcccttgacagggtatttctgaagcccttgggatctaccttgggtcttacttgagttccatatttttcacatgtagaacaaaatgcaaaagaaaagtgagttttcaagagtggcaggttgagagaggagaatgctggaaagaggacaagtttgagaggcaacacttaaacactagggctactgtggcatctatgtagacaggaaagacaaacgtgtttcataaaattcgttgttgatggtattgattgaaactatctgagccatgtaatcaaaaaataaaagttttctgcatctt

SEQ ID NO: 103835 - DNA, 2791 bp, Homo sapiens
  Payload ID: 411
  Gene Symbol: ACRC
  Gene Name: acidic repeat containing
  Uniprot ID: Q96QF7
  ENST ID: ENST00000373696
  CDS Start-End: 115-2190
aaaggggcctgcgcctggcgttgttcatcgcagttgctccggatctttgcacacactccacgggcagttggaggtgagctgctgccggccacgccagaggctgcaacaccagacatggatgggtgcaaaaaagagctgccccgcttgcaagagccggaggaggacgaggattgttacatccttaatgttcagtcaagcagtgatgacaccagtgggtcttctgtggccagaagagctccgaagagacaggcgagttgcatccttaatgtccagtcaaggagtggtgacaccagtgggtcttctgtggccagaagagctccgaagagacaggcgagctccgtggtagtgattgactctgattctgatgaggaatgtcacacccatgaagagaagaaagctaagttattggaaataaacagcgacgatgagagtccggagtgttgtcatgtgaagcctgccatccaggaacctccaatagttattagtgatgatgacaatgacgatgacaacggtaatgatttggaagttcccgacgacaacagtgatgattcagaagctcccgacgacaacagtgatgattcggaagctcctgacgacaacagtgatgattcggaagctcccgacgacaacagtgatgattcggaagctcccgacgacaatagtgatgattcggatgttcccgacgacaacagtgatgattcatccgacgacaacagtgatgattcatccgacgacaacagtgatgattcggatgttcccgacgacaagagtgatgattcggatgttcccgacgacagcagtgatgattcggatgttcccgacgacagcagtgatgattcggaagctcccgacgacagcagtgatgattcggaagctcccgacgacagcagtgatgattcggaagctcccgacgacagcagtgatgattcggaagctcccgacgacagcagtgatgattcggaagcttccgacgacagcagtgatgattcggaagcttccgacgacagcagtgatgattcggaagctcccgacgacaagagtgatgattcggatgttcccgaagacaagagtgatgattcggatgttcccgatgacaatagtgatgatttggaagttcctgtgccagcagaagatttgtgtaatgaaggccaaattgcttcagatgaagaagagctggttgaggctgctgctgctgtctcccagcatgattcatctgatgatgctggtgagcaggatcttggtgagaatctcagcaaaccaccaagtgatcctgaggctaaccctgaagtttcagagagaaagctgccaactgaggaagagcctgcacctgtggtggaacaatcagggaaaaggaagtcaaaaaccaaaactattgtggagccaccgaggaaaaggcagacaaagaccaaaaatatagtggagccaccaaggaaaaggcagacaaagaccaaaaatatagtggagccactgaggaagaggaaggcgaaaaccaaaaatgtatctgtgacacctggacataagaagcgtgggccttcaaagaagaaacccggtgcagcaaaagttgaaaaacgcaagactaggactcctaaatgcaaagtccctggatgtttcttgcaagaccttgaaaagtcaaagaaatactctggaaaaaatttaaagcgaaataaggatgaattggttcagagaatctacgacctgtttaacagatccgtctgtgataaaaagctgccagagaaactacgcataggctggaataacaagatggtgaaaactgctggcttatgcagcactggtgagatgtggtacccaaagtggcggcgctttgccaagatccagattggcttgaaagtctgcgactctgcagaccgaatccgggataccttgatccatgaaatgtgccatgctgcctcctggctgattgatggtatccatgattctcatggtgacgcatggaagtattatgccaggaaatccaacaggatacacccggagctgcccagggtcacccgttgccataactataagattaactacaaggtccattatgaatgtactggatgcaaaacgaggattggctgctacaccaaatcgttggacaccagccgcttcatctgtgccaaatgcaaggggtctctggtcatggtgccattaactcagaaagatgggacccgtattgtgccccacgtgtgaccatttgctgtgtatgtgcagaagtattatagaaaaattatgcaggagatggctaggattagccttggggatgtgatgaaaacacttggcaggaattacaaggcaatgaagaattcttaaggttatcttagagtatattaatgtgagctatatcctttactggtaagaagttttagaaaagtttgttttgtgaagttaggaatattagaatttaggtactgttaagtaagtaatgttagaatttaagattcatgttattaacgatgattgaccttaaatagggactctattgctaaccattctgtgcccttgacagggtatttctgaagcccttgggatctaccttgggtcttacttgagttccatatttttcacatgtagaacaaaatgcaaaagaaaagtgagttttcaagagtggcaggttgagagaggagaatgctggaaagaggacaagtttgagaggcaacacttaaacactagggctactgtggcatctatgtagacaggaaagacaaacgtgtttcataaaattcgttgttgatggtattgattgaaactatctgagccatgtaatcaaaaaataaaagttttctgcatcttg

SEQ ID NO: 103836 - DNA, 2576 bp, Homo sapiens
  Payload ID: 412
  Gene Symbol: ARMT1
  Gene Name: acidic residue methyltransferase 1
  Uniprot ID: Q9H993
  ENST ID: ENST00000367294
  CDS Start-End: 260-1585
gcttccggctttcgctcgcttccatatccgctcctctagtcgccctccgctggccccgccttcgtccccggaagattgggtcttctggcgagccactgtttgccgtttgatcgggcaccaaataaagtttctttattcaaaagcactttttttttaaagccacaccacccccattctcagctcctccttcgcggcggtaccgcctctgtttctgcggcgattgaacagccgagctttgcggccgggatcgcggaaagtgatggctgtcgtcccggcgtctctctcaggacaggacgtgggatcatttgcatatcttacaattaaagacagaataccacagatcttaactaaggttattgatacattgcatcgacataaaagtgaattttttgagaaacacggagaggaaggcgtggaagctgaaaagaaagctatctctctcctttctaaattacggaatgaattgcaaacagataaaccatttatccccttggttgagaaatttgttgatactgatatatggaatcagtacctagaatatcaacagagtcttttaaatgaaagtgatggaaaatcaagatggttctactcaccgtggttgttggtagaatgttacatgtatcgaagaattcatgaagcaattatccagagtccaccaatcgattactttgatgtatttaaagaatcaaaagagcaaaatttctatgggtcacaggaatccatcattgctttatgtactcacctgcaacaattgataagaactattgaagacctagatgaaaatcagctgaaagatgagttttttaaacttctgcagatttcactgtggggaaataagtgtgatctgtctctctcaggtggagaaagtagttctcagaataccaatgtactaaattcattggaagacctaaaacctttcattttattgaatgatatggaacatctttggtcattgcttagcaattgcaagaaaacaagagaaaaagcttctgctactagagtgtatattgttctcgataattctggatttgagcttgttacagatttaatattagccgacttcttgttgtcctctgaactggctactgaggttcatttttatggaaaaacaattccatggtttgtttctgatactactatacatgattttaattggttaattgaacaggtaaaacacagtaatcataagtggatgtccaagtgtggggctgactgggaagagtatattaaaatgggtaaatgggtttaccacaatcatatattttggactctgcctcatgagtactgtgcaatgcctcaggttgcacctgacttatatgctgaactacagaaggcacatttaattttattcaagggtgatttgaattacaggaagttgacaggtgacagaaaatgggagttttctgttccatttcatcaggctctgaatggcttccatcctgcaccactctgtaccataagaacattaaaagctgaaattcaggttggtctgcagcctgggcaaggggaacagctcctggcctctgagcccagctggtggaccactggaaaatatggaatatttcagtacgatggtcccctttgacttgatttaggagctctcagttgcatagaaagatctggtgagcaccttttcatccccagaaaaggagcacgtgaattgagtcgcctggcggctctgtacgcgctcagggaagcttagcttcttggtgcccatctacgtgcactggatgatttttcttttgaacattttgccccactacactgttttggggatagctgggttaagcaagttaaagatatttacatttatattggaattttagcaactttttttcaggttaaatatataatttcaagtgcttttaatgaacttatttttaattggctagggagcaaaaaataagtgagttctgcttttagttagttaaccttgttcttttcttaaatagtacactgcatggtatttaatattccaggaagcatgggattttattttgcttgattttgggcacatgaaataatagctctaggaaaatgcgcatcttaatgactctttgtaaagagaggcatttcttacaactgtgatgtttgcttacataaaagttacctcataagttaattctaacttttattcttgaattttatttcatttcaatagcttgtttcatttgcacgcctttgtattttgattgacctgtagaatggatgttaggaaactcaaaattgaacacagtgaaacaaatggtatttgaagaaatgtaatatcttttatattctatttatgatatccataatcaaatgagattattttaccacataaatgttttaaatatcagatttttagtttgcagttttaggaaaatgctttagatagaaaaggttcttatgcattgaatttggagtactaccaacaatgaatgaatttattttttatattcttacacattttattggtcattgtcacagatagtaaatactaaaaatttcaggtcagtttgttttgaaactgaaattggaaataaatctggaaatgttttgttgcactaaaataataaaatgaattgtactgaaaa

SEQ ID NO: 103837 - DNA, 712 bp, Homo sapiens
  Payload ID: 412
  Gene Symbol: ARMT1
  Gene Name: acidic residue methyltransferase 1
  ENST ID: ENST00000494826
  CDS Start-End: 61-231
ccgcctctgtttctgcggcgattgaacagccgagctttgcggccgggatcgcggaaagtgatggctgtcgtcccggcgtctctctcaggacaggacgtggggaaggcgtggaagctgaaaagaaagctatctctctcctttctaaattacggaatgaattgcaaacagataaaccatttatccccttggttgagaaatttgttgatactgatatatggaatcagtacctagaatatcaacagagtcttttaaatgaaagtgatggaaaatcaagatggttctactcaccgtggttgttggtagaatgttacatgtatcgaagaattcatgaagcaattatccagagtccaccaatcgattactttgatgtatttaaagaatcaaaagagcaaaatttctatgggtcacaggaatccatcattgctttatgtactcacctgcaacaattgataagaactattgaagacctagatgaaaatcagctgaaagatgagttttttaaacttctgcagatttcactgtggggaaataagtgtgatctgtctctctcaggtggagaaagtagttctcagaataccaatgtactaaattcattggaagacctaaaacctttcattttattgaatgatatggaacatctttggtcattgcttagcaattgcaagaaaacaagagaaaaagcttctgctactagagtgtatattgttctcga

SEQ ID NO: 103838 - DNA, 2495 bp, Homo sapiens
  Payload ID: 412
  Gene Symbol: ARMT1
  Gene Name: acidic residue methyltransferase 1
  ENST ID: ENST00000545879
  CDS Start-End: 540-1508
aggccctgggacctcccggtcccttgcctgcttccggctttcgctcgcttccatatccgctcctctagtcgccctccgctggccccgccttcgtccccggaagattgggtcttctggcgagccactgtttgccgtttgatcgggcaccaaataaagtttctttattcaaaagcactttttttttaaagccacaccacccccattctcagctcctccttcgcggcggtaccgcctctgtttctgcggcgattgaacagccgagctttgcggccgggatcgcggaaagtgatggctgtcgtcccggcgtctctctcaggacaggacgtggggaaggcgtggaagctgaaaagaaagctatctctctcctttctaaattacggaatgaattgcaaacagataaaccatttatccccttggttgagaaatttgttgatactgatatatggaatcagtacctagaatatcaacagagtcttttaaatgaaagtgatggaaaatcaagatggttctactcaccgtggttgttggtagaatgttacatgtatcgaagaattcatgaagcaattatccagagtccaccaatcgattactttgatgtatttaaagaatcaaaagagcaaaatttctatgggtcacaggaatccatcattgctttatgtactcacctgcaacaattgataagaactattgaagacctagatgaaaatcagctgaaagatgagttttttaaacttctgcagatttcactgtggggaaataagtgtgatctgtctctctcaggtggagaaagtagttctcagaataccaatgtactaaattcattggaagacctaaaacctttcattttattgaatgatatggaacatctttggtcattgcttagcaattgcaagaaaacaagagaaaaagcttctgctactagagtgtatattgttctcgataattctggatttgagcttgttacagatttaatattagccgacttcttgttgtcctctgaactggctactgaggttcatttttatggaaaaacaattccatggtttgtttctgatactactatacatgattttaattggttaattgaacaggtaaaacacagtaatcataagtggatgtccaagtgtggggctgactgggaagagtatattaaaatgggtaaatgggtttaccacaatcatatattttggactctgcctcatgagtactgtgcaatgcctcaggttgcacctgacttatatgctgaactacagaaggcacatttaattttattcaagggtgatttgaattacaggaagttgacaggtgacagaaaatgggagttttctgttccatttcatcaggctctgaatggcttccatcctgcaccactctgtaccataagaacattaaaagctgaaattcaggttggtctgcagcctgggcaaggggaacagctcctggcctctgagcccagctggtggaccactggaaaatatggaatatttcagtacgatggtcccctttgacttgatttaggagctctcagttgcatagaaagatctggtgagcaccttttcatccccagaaaaggagcacgtgaattgagtcgcctggcggctctgtacgcgctcagggaagcttagcttcttggtgcccatctacgtgcactggatgatttttcttttgaacattttgccccactacactgttttggggatagctgggttaagcaagttaaagatatttacatttatattggaattttagcaactttttttcaggttaaatatataatttcaagtgcttttaatgaacttatttttaattggctagggagcaaaaaataagtgagttctgcttttagttagttaaccttgttcttttcttaaatagtacactgcatggtatttaatattccaggaagcatgggattttattttgcttgattttgggcacatgaaataatagctctaggaaaatgcgcatcttaatgactctttgtaaagagaggcatttcttacaactgtgatgtttgcttacataaaagttacctcataagttaattctaacttttattcttgaattttatttcatttcaatagcttgtttcatttgcacgcctttgtattttgattgacctgtagaatggatgttaggaaactcaaaattgaacacagtgaaacaaatggtatttgaagaaatgtaatatcttttatattctatttatgatatccataatcaaatgagattattttaccacataaatgttttaaatatcagatttttagtttgcagttttaggaaaatgctttagatagaaaaggttcttatgcattgaatttggagtactaccaacaatgaatgaatttattttttatattcttacacattttattggtcattgtcacagatagtaaatactaaaaatttcaggtcagtttgttttgaaactgaaattggaaataaatctggaaatgttttgttgcactaaaataataaaatgaattgtactg

SEQ ID NO: 103839 - DNA, 2391 bp, Homo sapiens
  Payload ID: 413
  Gene Symbol: ADI1
  Gene Name: acireductone dioxygenase 1
  Uniprot ID: Q9BV57
  ENST ID: ENST00000327435
  CDS Start-End: 250-789
tggcgaacggctggccccgggccgcgggcctcaggcaggtccgagggtgcccaggacagggtcggggcttgaatgcctttgcttccgaaaacagcggagccgtggggcctcccccgcgccggccctgcctccaaccagccgcccaatcccggctcccatgcgcgtccacgcctccctataagataaagcgcggccgacgggctccgagcgcggcccctgggttcgaacacggcacccgcactgcgcgtcatggtgcaggcctggtatatggacgacgccccgggcgacccgcggcaaccccaccgccccgaccccggccgcccagtgggcctggagcagctgcggcggctcggggtgctctactggaagctggatgctgacaaatatgagaatgatccagaattagaaaagatccgaagagagaggaactactcctggatggacatcataaccatatgcaaagataaactaccaaattatgaagaaaagattaagatgttctacgaggagcatttgcacttggacgatgagatccgctacatcctggatggcagtgggtacttcgatgtgagggacaaggaggaccagtggatccggatcttcatggagaagggagacatggtgacgctccccgcggggatctatcaccgcttcacggtggacgagaagaactacacgaaggccatgcggctgtttgtgggagaaccggtgtggacagcgtacaaccggcccgctgaccattttgaagcccgcgggcagtacgtgaaatttctggcacagaccgcctagcagtgctgcctgggaactaacacgtgcctcgtaaaggtccccaatgtaatgactgagcagaaaatcaatcactttctctttgcttttagaggatagccttgaggctagattatctttcctttgtaagattatttgatcagaatattttgtaatgaaaggatctagaaagcaacttggaagtgtaaagagtcaccttcattttctgtaactcaatcaagactggtgggtccatggccctgtgttagttcatgcattcagttgagtcccaaatgaaagtttcatctcccgaaatgcagttccttagatgcccatctggacgtgatgccgcgcctgccgtgtaagaaggtgcaatcctagataacacagctagccagatagaagacacttttttctccaaaatgatgccttggggtggggagtggtagggggaagagctcccaccctaaggggcacacactgagttgcttatgccacttccttgttcaaaataaagtaactgccttaatcttatactcatggcttggagttaccttatattcaggtatatgtgatattttgcctggtttgttaaaattgccccatttagattccttctataattgttcttatagataagtaatttatatatgagctgtgttagtattttttcagtgtgagatctctggattctttcacaataaagctgttgaattttaacaggagtattagtacataaattttctactcaacaattccgagataggattatgcctagtttgtcatatcacagaaaaactccaagttaacttcatgttttggaagggcaggtcgtttttaaagtatttctttttttaactggatgaaaaatcttcatgttaggattaattttcttaatcacctccacactgtacagaggaaactcaagccttaaatgtttaagtaaactctgtctcagttttaggattaaaatacccaccggtggtgtgatgatgccatataccgcagggcttgcttctgtcaagtgtgactctatctcagtaattaaaataagtgctgatctactgattttttttaatggattcatttctaaatgggcattataaatagagcttgttcatttttaagaacgaaacattcatatgataaactatcgctttaaattgcctttcttgcttcatataacttttccctgtcaggatccttagtgtttgaaactcctcgtgcggggctggcctcctgcggactctagtttcgcctccttgatgtggcgcctgggatttcttcacttcagagctgtatttttacaggcaagagtaagttcctgggcacagtggctcatgcctgtaatctcagctactcaggaggctaaggtgggaggattcttagagcctgggaggtcgaggctgcagtgagctgtgattgtggccactgcactccagcctgggtgacagagcgagactctgtctcaaaaaagaagaaagagtaagagctgaggcatataatagaattctgctaaagcacttaaggtgaaatcacattttcttttcccaggatgttgctcacatctttcgtttttattgaggtgtcatttatatacaataaaatgtactcattttcagtgtt

SEQ ID NO: 103840 - DNA, 3870 bp, Homo sapiens
  Payload ID: 413
  Gene Symbol: ADI1
  Gene Name: acireductone dioxygenase 1
  Uniprot ID: Q9BV57
  ENST ID: ENST00000382093
  CDS Start-End: 2839-3360
tttgcccaggctggagtgcagtggcatgatctcggctcaccgcaacctcatcttcccgagttcaagccattctcatgtgtcagcctcccgagtagctgggattacaaggtgcacagcaccatgccgggctaattttgtatttttagtagagacagggtttctccatgttggtcaggctgatcttgaactgctgacctcaggtgatccacccacttcggcctcccaaagtgctggcattatagacacgaaccaccgcacccggcctatatgctttcttaatatccattctggatcagtgctgttggaagacaaaattacaacaaatttagttaaagatctaattagcttttattcttgatttgtgaatagggcaacctccgttctacaaaatagaataagagctcgatagggtaatagcacaacagtgggttttgtagggcggcaacaaagaaacagaacaataggtagaaaagctgattggttaacgtcaagttacattaggttacttttttcctaagggttaaagcagaagcgacttccttattattctgactcaggaagactggaatcttctgatcgcaggaaaagctggtctgtttgagatgcacctccttctttaaagttttagtttgatcaagtggcatatggcatgagtggctgcattttggtttggtctcatcctggggcctagtgcaggggctcagtccaaaacagtgacctctcctgggccaggcatggtggcttctgtcatcccagcactttgggaggctgaggcggcagattgcctgaagccagaagtttgagacctcatctctaaaaaaacccaaaaaacaaaaaagccacacacacaccccatattaacattatatatatgtaacatctcccataatttttaacagaggtaacacatgtggacatgtttgtgtatctgtttaatcaatctgttattagtgacatagagttctaaaaaaccttttgtcatacatacaaacaattggaagattattttagcttggaataaactaaatacctgctgctataacaaaatgacaaaaatagcttaaactgggcaatttataaacaacagcaatttatagaattcttatagttctagaggctaagaagtccaagattaaggtgccagcagatttagtgtctgatgaggatcctgtcctcatagacggccatttccttgctctgtcctcatgtggtggaaggggcaaactgctctcttacatctctcttgctcttttttttttttttttttttttttgagatggagcctcgctctgtcacccaggctggtagcgcagtcttggctcactgcaacctctgcctcctggattcaagtgattctcctgcctcagcctcccgagtagctgggatcacaggcgtggaccaccatgcctggctaatttttgtatttttagtagagatggggtttcaccatgttggacaggctggtcttgaacccctgacctcaggtgatctgcccaccttggcctcccaaagttctgggattataggtgtgagccacagtgcccagctccatctctcttacaaggccactaatcctataaatgagggcttgccctcatgacttaatcacatcctaaaggtcccaccccttaatactatcacatttgtgttaagtttcaacattcgtatatttaaacttatgacacgtgtcatataatgtgtcatattacatattatgtgtcataatatggacacattcagaccatagcaaatagtactgtgcatatcatgcagtggataggctaagttttagagtcaactttgtagaaaataacgtattgatgactagtactttaatatgttctggagtatcgggggaacccacccccaatatttcaacataggttccattttccataagtgtcggccagctgagaaataaagagagacagtataaagagaggaattttacagctgggccgccaggggtgacatcacatatcggtaggaccgtgatgcccgcctgagtctcagaccagcaagtttttattaagggtttcaaaaggggagggggtgtaagaacagggagtaggtacaaatatcacaggcttcaaagggcaaaaagcagaactactaataagggtctaacaaagatcacatgcttctgagggaacaggacaaagggcaaaagcagaaccactgataagggtccaacaaagatcacagggcaaagggcaaaagcagaaccactgataaagatctatgttcagtgctgcacatattgtcttgataaacatcttaaataacagaaaacagggttcgagagcagagaactggtctgaccacaaatttaccagggtggagtttttccccaccttagtaagcctgagggtactgcagaagaccagggcgtatctcagtccttatctcaaccgcataagacagacattcccagagcagctgtttatagacctccccccagaaatgcattccttccccagagtattaatattaatattccttcctaggaaaagaatttagtgataccttctctacttgcacgcccatttataggctctctgcaagaagaaaaatatgggtgtttttgcctgaccctgcaggcagtcaaaccttatggttgtcttcccttgttccctaaaaatcgctgttattttattttttaaggtgtactgatttcatattgttcaaacacacatgttttacaatcaatttgtacagttaacacaattatcacagtggtcctgaggtgacatacatcctcagcttacgaagataacaggattaagagattaaagacaggcataataaattataaaagtattatttgagaactgatagatgtccgtgaaatcttcaaaacttatgttcctctgccatggctccagccggtccctccattcggggtccctgacttcctgcaacactggagtttgttgttcactggatgctgacaaatatgagaatgatccagaattagaaaagatccgaagagagaggaactactcctggatggacatcataaccatatgcaaagataaactaccaaattatgaagaaaagattaagatgttctacgaggagcatttgcacttggacgatgagatccgctacatcctggatggcagtgggtacttcgatgtgagggacaaggaggaccagtggatccggatcttcatggagaagggagacatggtgacgctccccgcggggatctatcaccgcttcacggtggacgagaagaactacacgaaggccatgcggctgtttgtgggagaaccggtgtggacagcgtacaaccggcccgctgaccattttgaagcccgcgggcagtacgtgaaatttctggcacagaccgcctagcagtgctgcctgggaactaacacgtgcctcgtaaaggtccccaatgtaatgactgagcagaaaatcaatcactttctctttgcttttagaggatagccttgaggctagattatctttcctttgtaagattatttgatcagaatattttgtaatgaaaggatctagaaagcaacttggaagtgtaaagagtcaccttcattttctgtaactcaatcaagactggtgggtccatggccctgtgttagttcatgcattcagttgagtcccaaatgaaagtttcatctcccgaaatgcagttccttagatgcccatctggacgtgatgccgcgcctgccgtgtaagaaggtgcaatcctagataacacagctagccagatagaagacacttttttctccaaaatgatgccttggggtggggagtggtagggggaagagctcccaccctaaggggcacacactgagttgcttatgccacttccttgttcaaaataaagtaactgccttaatctta

SEQ ID NO: 103841 - DNA, 654 bp, Homo sapiens
  Payload ID: 413
  Gene Symbol: ADI1
  Gene Name: acireductone dioxygenase 1
  ENST ID: ENST00000415131
  CDS Start-End: 1-352
aaggtgggagtgctgtgctttctccccaggcccggcctgtgtggtggccctggccgtggcatctctgccgctgaactgcgcggcttccgcagactccaagcgcggtcgctgggctcgggactcctcgacctgtgcttcaaggagagtctgtggagccgcaggcgatgtccgaggtgacagctgtccttccgtggcagcctccgtggcccctgcctgcgatcctggtggacagaactacacgaaggccatgcggctgtttgtgggagaaccggtgtggacagcgtacaaccggcccgctgaccattttgaagcccgcgggcagtacgtgaaatttctggcacagaccgcctagcagtgctgcctgggaactaacacgtgcctcgtaaaggtccccaatgtaatgactgagcagaaaatcaatcactttctctttgcttttagaggatagccttgaggctagattatctttcctttgtaagattatttgatcagaatattttgtaatgaaaggatctagaaagcaacttggaagtgtaaagagtcaccttcattttctgtaactcaatcaagactggtgggtccatggccctgtgttagttcatgcattcagttgagtcccaaatgaaagtttcatctcccgaaatgcagttcctt

SEQ ID NO: 103842 - DNA, 1902 bp, Homo sapiens
  Payload ID: 413
  Gene Symbol: ADI1
  Gene Name: acireductone dioxygenase 1
  ENST ID: ENST00000627048
  CDS Start-End: 1-300
attaagatgttctacgaggagcatttgcacttggacgatgagatccgctacatcctggatggcagtgggtacttcgatgtgagggacaaggaggaccagtggatccggatcttcatggagaagggagacatggtgacgctccccgcggggatctatcaccgcttcacggtggacgagaagaactacacgaaggccatgcggctgtttgtgggagaaccggtgtggacagcgtacaaccggcccgctgaccattttgaagcccgcgggcagtacgtgaaatttctggcacagaccgcctagcagtgctgcctgggaactaacacgtgcctcgtaaaggtccccaatgtaatgactgagcagaaaatcaatcactttctctttgcttttagaggatagccttgaggctagattatctttcctttgtaagattatttgatcagaatattttgtaatgaaaggatctagaaagcaacttggaagtgtaaagagtcaccttcattttctgtaactcaatcaagactggtgggtccatggccctgtgttagttcatgcattcagttgagtcccaaatgaaagtttcatctcccgaaatgcagttccttagatgcccatctggacgtgatgccgcgcctgccgtgtaagaaggtgcaatcctagataacacagctagccagatagaagacacttttttctccaaaatgatgccttggggtggggagtggtagggggaagagctcccaccctaaggggcacacactgagttgcttatgccacttccttgttcaaaataaagtaactgccttaatcttatactcatggcttggagttaccttatattcaggtatatgtgatattttgcctggtttgttaaaattgccccatttagattccttctataattgttcttatagataagtaatttatatatgagctgtgttagtattttttcagtgtgagatctctggattctttcacaataaagctgttgaattttaacaggagtattagtacataaattttctactcaacaattccgagataggattatgcctagtttgtcatatcacagaaaaactccaagttaacttcatgttttggaagggcaggtcgtttttaaagtatttctttttttaactggatgaaaaatcttcatgttaggattaattttcttaatcacctccacactgtacagaggaaactcaagccttaaatgtttaagtaaactctgtctcagttttaggattaaaatacccaccggtggtgtgatgatgccatataccgcagggcttgcttctgtcaagtgtgactctatctcagtaattaaaataagtgctgatctactgattttttttaatggattcatttctaaatgggcattataaatagagcttgttcatttttaagaacgaaacattcatatgataaactatcgctttaaattgcctttcttgcttcatataacttttccctgtcaggatccttagtgtttgaaactcctcgtgcggggctggcctcctgcggactctagtttcgcctccttgatgtggcgcctgggatttcttcacttcagagctgtatttttacaggcaagagtaagttcctgggcacagtggctcatgcctgtaatctcagctactcaggaggctaaggtgggaggattcttagagcctgggaggtcgaggctgcagtgagctgtgattgtggccactgcactccagcctgggtgacagagcgagactctgtctcaaaaaagaagaaagagtaagagctgaggcatataatagaattctgctaaagcacttaaggtgaaatcacattttcttttcccaggatgttgctcacatctttcgtttttattgaggtgtcatttatatacaataaaatgtactcattttcagtgtt

SEQ ID NO: 103843 - DNA, 7466 bp, Homo sapiens
  Payload ID: 414
  Gene Symbol: ACO1
  Gene Name: aconitase 1, soluble
  Uniprot ID: P21399
  ENST ID: ENST00000309951
  CDS Start-End: 139-2808
ggggcgagagggggcggagcgtggaggcggcagctggaaccgcgcagcgcacgggaacgcgtcccgctgcttgggtcaggttcgccggtcgcgggagccccgccgtgcagtcggaggaacacgtggccatcagtaatcatgagcaacccattcgcacaccttgctgagccattggatcctgtacaaccaggaaagaaattcttcaatttgaataaattggaggattcaagatatgggcgcttaccattttcgatcagagttcttctggaagcagccattcggaattgtgatgagtttttggtgaagaaacaggatattgaaaatattctacattggaatgtcacgcagcacaagaacatagaagtgccatttaagcctgctcgtgtcatcctgcaggactttacgggtgtgcccgctgtggttgactttgctgcaatgcgtgatgctgtgaaaaagttaggaggagatccagagaaaataaaccctgtctgccctgctgatcttgtaatagatcattccatccaggttgatttcaacagaagggcagacagtttacagaagaatcaagacctggaatttgaaagaaatagagagcgatttgaatttttaaagtggggttcccaggcttttcacaacatgcggattattccccctggctcaggaatcatccaccaggtgaatttggaatatttggcaagagtggtatttgatcaggatggatattattacccagacagcctcgtgggcacagactcgcacactaccatgattgatggcttgggcattcttggttggggtgtcggtggtattgaagcagaagctgtcatgctgggtcagccaatcagtatggtgcttcctcaggtgattggctacaggctgatggggaagccccaccctctggtaacatccactgacatcgtgctcaccattaccaagcacctccgccaggttggggtagtgggcaaatttgtcgagttcttcgggcctggagtagcccagttgtccattgctgaccgagctacgattgctaacatgtgtccagagtacggagcaactgctgcctttttcccagttgatgaagttagtatcacgtacctggtgcaaacaggtcgtgatgaagaaaaattaaagtatattaaaaaatatcttcaggctgtaggaatgtttcgagatttcaatgacccttctcaagacccagacttcacccaggttgtggaattagatttgaaaacagtagtgccttgctgtagtggacccaaaaggcctcaggacaaagttgctgtgtccgacatgaaaaaggactttgagagctgccttggagccaagcaaggatttaaaggattccaagttgctcctgaacatcataatgaccataagacctttatctatgataacactgaattcacccttgctcatggttctgtggtcattgctgccattactagctgcacaaacaccagtaatccgtctgtgatgttaggggcaggattgttagcaaagaaagctgtggatgctggcctgaacgtgatgccttacatcaaaactagcctgtctcctgggagtggcgtggtcacctactacctacaagaaagcggagtcatgccttatctgtctcagcttgggtttgacgtggtgggctatggctgcatgacctgcattggcaacagtgggcctttacctgaacctgtggtagaagccatcacacagggagaccttgtagctgttggagtactatctggaaacaggaattttgaaggtcgagttcaccccaacacccgggccaactatttagcctctccccccttagtaatagcatatgcaattgctggaaccatcagaatcgactttgagaaagagccattgggagtaaatgcaaagggacagcaggtatttctgaaagatatctggccgactagagacgagatccaggcagtggagcgtcagtatgtcatcccggggatgtttaaggaagtctatcagaaaatagagactgtgaatgaaagctggaatgccttagcaaccccatcagataagctgtttttctggaattccaaatctacgtatatcaaatcaccaccattctttgaaaacctgactttggatcttcagccccctaaatctatagtggatgcctatgtgctgctaaatttgggagattcggtaacaactgaccacatctccccagctggaaatattgcaagaaacagtcctgctgctcgctacttaactaacagaggcctaactccacgagaattcaactcctatggctcccgccgaggtaatgacgccgtcatggcacggggaacatttgccaacattcgcttgttaaacagatttttgaacaagcaggcaccacagactatccatctgccttctggggaaatccttgatgtgtttgatgctgctgagcggtaccagcaggcaggccttcccctgatcgttctggctggcaaagagtacggtgcaggcagctcccgagactgggcagctaagggccctttcctgctgggaatcaaagccgtcctggccgagagctacgagcgcattcaccgcagtaacctggttgggatgggtgtgatcccacttgaatatctccctggtgagaatgcagatgccctggggctcacagggcaagaacgatacactatcattattccagaaaacctcaaaccacaaatgaaagtccaggtcaagctggatactggcaagaccttccaggctgtcatgaggtttgacactgatgtggagctcacttatttcctcaacgggggcatcctcaactacatgatccgcaagatggccaagtaggagacgtgcacttggtgctgcgcccagggaggaagccgcaccaccagccagcgcaggccctggtggagaggcctccctggctgcctctgggaggggtgctgccttgtagatggagcaagtgagcactgagggtctggtgccaatcctgtaggcacaaaaccagaagtttctacattctctatttttgttaatcatcttctctttttccagaatttggaagctagaatggtgggaatgtcagtagtgccagaaagagagaaccaagcttgtctttaaagttactgatcacaggacgttgctttttcactgtttcctattaatcttcagctgaacacaagcaaaccttctcaggaggtgtctcctaccctcttattgttcctcttacgctctgctcaatgaaaccttcctcttgagggtcattttcctttctgtattaattataccagtgttaagtgacatagataagaactttgcacacttcaaatcagagcagtgattctctcttctctccccttttccttcagagtgaatcatccagactcctcatggataggtcgggtgttaaagttgttttgattatgtaccttttgatagatccacataaaaagaaatgtgaagttttcttttactatcttttcatttatcaagcagagacctttgttgggaggcggtttgggagaacacatttctaatttgaatgaaatgaaatctattttcagtgaaaacttgttgactttgagttttgctgtgtttgtggctagagttttgggatatttagtacagagtgaatctcacaccatatcattgggaagcctgaataaccttcatattctcccatttttacaactctatcagaactgtacgggtataacggaaatgtttaggaaccattatgctcgctcttccctgtttgggagcagacaagaaggaagagtagcctggtggcagtggcaacgatataagtacataaggaaaagcagataaacttcaggacactaaaaaccaattatctgctcatttttacccctgtagtcatttctgggcatgccttagtttgcttgggttgctataatgtaatgccatagactggctgaaagaacagaaatgtattttctcacagttatggaggctggaattctgagatcaaagttgaagccacttcattttctggtgaggacactcttcctggtttacagatggccaccttcttgcttgttctcacatggcatttctttggtatgtgcctggtgggggagagagaaaataggctctcatgtctcttcttacagcaacactaattgtattggatcagggtcccactcttatggagacccaggaaagctggtggtataacaacttggttcaagtccaaatgcctaagaacctggggaggggcatggggaatgctggtataagtcccagagtctgaatgcccaggaacaagcaggagctgtgatgtccaaggacaggagggcaggatctttgtaatgaatttttaatgtcaaccttagcactcaggggatatggcctggtcatcagaacatctggaatctaatcctctttctacttctcaccagatgagggatcaagacaggttatttagcatccctgcacttgcggtcctggggatcttatttatattcatttaaaaaataaattacaaacaaacagccaggcgcagtggctcatgcctataattccatcactttgggaggccgaggtgggtagatcacctgaggtcaggagttctagaccagcctggccaacatggtgaaaccccgtctctactaaaaatacaaaaaattagccaggtgtggtattgtgtgcctgtaatcccagctacacaggaggctgaggcaggagaattgcttaaacccgggatgcagaggctgcagtgagccgagatcgtgccattgcacgcccgcctgggctacaagagcaaagctccgtctcaaaaaaaaaaaaaaattacaaacaaacagaactccattgtacaaaaaaacctgtgatcctcaagttaagatcagtcctagaataaaaacactaagaatggctgagaaaacagacctccaccctctcagctctccattactgagcagctggggagctgtctcgctccccgcattcagtggctcctgtggtctgtatttttgtatcctccccaaaattcaggtggtgaaaccttaaccccccaggtaatggtaatagaagctggggcctttggaaggtgattagatcatgagggtagtgccttttaaaagagactcaagataagatagagaccccctcatttcttctgccatgggagaacacagcaagaagtcaccatccgtgaaccagaaagtgggttctcaccagatactgaatctgccagtgccttgaacctagactttccagccagaactgtgagaaatttctattgtttataagccacccagttgatatttagttacagcagcccaaccaagactgtggttatgaggaaacaaacacattattgtggctagactaatggaattgggtcccttacctccaagtacaccctctgtccttttcggtaaaaatatcttcgccaggcacggtgtctcatgcctatgatcccaacactttgggaggccgaggctggagggttgcttgagcccagaagtttgagaccagcctgggcaacactctacaaaaaaaaaaataaataaataaataaataaaataaatcagccaggtgtgcacctgtggtcccagctgttcaggaggctgaggtgggaggatcacttgagcctgggaggtcgtggctatgattgctccactgcactccagcctgggcaatagagtgagaccctatcaatcaatcaccaccccccccccccccaaaaaaaaaagtatcttggccagtgtctcaaccttgcccactaacaagcctaaataaaccaacttcttttacctggttctttaagggctgctcgtcttactatccaaattaaaaatctgctgttctccctcccatattctttgcgaatgaagattcccctgtttgtttggatagttttccaaattcattactgcattcctggcatccgcagcaagctaagagttagttaatatttttaatatagcaaataaggatgagggatgcccttcatgtgtatttacacaccagatttttatggtacatagggagtaatctagggaaaagatatattaggcatgaatcttagctgtggtagaagcacagctcaaattagcttaaggaaaaaaaaaaaaaagctggctcatagaacttgaggacagtggtggccatgactatgggcttgattggatctagtgactcaagctcccttccatttgcccctccaaccacccccccatccctccaccaatcataccttctgttggcctctgcagtagagtggcctcttctgggcccttccacatgccaggggatatggccaccagcagttctggggaaaccattagtaatttgtgatcgtagagatttgtctcccagtattccctagggcaaaaatattgggagttcctagtcacctaaatgaagaaccttatttttagcagtttccctttcagggctctaacaggactgtggagtaatgtacggggttatgtaggagcaatgcagagccacttttgaaaaacagtagccaaggttctactggctgccttcttaggacattattaaatatcataaacacaagtggaatttaacacccagccagtttgtgttcaaccagacagcgtcattatgaacaaagattatataacgatagctgatattaagtaagttttaaaagttgacatcccaagagtgaagcctacttattcagtacagatttgttgaatgaaattcgtagttttattttacggcataatgaaacagagttccagacatgtacctgccaaatttggttctggttgtcttatcgtatgcaggctggatacctgctactgtgcttctacaggatgttaacagtgtcccctgagtaaaacagttccacggtcagtacatttgggaaccactgagttaaatgggttttatcactgcagaacagacacaagaacaatgtgtgctgtaaatcactgtttgcagggaaggtggcagcaaatggcacagaaacccacctgaccacagactgctttcttctgggcgttcacgcactgtgctccacaggatactcttgagaaacattgagctatggttggtctgttgtttgaaattcaaataataatgaatccattttaaggacaggaattggtttactgaccttgatgttgggatgactcttcatttcagggtgaaaatatcacagcatcagcacaggccaggaccacagagataacaaggtggtagttgtgtaacaggttgtgtctgaaccacaggagcttcaaaacatacacggctggacaccctgccaggatgctctaatggggctgggcatgtgtccatgaaaaagactccccagttgtttctaaaatgtggcctttgttctagaaatgcaatgaccagcatttgggagtcagtcaaaagatccacttcctaaaagcctacctgctcatttctttcattcaatacatattaaccaagtgcctactttgtttgagtccatgcctggcaatgacattattccattaaaagtcaaacaaggaaa

SEQ ID NO: 103844 - DNA, 3601 bp, Homo sapiens
  Payload ID: 414
  Gene Symbol: ACO1
  Gene Name: aconitase 1, soluble
  Uniprot ID: P21399
  ENST ID: ENST00000379923
  CDS Start-End: 207-2876
ggggcgagagggggcggagcgtggaggcggcagctggaaccgcgcagcgcacgggaacgcgtcccgctgcttgggtcaggttcgccggtcgcgggagccccgccgtgcagtcggagagggtgtcactctgagtggtgcttcctcagcccctgtcaaaaagcagtttccaccatcctggagtgtggaacacgtggccatcagtaatcatgagcaacccattcgcacaccttgctgagccattggatcctgtacaaccaggaaagaaattcttcaatttgaataaattggaggattcaagatatgggcgcttaccattttcgatcagagttcttctggaagcagccattcggaattgtgatgagtttttggtgaagaaacaggatattgaaaatattctacattggaatgtcacgcagcacaagaacatagaagtgccatttaagcctgctcgtgtcatcctgcaggactttacgggtgtgcccgctgtggttgactttgctgcaatgcgtgatgctgtgaaaaagttaggaggagatccagagaaaataaaccctgtctgccctgctgatcttgtaatagatcattccatccaggttgatttcaacagaagggcagacagtttacagaagaatcaagacctggaatttgaaagaaatagagagcgatttgaatttttaaagtggggttcccaggcttttcacaacatgcggattattccccctggctcaggaatcatccaccaggtgaatttggaatatttggcaagagtggtatttgatcaggatggatattattacccagacagcctcgtgggcacagactcgcacactaccatgattgatggcttgggcattcttggttggggtgtcggtggtattgaagcagaagctgtcatgctgggtcagccaatcagtatggtgcttcctcaggtgattggctacaggctgatggggaagccccaccctctggtaacatccactgacatcgtgctcaccattaccaagcacctccgccaggttggggtagtgggcaaatttgtcgagttcttcgggcctggagtagcccagttgtccattgctgaccgagctacgattgctaacatgtgtccagagtacggagcaactgctgcctttttcccagttgatgaagttagtatcacgtacctggtgcaaacaggtcgtgatgaagaaaaattaaagtatattaaaaaatatcttcaggctgtaggaatgtttcgagatttcaatgacccttctcaagacccagacttcacccaggttgtggaattagatttgaaaacagtagtgccttgctgtagtggacccaaaaggcctcaggacaaagttgctgtgtccgacatgaaaaaggactttgagagctgccttggagccaagcaaggatttaaaggattccaagttgctcctgaacatcataatgaccataagacctttatctatgataacactgaattcacccttgctcatggttctgtggtcattgctgccattactagctgcacaaacaccagtaatccgtctgtgatgttaggggcaggattgttagcaaagaaagctgtggatgctggcctgaacgtgatgccttacatcaaaactagcctgtctcctgggagtggcgtggtcacctactacctacaagaaagcggagtcatgccttatctgtctcagcttgggtttgacgtggtgggctatggctgcatgacctgcattggcaacagtgggcctttacctgaacctgtggtagaagccatcacacagggagaccttgtagctgttggagtactatctggaaacaggaattttgaaggtcgagttcaccccaacacccgggccaactatttagcctctccccccttagtaatagcatatgcaattgctggaaccatcagaatcgactttgagaaagagccattgggagtaaatgcaaagggacagcaggtatttctgaaagatatctggccgactagagacgagatccaggcagtggagcgtcagtatgtcatcccggggatgtttaaggaagtctatcagaaaatagagactgtgaatgaaagctggaatgccttagcaaccccatcagataagctgtttttctggaattccaaatctacgtatatcaaatcaccaccattctttgaaaacctgactttggatcttcagccccctaaatctatagtggatgcctatgtgctgctaaatttgggagattcggtaacaactgaccacatctccccagctggaaatattgcaagaaacagtcctgctgctcgctacttaactaacagaggcctaactccacgagaattcaactcctatggctcccgccgaggtaatgacgccgtcatggcacggggaacatttgccaacattcgcttgttaaacagatttttgaacaagcaggcaccacagactatccatctgccttctggggaaatccttgatgtgtttgatgctgctgagcggtaccagcaggcaggccttcccctgatcgttctggctggcaaagagtacggtgcaggcagctcccgagactgggcagctaagggccctttcctgctgggaatcaaagccgtcctggccgagagctacgagcgcattcaccgcagtaacctggttgggatgggtgtgatcccacttgaatatctccctggtgagaatgcagatgccctggggctcacagggcaagaacgatacactatcattattccagaaaacctcaaaccacaaatgaaagtccaggtcaagctggatactggcaagaccttccaggctgtcatgaggtttgacactgatgtggagctcacttatttcctcaacgggggcatcctcaactacatgatccgcaagatggccaagtaggagacgtgcacttggtgctgcgcccagggaggaagccgcaccaccagccagcgcaggccctggtggagaggcctccctggctgcctctgggaggggtgctgccttgtagatggagcaagtgagcactgagggtctggtgccaatcctgtaggcacaaaaccagaagtttctacattctctatttttgttaatcatcttctctttttccagaatttggaagctagaatggtgggaatgtcagtagtgccagaaagagagaaccaagcttgtctttaaagttactgatcacaggacgttgctttttcactgtttcctattaatcttcagctgaacacaagcaaaccttctcaggaggtgtctcctaccctcttattgttcctcttacgctctgctcaatgaaaccttcctcttgagggtcattttcctttctgtattaattataccagtgttaagtgacatagataagaactttgcacacttcaaatcagagcagtgattctctcttctctccccttttccttcagagtgaatcatccagactcctcatggataggtcgggtgttaaagttgttttgattatgtaccttttgatagatccacataaaaagaaatgtgaagttttcttttactatcttttcatttatcaagcagagacctttgttgggaggcggtttgggagaacacatttctaatttgaatgaaatgaaatctattttcagtgaaaa

SEQ ID NO: 103845 - DNA, 3618 bp, Homo sapiens
  Payload ID: 414
  Gene Symbol: ACO1
  Gene Name: aconitase 1, soluble
  Uniprot ID: P21399
  ENST ID: ENST00000541043
  CDS Start-End: 228-2897
atcgcgcggcggccccgggggcgagagggggcggagcgtggaggcggcagctggaaccgcgcagcgcacgggaacgcgtcccgctgcttgggtcaggttcgccggtcgcgggagccccgccgtgcagtcggagagggtgtcactctgagtggtgcttcctcagcccctgtcaaaaagcagtttccaccatcctggagtgtggtaggaacacgtggccatcagtaatcatgagcaacccattcgcacaccttgctgagccattggatcctgtacaaccaggaaagaaattcttcaatttgaataaattggaggattcaagatatgggcgcttaccattttcgatcagagttcttctggaagcagccattcggaattgtgatgagtttttggtgaagaaacaggatattgaaaatattctacattggaatgtcacgcagcacaagaacatagaagtgccatttaagcctgctcgtgtcatcctgcaggactttacgggtgtgcccgctgtggttgactttgctgcaatgcgtgatgctgtgaaaaagttaggaggagatccagagaaaataaaccctgtctgccctgctgatcttgtaatagatcattccatccaggttgatttcaacagaagggcagacagtttacagaagaatcaagacctggaatttgaaagaaatagagagcgatttgaatttttaaagtggggttcccaggcttttcacaacatgcggattattccccctggctcaggaatcatccaccaggtgaatttggaatatttggcaagagtggtatttgatcaggatggatattattacccagacagcctcgtgggcacagactcgcacactaccatgattgatggcttgggcattcttggttggggtgtcggtggtattgaagcagaagctgtcatgctgggtcagccaatcagtatggtgcttcctcaggtgattggctacaggctgatggggaagccccaccctctggtaacatccactgacatcgtgctcaccattaccaagcacctccgccaggttggggtagtgggcaaatttgtcgagttcttcgggcctggagtagcccagttgtccattgctgaccgagctacgattgctaacatgtgtccagagtacggagcaactgctgcctttttcccagttgatgaagttagtatcacgtacctggtgcaaacaggtcgtgatgaagaaaaattaaagtatattaaaaaatatcttcaggctgtaggaatgtttcgagatttcaatgacccttctcaagacccagacttcacccaggttgtggaattagatttgaaaacagtagtgccttgctgtagtggacccaaaaggcctcaggacaaagttgctgtgtccgacatgaaaaaggactttgagagctgccttggagccaagcaaggatttaaaggattccaagttgctcctgaacatcataatgaccataagacctttatctatgataacactgaattcacccttgctcatggttctgtggtcattgctgccattactagctgcacaaacaccagtaatccgtctgtgatgttaggggcaggattgttagcaaagaaagctgtggatgctggcctgaacgtgatgccttacatcaaaactagcctgtctcctgggagtggcgtggtcacctactacctacaagaaagcggagtcatgccttatctgtctcagcttgggtttgacgtggtgggctatggctgcatgacctgcattggcaacagtgggcctttacctgaacctgtggtagaagccatcacacagggagaccttgtagctgttggagtactatctggaaacaggaattttgaaggtcgagttcaccccaacacccgggccaactatttagcctctccccccttagtaatagcatatgcaattgctggaaccatcagaatcgactttgagaaagagccattgggagtaaatgcaaagggacagcaggtatttctgaaagatatctggccgactagagacgagatccaggcagtggagcgtcagtatgtcatcccggggatgtttaaggaagtctatcagaaaatagagactgtgaatgaaagctggaatgccttagcaaccccatcagataagctgtttttctggaattccaaatctacgtatatcaaatcaccaccattctttgaaaacctgactttggatcttcagccccctaaatctatagtggatgcctatgtgctgctaaatttgggagattcggtaacaactgaccacatctccccagctggaaatattgcaagaaacagtcctgctgctcgctacttaactaacagaggcctaactccacgagaattcaactcctatggctcccgccgaggtaatgacgccgtcatggcacggggaacatttgccaacattcgcttgttaaacagatttttgaacaagcaggcaccacagactatccatctgccttctggggaaatccttgatgtgtttgatgctgctgagcggtaccagcaggcaggccttcccctgatcgttctggctggcaaagagtacggtgcaggcagctcccgagactgggcagctaagggccctttcctgctgggaatcaaagccgtcctggccgagagctacgagcgcattcaccgcagtaacctggttgggatgggtgtgatcccacttgaatatctccctggtgagaatgcagatgccctggggctcacagggcaagaacgatacactatcattattccagaaaacctcaaaccacaaatgaaagtccaggtcaagctggatactggcaagaccttccaggctgtcatgaggtttgacactgatgtggagctcacttatttcctcaacgggggcatcctcaactacatgatccgcaagatggccaagtaggagacgtgcacttggtgctgcgcccagggaggaagccgcaccaccagccagcgcaggccctggtggagaggcctccctggctgcctctgggaggggtgctgccttgtagatggagcaagtgagcactgagggtctggtgccaatcctgtaggcacaaaaccagaagtttctacattctctatttttgttaatcatcttctctttttccagaatttggaagctagaatggtgggaatgtcagtagtgccagaaagagagaaccaagcttgtctttaaagttactgatcacaggacgttgctttttcactgtttcctattaatcttcagctgaacacaagcaaaccttctcaggaggtgtctcctaccctcttattgttcctcttacgctctgctcaatgaaaccttcctcttgagggtcattttcctttctgtattaattataccagtgttaagtgacatagataagaactttgcacacttcaaatcagagcagtgattctctcttctctccccttttccttcagagtgaatcatccagactcctcatggataggtcgggtgttaaagttgttttgattatgtaccttttgatagatccacataaaaagaaatgtgaagttttcttttactatcttttcatttatcaagcagagacctttgttgggaggcggtttgggagaacacatttctaatttgaatgaaatgaaatctattttcagtg

SEQ ID NO: 103846 - DNA, 2741 bp, Homo sapiens
  Payload ID: 415
  Gene Symbol: ACO2
  Gene Name: aconitase 2, mitochondrial
  Uniprot ID: Q99798
  ENST ID: ENST00000216254
  CDS Start-End: 23-2365
ctcatctttgtcagtgcacaaaatggcgccctacagcctactggtgactcggctgcagaaagctctgggtgtgcggcagtaccatgtggcctcagtcctgtgccaacgggccaaggtggcgatgagccactttgagcccaacgagtacatccattatgacctgctagagaagaacattaacattgttcgcaaacgactgaaccggccgctgacactctcggagaagattgtgtatggacacctggatgaccccgccagccaggaaattgagcgaggcaagtcgtacctgcggctgcggccggaccgtgtggccatgcaggatgcgacggcccagatggccatgctccagttcatcagcagcgggctgtccaaggtggctgtgccatccaccatccactgtgaccatctgattgaagcccaggttgggggcgagaaagacctgcgccgggccaaggacatcaaccaggaagtttataatttcctggcaactgcaggtgccaaatatggcgtgggcttctggaagcctggatctggaatcattcaccagattattctggaaaactatgcgtaccctggtgttcttctgattggcactgactcccacacccccaatggtggcggccttgggggcatctgcattggagttgggggtgccgatgctgtggatgtcatggctgggatcccctgggagctgaagtgccccaaggtgattggcgtgaagctgacgggctctctctccggttggtcctcacccaaagatgtgatcctgaaggtggcaggcatcctcacggtgaaaggtggcacaggtgcaatcgtggaataccacgggcctggtgtagactccatctcctgcactggcatggcgacaatctgcaacatgggtgcagaaattggggccaccacttccgtgttcccttacaaccacaggatgaagaagtacctgagcaagaccggccgggaagacattgccaatctagctgatgaattcaaggatcacttggtgcctgaccctggctgccattatgaccaactaattgaaattaacctcagtgagctgaagccacacatcaatgggcccttcacccctgacctggctcaccctgtggcagaagtgggcaaggtggcagagaaggaaggatggcctctggacatccgagtgggtctaattggtagctgcaccaattcaagctatgaagatatggggcgctcagcagctgtggccaagcaggcactggcccatggcctcaagtgcaagtcccagttcaccatcactccaggttccgagcagatccgcgccaccattgagcgggacggctatgcacagatcttgagggatctgggtggcattgtcctggccaatgcttgtggcccctgcattggccagtgggacaggaaggacatcaagaagggggagaagaacacaatcgtcacctcctacaacaggaacttcacgggccgcaacgacgcaaaccccgagacccatgcctttgtcacgtccccagagattgtcacagccctggccattgcgggaaccctcaagttcaacccagagaccgactacctgacgggcacggatggcaagaagttcaggctggaggctccggatgcagatgagcttcccaaaggggagtttgacccagggcaggacacctaccagcacccacccaaggacagcagcgggcagcatgtggacgtgagccccaccagccagcgcctgcagctcctggagccttttgacaagtgggatggcaaggacctggaggacctgcagatcctcatcaaggtcaaagggaagtgtaccactgaccacatctcagctgctggcccctggctcaagttccgtgggcacttggataacatctccaacaacctgctcattggtgccatcaacattgaaaacggcaaggccaactccgtgcgcaatgccgtcactcaggagtttggccccgtccctgacactgcccgctactacaagaaacatggcatcaggtgggtggtgatcggagacgagaactacggcgagggctcgagccgggagcatgcagctctggagcctcgccaccttgggggccgggccatcatcaccaagagctttgccaggatccacgagaccaacctgaagaaacagggcctgctgcctctgaccttcgctgacccggctgactacaacaagattcaccctgtggacaagctgaccattcagggcctgaaggacttcacccctggcaagcccctgaagtgcatcatcaagcaccccaacgggacccaggagaccatcctcctgaaccacaccttcaacgagacgcagattgagtggttccgcgctggcagtgccctcaacagaatgaaggaactgcaacagtgagggcagtgcctccccgccccgccgctggcgtcaagttcagctccacgtgtgccatcagtggatccgatccgtccagccatggcttcctattccaagatggtgtgaccagacatgcttcctgctccccgcttagcccacggagtgactgtggttgtggtgggggggttcttaaaataactttttagcccccgtcttcctattttgagtttggttcagatcttaagcagctccatgcaactgtatttatttttgatgacaagactcccatctaaagtttttctcctgcctgatcatttcattggtggctgaaggattctagagaaccttttgttcttgcaaggaaaacaagaatccaaaaccagtgactgttctgtga

SEQ ID NO: 103847 - DNA, 2811 bp, Homo sapiens
  Payload ID: 415
  Gene Symbol: ACO2
  Gene Name: aconitase 2, mitochondrial
  ENST ID: ENST00000396512
  CDS Start-End: 18-2435
ctttgtcagtgcacaaaatggcgccctacagcctactggtgactcggctgcagaaagctctgggtgtgcggcagtaccatgtggcctcagtcctgtgccaacgggccaaggtggcgatgagccactttgagcccaacgagtacatccattatgacctgctagagaagaacattaacattgttcgcaaacgactgaaccggccgctgacactctcggagaagattgtgtatggacacctggatgaccccgccagccaggaaattgagcgaggcaagtcgtacctgcggctgcggccggaccgtgtggccatgcaggatgcgacggcccagatggccatgctccagttcatcagcagcgggctgtccaaggtggctgtgccatccaccatccactgtgaccatctgattgaagcccaggttgggggcgagaaagacctgcgccgggccaaggacatcaaccaggaagtttataatttcctggcaactgcaggtgccaaatatggcgtgggcttctggaagcctggatctggaatcattcaccagattattctggaaaactatgcgtaccctggtgttcttctgattggcactgactcccacacccccaatggtggcggccttgggggcatctgcattggagttgggggtgccgatgctgtggatgtcatggctgggatcccctgggagctgaagtgccccaaggtgattggcgtgaagctgacgggctctctctccggttggtcctcacccaaagatgtgatcctgaaggtggcaggcatcctcacggtgaaaggtggcacaggtgcaatcgtggaataccacgggcctggtgtagactccatctcctgcactggtgaggaaggcggccaggcgacgtggcccctaccctgtgctgggcctgatgggtctccagttgggagtagaagcggcatggcgacaatctgcaacatgggtgcagaaattggggccaccacttccgtgttcccttacaaccacaggatgaagaagtacctgagcaagaccggccgggaagacattgccaatctagctgatgaattcaaggatcacttggtgcctgaccctggctgccattatgaccaactaattgaaattaacctcagtgagctgaagccacacatcaatgggcccttcacccctgacctggctcaccctgtggcagaagtgggcaaggtggcagagaaggaaggatggcctctggacatccgagtgggtctaattggtagctgcaccaattcaagctatgaagatatggggcgctcagcagctgtggccaagcaggcactggcccatggcctcaagtgcaagtcccagttcaccatcactccaggttccgagcagatccgcgccaccattgagcgggacggctatgcacagatcttgagggatctgggtggcattgtcctggccaatgcttgtggcccctgcattggccagtgggacaggaaggacatcaagaagggggagaagaacacaatcgtcacctcctacaacaggaacttcacgggccgcaacgacgcaaaccccgagacccatgcctttgtcacgtccccagagattgtcacagccctggccattgcgggaaccctcaagttcaacccagagaccgactacctgacgggcacggatggcaagaagttcaggctggaggctccggatgcagatgagcttcccaaaggggagtttgacccagggcaggacacctaccagcacccacccaaggacagcagcgggcagcatgtggacgtgagccccaccagccagcgcctgcagctcctggagccttttgacaagtgggatggcaaggacctggaggacctgcagatcctcatcaaggtcaaagggaagtgtaccactgaccacatctcagctgctggcccctggctcaagttccgtgggcacttggataacatctccaacaacctgctcattggtgccatcaacattgaaaacggcaaggccaactccgtgcgcaatgccgtcactcaggagtttggccccgtccctgacactgcccgctactacaagaaacatggcatcaggtgggtggtgatcggagacgagaactacggcgagggctcgagccgggagcatgcagctctggagcctcgccaccttgggggccgggccatcatcaccaagagctttgccaggatccacgagaccaacctgaagaaacagggcctgctgcctctgaccttcgctgacccggctgactacaacaagattcaccctgtggacaagctgaccattcagggcctgaaggacttcacccctggcaagcccctgaagtgcatcatcaagcaccccaacgggacccaggagaccatcctcctgaaccacaccttcaacgagacgcagattgagtggttccgcgctggcagtgccctcaacagaatgaaggaactgcaacagtgagggcagtgcctccccgccccgccgctggcgtcaagttcagctccacgtgtgccatcagtggatccgatccgtccagccatggcttcctattccaagatggtgtgaccagacatgcttcctgctccccgcttagcccacggagtgactgtggttgtggtgggggggttcttaaaataactttttagcccccgtcttcctattttgagtttggttcagatcttaagcagctccatgcaactgtatttatttttgatgacaagactcccatctaaagtttttctcctgcctgatcatttcattggtggctgaaggattctagagaaccttttgttcttgcaaggaaaacaagaatccaaaaccagtgactgttctgtga

SEQ ID NO: 103848 - DNA, 1433 bp, Homo sapiens
  Payload ID: 416
  Gene Symbol: ACR
  Gene Name: acrosin
  Uniprot ID: P10323
  ENST ID: ENST00000216139
  CDS Start-End: 41-1306
gtgaggtcactaggcttgcaggccaggcagtgccaggagtatggttgagatgctaccaactgccattctgctggtcttggcagtgtccgtggttgctaaagataacgccacgtgtgatggcccctgtgggttacggttcaggcaaaacccacagggtggtgtccgcatcgtcggcgggaaggctgcacagcatggggcctggccctggatggtcagcctccagatcttcacgtacaacagccacaggtaccacacatgtggaggcagcttgctgaattcacgatgggtgctcactgctgctcactgcttcgtcggcaaaaataatgtgcatgactggagactggttttcggagcaaaggaaattacatatgggaacaataaaccagtaaaggcgcctctgcaagagagatatgtggagaaaatcatcattcatgaaaaatacaactctgcgacagagggaaatgacattgccctcgtggagatcacccctcccatttcgtgtgggcgcttcattgggccgggctgcctgccccactttaaggcaggcctccccagaggctcccagagctgctgggtggccggctggggatatatagaagagaaagcccccaggccatcatctatactgatggaggcacgtgtggatctcatcgacctggacttgtgtaactcgacccagtggtacaatgggcgcgttcagccaaccaatgtgtgcgcggggtatcctgtaggcaagatcgacacctgccagggagacagcggcgggcctctcatgtgcaaagacagcaaggaaagcgcctatgtggtcgtgggaatcacaagctggggggtaggctgtgcccgtgccaagcgccccggaatctacacggccacctggccctatctgaactggatcgcctccaagattggttctaacgctttgcgtatgattcaatcggccacccctccacctcccaccactcgaccgcccccgattcgaccccccttctcccaccctatctctgctcaccttccttggtatttccaaccgccccctcgaccacttccaccccgaccaccggcagcccagccccgacccccaccttcacccccgcccccacccccacctccagcctcacctttacccccacccccacccccacccccacctacaccctcatctaccacaaaacttccccaaggactttcttttgccaagcgcctacagcagctcatagaggtcttgaaggggaagacctattccgacggaaagaaccattatgacatggagaccacagagctcccagaactgacctcgacctcctgatctgacctggttctcaacagacccagtgagcccttcactcctgagaaaaaggaaagatgaaataaataaataaacatatatatatagatatacacacacacatatctgtatgtatacatgcatatac

SEQ ID NO: 103849 - DNA, 708 bp, Homo sapiens
  Payload ID: 416
  Gene Symbol: ACR
  Gene Name: acrosin
  ENST ID: ENST00000529621
  CDS Start-End: 7-645
aggagtatggttgagatgctaccaactgccattctgctggtcttggcagtgtccgtggttgctaaagataacgccacgtgtgatggcccctgtgggttacggttcaggcaaaacccacagggtggtgtccgcatcgtcggcgggaaggctgcacagcatggggcctggccctggatggtcagcctccagatcttcacgtacaacagccacaggtaccacacatgtggaggcagcttgctgaattcacgatgggtgctcactgctgctcactgcttcgtcggcaaaaataatgtgcatgactggagactggttttcggagcaaaggaaattacatatgggaacaataaaccagtaaaggcgcctctgcaagagagatatgtggagaaaatcatcattcatgaaaaatacaactctgcgacagagggaaatgacattgccctcgtggagatcacccctcccatttcgtgtgggcgcttcattgggccgggctgcctgccccactttaaggcaggcctccccagaggctcccagagctgctgggtggccggctggggatatatagaagagaaaggcttcctggagtgtccggcaggtacctctccattcaagacgggtgtagctgtcgctctagagctctgtccataaccaagctgtctctctctcccctggctcccagaagatctcttgcccatccaacactacctgata

SEQ ID NO: 103850 - DNA, 1933 bp, Homo sapiens
  Payload ID: 417
  Gene Symbol: ACRBP
  Gene Name: acrosin binding protein
  Uniprot ID: Q8NEB7
  ENST ID: ENST00000229243
  CDS Start-End: 95-1726
gcgtgcgccccgccccgcgcctgcggctctctctgcggcttggcccgttagaggcggcttgtgtccacgggacgcgggcggatcttctccggccatgaggaagccagccgctggcttccttccctcactcctgaaggtgctgctcctgcctctggcacctgccgcagcccaggattcgactcaggcctccactccaggcagccctctctctcctaccgaatacgaacgcttcttcgcactgctgactccaacctggaaggcagagactacctgccgtctccgtgcaacccacggctgccggaatcccacactcgtccagctggaccaatatgaaaaccacggcttagtgcccgatggtgctgtctgctccaacctcccttatgcctcctggtttgagtctttctgccagttcactcactaccgttgctccaaccacgtctactatgccaagagagtcctgtgttcccagccagtctctattctctcacctaacactctcaaggagatagaagcttcagctgaagtctcacccaccacgatgacctcccccatctcaccccacttcacagtgacagaacgccagaccttccagccctggcctgagaggctcagcaacaacgtggaagagctcctacaatcctccttgtccctgggaggccaggagcaagcgccagagcacaagcaggagcaaggagtggagcacaggcaggagccgacacaagaacacaagcaggaagaggggcagaaacaggaagagcaagaagaggaacaggaagaggagggaaagcaggaagaaggacaggggactaaggagggacgggaggctgtgtctcagctgcagacagactcagagcccaagtttcactctgaatctctatcttctaacccttcctcttttgctccccgggtacgagaagtagagtctactcctatgataatggagaacatccaggagctcattcgatcagcccaggaaatagatgaaatgaatgaaatatatgatgagaactcctactggagaaaccaaaaccctggcagcctcctgcagctgccccacacagaggccttgctggtgctgtgctattcgatcgtggagaatacctgcatcataacccccacagccaaggcctggaagtacatggaggaggagatccttggtttcgggaagtcggtctgtgacagccttgggcggcgacacatgtctacctgtgccctctgtgacttctgctccttgaagctggagcagtgccactcagaggccagcctgcagcggcaacaatgcgacacctcccacaagactccctttgtcagccccttgcttgcctcccagagcctgtccatcggcaaccaggtagggtccccagaatcaggccgcttttacgggctggatttgtacggtgggctccacatggacttctggtgtgcccggcttgccacgaaaggctgtgaagatgtccgagtctctgggtggctccagactgagttccttagcttccaggatggggatttccctaccaagatttgtgacacagactatatccagtacccaaactactgttccttcaaaagccagcagtgtctgatgagaaaccgcaatcggaaggtgtcccgcatgagatgtctgcagaatgagacttacagtgcgctgagccctggcaaaagtgaggacgttgtgcttcgatggagccaggagttcagcaccttgactctaggccagttcggatgagctggcgtctattctgcccacaccccagcccaacctgcccacgttctctattgttttgagaccccattgctttcaggctgccccttctgggtctgttactcggcccctactcacatttccttgggttggagcaacagtcccagagagggccacggtgggagctgcgccctccttaaaagatgactttacataaaatgttgatcttca

SEQ ID NO: 103851 - DNA, 1700 bp, Homo sapiens
  Payload ID: 417
  Gene Symbol: ACRBP
  Gene Name: acrosin binding protein
  ENST ID: ENST00000414226
  CDS Start-End: 46-1578
agaggcggcttgtgtccacgggacgcgggcggatcttctccggccatgaggaagccagccgctggcttccttccctcactcctgaaggtgctgctcctgcctctggcacctgccgcagcccaggattcgactcaggcctccactccaggcagccctctctctcctaccgaatacgaacgcttcttcgcactgctgactccaacctggaaggcagagactacctgccgtctccgtgcaacccacggctgccggaatcccacactcgtccagctggaccaatatgaaaaccacggcttagtgcccgatggtgctgtctgctccaacctcccttatgcctcctggtttgagtctttctgccagttcactcactaccgttgctccaaccacgtctactatgccaagagagtcctgtgttcccagccagtctctattctctcacctaacactctcaaggagatagaagcttcagctgaagtctcacccaccacgatgacctcccccatctcaccccacttcacagcgccagagcacaagcaggagcaaggagtggagcacaggcaggagccgacacaagaacacaagcaggaagaggggcagaaacaggaagagcaagaagaggaacaggaagaggagggaaagcaggaagaaggacaggggactaaggagggacgggaggctgtgtctcagctgcagacagactcagagcccaagtttcactctgaatctctatcttctaacccttcctcttttgctccccgggtacgagaagtagagtctactcctatgataatggagaacatccaggagctcattcgatcagcccaggaaatagatgaaatgaatgaaatatatgatgagaactcctactggagaaaccaaaaccctggcagcctcctgcagctgccccacacagaggccttgctggtgctgtgctattcgatcgtggagaatacctgcatcataacccccacagccaaggcctggaagtacatggaggaggagatccttggtttcgggaagtcggtctgtgacagccttgggcggcgacacatgtctacctgtgccctctgtgacttctgctccttgaagctggagcagtgccactcagaggccagcctgcagcggcaacaatgcgacacctcccacaagactccctttgtcagccccttgcttgcctcccagagcctgtccatcggcaaccaggtagggtccccagaatcaggccgcttttacgggctggatttgtacggtgggctccacatggacttctggtgtgcccggcttgccacgaaaggctgtgaagatgtccgagtctctgggtggctccagactgagttccttagcttccaggatggggatttccctaccaagatttgtgacacagactatatccagtacccaaactactgttccttcaaaagccagcagtgtctgatgagaaaccgcaatcggaaggtgtcccgcatgagatgtctgcagaatgagacttacagtgcgctgagccctggcaaaagtgaggacgttgtgcttcgatggagccaggagttcagcaccttgactctaggccagttcggatgagctggcgtctattctgcccacaccccagcccaacctgcccacgttctctattgttttgagaccccattgctttcaggctgccccttctgggtctgttactcggcccctactcacatttcctt

SEQ ID NO: 103852 - DNA, 588 bp, Homo sapiens
  Payload ID: 417
  Gene Symbol: ACRBP
  Gene Name: acrosin binding protein
  ENST ID: ENST00000546114
  CDS Start-End: 68-588
tctctctgcggcttggcccgttagaggcggcttgtgtccacgggacgcgggcggatcttctccggccatgaggaagccagccgctggcttccttccctcactcctgaaggtgctgctcctgcctctggcacctgccgcagcccaggattcgactcaggcctccactccaggcagccctctctctcctaccgaatacgaacgcttcttcgcactgctgactccaacctggaaggcagagactacctgccgtctccgtgcaacccacggctgccggaatcccacactcgtccagctggaccaatatgaaaaccacggcttagtgcccgatggtgctgtctgctccaacctcccttatgcctcctggtttgagtctttctgccagttcactcactaccgttgctccaaccacgtctactatgccaagagagtcctgtgttcccagccagtctctattctctcacctaacactctcaaggagatagaagcttcagctgaagtctcacccaccacgatgacctcccccatctcaccccacttcacagaacgccagaccttccagccctggcctgagaggctcagcaacaacgt

SEQ ID NO: 103853 - DNA, 1053 bp, Homo sapiens
  Payload ID: 417
  Gene Symbol: ACRBP
  Gene Name: acrosin binding protein
  ENST ID: ENST00000536350
  CDS Start-End: 28-987
cgggacgcgggcggatcttctccggccatgaggaagccagccgctggcttccttccctcactcctgaaggtgctgctcctgcctctggcacctgccgcagcccaggattcgactcaggcctccactccaggcagccctctctctcctaccgaatacgaacgcttcttcgcactgctgactccaacctggaaggcagagactacctgccgtctccgtgcaacccacggctgccggaatcccacactcgtccagctggaccaatatgaaaaccacggcttagtgcccgatggtgctgtctgctccaacctcccttatgcctcctggtttgagtctttctgccagttcactcactaccgttgctccaaccacgtctactatgccaagagagtcctgtgttcccagccagtctctattctctcacctaacactctcaaggagatagaagcttcagctgaagtctcacccaccacgatgacctcccccatctcaccccacttcacagtgacagaacgccagaccttccagccctggcctgagaggctcagcaacaacgtggaagagctcctacaatcctccttgtccctgggaggccaggagcaagcgccagagcacaagcaggagcaaggagtggagcacaggcaggagccgacacaagaacacaagcaggaagaggggcagaaacaggaagagcaagaagaggaacaggaagaggagggaaagcaggaagaaggacaggggactaaggagggacgggaggctgtgtctcagctgcagacagactcagagcccaagtttcactctgaatctctatcttctaacccttcctcttttgctccccgggtacgagaagtagagtctactcctatgataatggagaacatccaggagctcattcgatcagcccaggaaatagatgaaatgaatgaaatatatgatgagaactcctactggagaaaccaaaaccctggcaggtataggaagttttgactctgtcatccaccctgccctcccttctgcctttcttgggagtgagaagcccattttcctagcttc

SEQ ID NO: 103854 - DNA, 791 bp, Homo sapiens
  Payload ID: 417
  Gene Symbol: ACRBP
  Gene Name: acrosin binding protein
  ENST ID: ENST00000535884
  CDS Start-End: 46-348
agaggcggcttgtgtccacgggacgcgggcggatcttctccggccatgaggaagccagccgctggcttccttccctcactcctgaaggtgctgctcctgcctctggcacctgccgcagcccaggattcgactcaggcctccactccaggcagccctctctctcctaccgaatacgaacgcttcttcgcactgctgactccaacctggaaggcagagactacctgccgtctccgtgcaacccacggctgccggaatcccacactcgtccagctggaccaatatgaaaaccacggcttagtgcccgatgagagtcctgtgttcccagccagtctctattctctcacctaacactctcaaggagatagaagcttcagctgaagtctcacccaccacgatgacctcccccatctcaccccacttcacagtgacagaacgccagaccttccagccctggcctgagaggctcagcaacaacgtggaagagctcctacaatcctccttgtccctgggaggccaggagcaagcgccagagcacaagcaggagcaaggagtggagcacaggcaggagccgacacaagaacacaagcaggaagaggggcagaaacaggaagagcaagaagaggaacaggaagaggagggaaagcaggaagaaggacaggggactaaggagggacgggaggctgtgtctcagctgcagacagactcagagcccaagtttcactctgaatctctatcttctaacccttcctcttttgctccccgggtacgagaagtagagtctactcctatga

SEQ ID NO: 103855 - DNA, 1042 bp, Homo sapiens
  Payload ID: 418
  Gene Symbol: ACRV1
  Gene Name: acrosomal vesicle protein 1
  Uniprot ID: P26436
  ENST ID: ENST00000315608
  CDS Start-End: 52-792
ctgtgaagaagctgtggcccacactggggtcccctcttttcctaaatccagatgaacaggtttctcttgctaatgagtctttatctgcttggatctgccagaggaacatcaagtcagcctaatgagctttctggctccatagatcatcaaacttcagttcagcaacttccaggtgagttcttttcacttgaaaacccttctgatgctgaggctttatatgagacttcttcaggcctgaacactttaagtgagcatggttccagtgagcatggttcaagcaagcacactgtggccgagcacacttctggagaacatgctgagagtgagcatgcttcaggtgagcccgctgcgactgaacatgctgaaggtgagcatactgtaggtgagcagccttcaggagaacagccttcaggtgaacacctctccggagaacagcctttgagtgagcttgagtcaggtgaacagccttcagatgaacagccttcaggtgaacatggctccggtgaacagccttctggtgagcaggcctcgggtgaacagccttcaggcacaatattaaattgctacacatgtgcttatatgaatgatcaaggaaaatgtcttcgtggagagggaacctgcatcactcagaattcccagcagtgcatgttaaagaagatctttgaaggtggaaaactccaattcatggttcaagggtgtgagaacatgtgcccatctatgaacctcttctcccatggaacgaggatgcaaattatatgctgtcgaaatcaatctttctgcaataagatctagaagcctgggcccttgcttgttttgactcaggcagtaaaaagcctccatcactctatttggctcattttatatttagttccttccccagtcaacaactgaccacatctgcctctgcctgagcattaggatgctcaaacatcctatctttcttcttctattcatgcttttatccattcttctctgtcctgtcttccctgctccaactctttctctcaatattcctgatttttttttcaataaatttcacatg

SEQ ID NO: 103856 - DNA, 2212 bp, Homo sapiens
  Payload ID: 418
  Gene Symbol: ACRV1
  Gene Name: acrosomal vesicle protein 1
  Uniprot ID: P26436
  ENST ID: ENST00000533904
  CDS Start-End: 344-1141
atcttttaaactttattacaaaaaatatgtgctttttggtaatactttttttttttttttaaagatagggcagatagccccaacacactaccctgcacacagaaaataatcattggtcttcactagtgaaataagcagtgggttgctaagggccaacttgcctgaacaggctacacaagaacctcagagcccaacccattgtgaagaaacatgggttacttctgaggttctagaattcccagaagctctgcttcagcactggaagcttttgctcgcagtttgcttcatagctctgtgaagaagctgtggcccacactggggtcccctcttttcctaaatccagatgaacaggtttctcttgctaatgagtctttatctgcttggatctgccagaggaacatcaagtcagcctaatgagctttctggctccatagatcatcaaacttcagttcagcaacttccaggtgagttcttttcacttgaaaacccttctgatgctgaggctttatatgagacttcttcaggcctgaacactttaagtgagcatggttccagtgagcatggttcaagcaagcacactgtggccgagcacacttctggagaacatgctgagagtgagcatgcttcaggtgagcccgctgcgactgaacatgctgaaggtgagcatactgtaggtgagcagccttcaggagaacagccttcaggtgaacacctctccggagaacagcctttgagtgagcttgagtcaggtgaacagccttcagatgaacagccttcaggtgaacatggctccggtgaacagccttctggtgagcaggcctcgggtgaacagccttcaggtgagcacgcttcaggggaacaggcttcaggtgcaccaatttcaagcacatctacaggcacaatattaaattgctacacatgtgcttatatgaatgatcaaggaaaatgtcttcgtggagagggaacctgcatcactcagaattcccagcagtgcatgttaaagaagatctttgaaggtggaaaactccaattcatggttcaagggtgtgagaacatgtgcccatctatgaacctcttctcccatggaacgaggatgcaaattatatgctgtcgaaatcaatctttctgcaataagatctagaagcctgggcccttgcttgttttgactcaggcagtaaaaagcctccatcactctatttggctcattttatatttagttccttccccagtcaacaactgaccacatctgcctctgcctgagcattaggatgctcaaacatcctatctttcttcttctattcatgcttttatccattcttctctgtcctgtcttccctgctccaactctttctctcaatattcctgatttttttttcaataaatttcacatggttaaagcacacaggctcaagacagacctttttttcccccattaatctagttgcagggtcaacatgagcttccttccacaccgacactaaactgggtgcattgtttaagcattccatatttatgaaagtaaaggagtctccaagggcagagacaacaaagaggaatgcaaagtaggtattaatcttttacagggtgtaaacgtgcaggtacttctgacacccccccttttccatccctacacactcttccatttattatggcatacaaaaactcaactcttctttggctcttgagagtttctagtcttcagtagtccactactaacataatgataatagtataatgattccttatttgctatatattgcagcagttcataatgcttaaatcatttttttcacacacaatgttactgaatcatctatacaggataggagggcaaatggaaatactaaacggtccctcatataagtgttatgttcttcaagatgttttcacatacacggtctcatctgatcctcaggaaagatcccagagtggtagacaggaaagatggcatcatccttttttgcaaataaggaaatgtgacacagagatgttttctttattcatactccatgttgttccaaatttaccaaggttacagagctacagagagctataggcagattccacaaccaaatctgcaagatctaaatctgagctgtttccaccacaatgaaagtagccagaatggttctaagaactcttagaacagtacaacaagaagtcaattttactgtatataaaatttaaaatttcaacatatatacacatcatg

SEQ ID NO: 103857 - DNA, 794 bp, Homo sapiens
  Payload ID: 418
  Gene Symbol: ACRV1
  Gene Name: acrosomal vesicle protein 1
  Uniprot ID: P26436
  ENST ID: ENST00000530048
  CDS Start-End: 52-684
ctgtgaagaagctgtggcccacactggggtcccctcttttcctaaatccagatgaacaggtttctcttgctaatgagtctttatctgcttggatctgccagaggaacatcaagtcagcctaatgagctttctggctccatagatcatcaaacttcagttcagcaacttccaggtgagcccgctgcgactgaacatgctgaaggtgagcatactgtaggtgagcagccttcaggagaacagccttcaggtgaacacctctccggagaacagcctttgagtgagcttgagtcaggtgaacagccttcagatgaacagccttcaggtgaacatggctccggtgaacagccttctggtgagcaggcctcgggtgaacagccttcaggtgagcacgcttcaggggaacaggcttcaggtgcaccaatttcaagcacatctacaggcacaatattaaattgctacacatgtgcttatatgaatgatcaaggaaaatgtcttcgtggagagggaacctgcatcactcagaattcccagcagtgcatgttaaagaagatctttgaaggtggaaaactccaattcatggttcaagggtgtgagaacatgtgcccatctatgaacctcttctcccatggaacgaggatgcaaattatatgctgtcgaaatcaatctttctgcaataagatctagaagcctgggcccttgcttgttttgactcaggcagtaaaaagcctccatcactctatttggctcattttatatttagttccttccccagtcaacaactgaccacatctgcc

SEQ ID NO: 103858 - DNA, 782 bp, Homo sapiens
  Payload ID: 418
  Gene Symbol: ACRV1
  Gene Name: acrosomal vesicle protein 1
  Uniprot ID: P26436
  ENST ID: ENST00000527795
  CDS Start-End: 95-682
gcttcagcactggaagcttttgctcgcagtttgcttcatagctctgtgaagaagctgtggcccacactggggtcccctcttttcctaaatccagatgaacaggtttctcttgctaatgagtctttatctgcttggatctgccagaggaacatcaagtcagcctaatgagctttctggctccatagatcatcaaacttcagttcagcaacttccaggtgagcagccttcaggagaacagccttcaggtgaacacctctccggagaacagcctttgagtgagcttgagtcaggtgaacagccttcagatgaacagccttcaggtgaacatggctccggtgaacagccttctggtgagcaggcctcgggtgaacagccttcaggtgagcacgcttcaggggaacaggcttcaggtgcaccaatttcaagcacatctacaggcacaatattaaattgctacacatgtgcttatatgaatgatcaaggaaaatgtcttcgtggagagggaacctgcatcactcagaattcccagcagtgcatgttaaagaagatctttgaaggtggaaaactccaattcatggttcaagggtgtgagaacatgtgcccatctatgaacctcttctcccatggaacgaggatgcaaattatatgctgtcgaaatcaatctttctgcaataagatctagaagcctgggcccttgcttgttttgactcaggcagtaaaaagcctccatcactctatttggctcattttatatttagttccttccccagtcaacaactgac

SEQ ID NO: 103859 - DNA, 2657 bp, Homo sapiens
  Payload ID: 419
  Gene Symbol: ABLIM1
  Gene Name: actin binding LIM protein 1
  Uniprot ID: O14639
  ENST ID: ENST00000277895
  CDS Start-End: 99-2435
agacagtaaggagccaggggaacagagagaattgtggggcagcaccgctccttgggtccccactccccatttctcattgcttggaaatccatgccaagatgcctgccttccttggtctaaagtgtctggggaaattgtgcagctctgagaaaagcaaagtcacctcatctgagagaaccagtgccaggggctcgaacagaaagagactgattgttgaggaccggagggtctctgggacctccttcaccgctcataggcgtgccactatcactcatttgctgtatctctgtcccaaggactactgcccacgtgggcgtgtatgtaacagcgttgatccttttgtggcccaccctcaggaccctcaccacccatcagagaagcctgtcattcactgccataaatgtggggagccttgcaagggtgaagtgcttcgggtccagaccaaacatttccacatcaagtgtttcacctgcaaagtgtgtggctgtgacctggcacaagggggcttcttcataaagaacggagagtatctctgcaccctggactaccagcggatgtacgggacacgctgccatggctgtggggagttcgtggagggcgaagtggtgactgctctgggcaagacctaccatcccaattgctttgcttgtactatctgcaagcgcccgtttccacccggagaccgagtcacattcaatgggagagactgcctttgtcaactctgtgcacagccgatgtcgtccagtccgaaagaaaccaccttctccagcaattgtgccggctgcggaagagatatcaagaatgggcaggcgctgctggcgctggataagcagtggcacttggggtgctttaaatgcaagtcctgcgggaaggtcctcaccggggagtacatcagcaaggatggtgctccgtactgtgaaaaggactaccagggactctttggggtgaaatgtgaggcgtgtcaccagtttatcacagggaaagtcctggaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctggcaatgagccgtccagcggccggaactcccctctcccttaccggccagacagccgccctctaactccaacttacgctcaggcccctaaacatttccatgttccagatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagattaccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacac

SEQ ID NO: 103860 - DNA, 7690 bp, Homo sapiens
  Payload ID: 419
  Gene Symbol: ABLIM1
  Gene Name: actin binding LIM protein 1
  ENST ID: ENST00000369252
  CDS Start-End: 303-2543
gtcattgagctgatgtgcttttgcaaggggtctctttagaagtggtaggggcagggtcgagagaagaaggggatgcagaatctgtacatgaggaaggagccagagtcactcaggaaactcctcattcttcctgcgctggctgtggcacacccaccggtggcacacccctccctcgggtccagttcagcccacagactcctgggaggagagccagggccccagcctctcctttgaggagtgttgcagcctttctgtgtgccagatgcctagtgaagaaaagctgaaaccctggagctttgtgcatgttaatgaccttggaaatgactgagctcacggaccctcatcacaccatgggagactacaaagtggcccaccctcaggaccctcaccacccatcagagaagcctgtcattcactgccataaatgtggggagccttgcaagggtgaagtgcttcgggtccagaccaaacatttccacatcaagtgtttcacctgcaaagtgtgtggctgtgacctggcacaagggggcttcttcataaagaacggagagtatctctgcaccctggactaccagcggatgtacgggacacgctgccatggctgtggggagttcgtggagggcgaagtggtgactgctctgggcaagacctaccatcccaattgctttgcttgtactatctgcaagcgcccgtttccacccggagaccgagtcacattcaatgggagagactgcctttgtcaactctgtgcacagccgatgtcgtccagtccgaaagaaaccaccttctccagcaattgtgccggctgcggaagagatatcaagaatgggcaggcgctgctggcgctggataagcagtggcacttggggtgctttaaatgcaagtcctgcgggaaggtcctcaccggggagtacatcagcaaggatggtgctccgtactgtgaaaaggactaccagggactctttggggtgaaatgtgaggcgtgtcaccagtttatcacagggaaagtcctggaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggctgccaaacattcggcgttcttcatccgatttcttttattccaaaagtctgattcgacgcacaggacggtctccgtctctgcagcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctggcaatgagccgtccagcggccggaactcccctctcccttaccggccagacagccgccctctaactccaacttacgctcaggcccctaaacatttccatgttccagatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagatttccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgagcttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattaagtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcataggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcttcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcataatgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttacaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcatttttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggtgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgt

SEQ ID NO: 103861 - DNA, 2255 bp, Homo sapiens
  Payload ID: 419
  Gene Symbol: ABLIM1
  Gene Name: actin binding LIM protein 1
  Uniprot ID: O14639
  ENST ID: ENST00000369253
  CDS Start-End: 231-1436
cgagcttcggagagaagcctgatatgtaacccaggcaggtgggagcctcagtctgtcgggctgaggtctggcatctacaaagcctcttggccgtgttctgaacttgaagcctggaggagttctctgctcagcacagccaaggaacagaattagaagaaaaggaaccctggcctgaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcgggcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctgatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagattaccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgagcttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattaagtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaa

SEQ ID NO: 103862 - DNA, 3203 bp, Homo sapiens
  Payload ID: 419
  Gene Symbol: ABLIM1
  Gene Name: actin binding LIM protein 1
  Uniprot ID: O14639
  ENST ID: ENST00000369256
  CDS Start-End: 651-2897
ataccaggagtttgtcagggaactgtttccaaagccataatgaataatcaggctgttagtaaaagaagcctctccaagttatagcattttttaaaaattctagtagtgaagaaaataattaaaagcccatctggttgagatagtaattcattaaggaaaaagaggaggcagaaggctggggaataatcgatccttttctttctttatttcatgtgtttcagttattgtgaaatgatagtgatcaaaatctggattctggattgtgcagaatgcaggaaaatcctaggaacattcttggcgtgttctaatagtggcttcccagaaacgagtgttttcagtgggtgtggcgtcattgagctgatgtgcttttgcaaggggtctctttagaagtggtaggggcagggtcgagagaagaaggggatgcagaatctgtacatgaggaaggagccagagtcactcaggaaactcctcattcttcctgcgctggctgtggcacacccaccggtggcacacccctccctcgggtccagttcagcccacagactcctgggaggagagccagggccccagcctctcctttgaggagtgttgcagcctttctgtgtgccagatgcctagtgaagaaaagctgaaaccctggagctttgtgcatgttaatgaccttggaaatgactgagctcacggaccctcatcacaccatgggagactacaaagtggcccaccctcaggaccctcaccacccatcagagaagcctgtcattcactgccataaatgtggggagccttgcaagggtgaagtgcttcgggtccagaccaaacatttccacatcaagtgtttcacctgcaaagtgtgtggctgtgacctggcacaagggggcttcttcataaagaacggagagtatctctgcaccctggactaccagcggatgtacgggacacgctgccatggctgtggggagttcgtggagggcgaagtggtgactgctctgggcaagacctaccatcccaattgctttgcttgtactatctgcaagcgcccgtttccacccggagaccgagtcacattcaatgggagagactgcctttgtcaactctgtgcacagccgatgtcgtccagtccgaaagaaaccaccttctccagcaattgtgccggctgcggaagagatatcaagaatgggcaggcgctgctggcgctggataagcagtggcacttggggtgctttaaatgcaagtcctgcgggaaggtcctcaccggggagtacatcagcaaggatggtgctccgtactgtgaaaaggactaccagggactctttggggtgaaatgtgaggcgtgtcaccagtttatcacagggaaagtcctggaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggctgccaaacattcggcgttcttcatccgatttcttttattccaaaagtctgattcgacgcacaggacggtctccgtctctgcagcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctggcaatgagccgtccagcggccggaactcccctctcccttaccggccagacagccgccctctaactccaacttacgctcaggcccctaaacatttccatgttccagatcaaggaatcaacatttaccgaaagccacccatctacaaacagcatgatgcagctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagattaccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgagcttttcacattaccttatgtatacaacaggagctgcgttgttttcttctttttcttttccttt

SEQ ID NO: 103863 - DNA, 2230 bp, Homo sapiens
  Payload ID: 419
  Gene Symbol: ABLIM1
  Gene Name: actin binding LIM protein 1
  ENST ID: ENST00000369266
  CDS Start-End: 226-1431
ttcggagagaagcctgatatgtaacccaggcaggtgggagcctcagtctgtcgggctgaggtctggcatctacaaagcctcttggccgtgttctgaacttgaagcctggaggagttctctgctcagcacagccaaggaacagaattagaagaaaaggaaccctggcctgaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcgggcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctgatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagatttccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgagcttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattaagtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgc

SEQ ID NO: 103864 - DNA, 6841 bp, Homo sapiens
  Payload ID: 419
  Gene Symbol: ABLIM1
  Gene Name: actin binding LIM protein 1
  Uniprot ID: O14639
  ENST ID: ENST00000392952
  CDS Start-End: 327-1694
aaagcgaggagaggaggcgtgagagagcgtgcctgcccgccgcacacggggctggtttccggagtgcgtctctagagggatgcacgttgccttagccgagcttcggagagaagcctgatatgtaacccaggcaggtgggagcctcagtctgtcgggctgaggtctggcatctacaaagcctcttggccgtgttctgaacttgaagcctggaggagttctctgctcagcacagccaaggaacagaattagaagaaaaggaaccctggcctgaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggctgccaaacattcggcgttcttcatccgatttcttttattccaaaagtctgattcgacgcacaggacggtctccgtctctgcagcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctgatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagattaccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgagcttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattaagtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcataggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcttcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcataatgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttacaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcatttttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggtgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgt

SEQ ID NO: 103865 - DNA, 7408 bp, Homo sapiens
  Payload ID: 419
  Gene Symbol: ABLIM1
  Gene Name: actin binding LIM protein 1
  Uniprot ID: O14639
  ENST ID: ENST00000392955
  CDS Start-End: 105-2261
ctgggaggagagccagggccccagcctctcctttgaggagtgttgcagcctttctgtgtgccagatgcctagtgaagaaaagctgaaaccctggagctttgtgcatgttaatgaccttggaaatgactgagctcacggaccctcatcacaccatgggagactacaaagtggcccaccctcaggaccctcaccacccatcagagaagcctgtcattcactgccataaatgtggggagccttgcaagggtgaagtgcttcgggtccagaccaaacatttccacatcaagtgtttcacctgcaaagtgtgtggctgtgacctggcacaagggggcttcttcataaagaacggagagtatctctgcaccctggactaccagcggatgtacgggacacgctgccatggctgtggggagttcgtggagggcgaagtggtgactgctctgggcaagacctaccatcccaattgctttgcttgtactatctgcaagcgcccgtttccacccggagaccgagtcacattcaatgggagagactgcctttgtcaactctgtgcacagccgatgtcgtccagtccgaaagaaaccaccttctccagcaattgtgccggctgcggaagagatatcaagaatgggcaggcgctgctggcgctggataagcagtggcacttggggtgctttaaatgcaagtcctgcgggaaggtcctcaccggggagtacatcagcaaggatggtgctccgtactgtgaaaaggactaccagggactctttggggtgaaatgtgaggcgtgtcaccagtttatcacagggaaagtcctggaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctggcaatgagccgtccagcggccggaactcccctctcccttaccggccagacagccgccctctaactccaacttacgctcaggcccctaaacatttccatgttccagatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagattaccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgagcttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattaagtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcataggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcttcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcataatgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttacaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcatttttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggtgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgt

SEQ ID NO: 103866 - DNA, 854 bp, Homo sapiens
  Payload ID: 419
  Gene Symbol: ABLIM1
  Gene Name: actin binding LIM protein 1
  ENST ID: ENST00000428430
  CDS Start-End: 335-854
gaggcgtgagagagcgtgcctgcccgccgcacacggggctggtttccggagtgcgtctctagagggatgcacgttgccttagccgagcttcggagagaagcctgatatgtaacccaggcaggtgggagcctcagtctgtcgggctgaggtctggcatctacaaagcctcttggccgtgttctgaacttgaagcctggaggagttctctgctcagcacagccaaggaacagaattagaagaaaaggaaccctggcctgaggtaaagcggacattgcacaaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctgatcaaggaatcaacatttaccgaaagc

SEQ ID NO: 103867 - DNA, 541 bp, Homo sapiens
  Payload ID: 419
  Gene Symbol: ABLIM1
  Gene Name: actin binding LIM protein 1
  ENST ID: ENST00000440467
  CDS Start-End: 1-519
tgtaagcaatctacgaagaccgaggaaaagctgcggcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctgatcaaggaatcaacatttaccgaaagccacccatctacaaacagcatgtactgtttgaagtcatccttttgttgttaatttaagaataaaattctcagcatttga

SEQ ID NO: 103868 - DNA, 7606 bp, Homo sapiens
  Payload ID: 419
  Gene Symbol: ABLIM1
  Gene Name: actin binding LIM protein 1
  ENST ID: ENST00000533213
  CDS Start-End: 303-2459
gtcattgagctgatgtgcttttgcaaggggtctctttagaagtggtaggggcagggtcgagagaagaaggggatgcagaatctgtacatgaggaaggagccagagtcactcaggaaactcctcattcttcctgcgctggctgtggcacacccaccggtggcacacccctccctcgggtccagttcagcccacagactcctgggaggagagccagggccccagcctctcctttgaggagtgttgcagcctttctgtgtgccagatgcctagtgaagaaaagctgaaaccctggagctttgtgcatgttaatgaccttggaaatgactgagctcacggaccctcatcacaccatgggagactacaaagtggcccaccctcaggaccctcaccacccatcagagaagcctgtcattcactgccataaatgtggggagccttgcaagggtgaagtgcttcgggtccagaccaaacatttccacatcaagtgtttcacctgcaaagtgtgtggctgtgacctggcacaagggggcttcttcataaagaacggagagtatctctgcaccctggactaccagcggatgtacgggacacgctgccatggctgtggggagttcgtggagggcgaagtggtgactgctctgggcaagacctaccatcccaattgctttgcttgtactatctgcaagcgcccgtttccacccggagaccgagtcacattcaatgggagagactgcctttgtcaactctgtgcacagccgatgtcgtccagtccgaaagaaaccaccttctccagcaattgtgccggctgcggaagagatatcaagaatgggcaggcgctgctggcgctggataagcagtggcacttggggtgctttaaatgcaagtcctgcgggaaggtcctcaccggggagtacatcagcaaggatggtgctccgtactgtgaaaaggactaccagggactctttggggtgaaatgtgaggcgtgtcaccagtttatcacagggaaagtcctggaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctggcaatgagccgtccagcggccggaactcccctctcccttaccggccagacagccgccctctaactccaacttacgctcaggcccctaaacatttccatgttccagatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagatttccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgagcttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattaagtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcataggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcttcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcataatgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttacaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcatttttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggtgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgt

SEQ ID NO: 103869 - DNA, 3754 bp, Homo sapiens
  Payload ID: 420
  Gene Symbol: ABLIM2
  Gene Name: actin binding LIM protein family, member 2
  ENST ID: ENST00000318888
  CDS Start-End: 144-2078
tgcggcggcgctgcctggcgtgtgcgcaaggagcgggcgcggagccggcgggcgggcggaggatagcgcgggcgcggcacctgcgggcccgagggtctggctgtcgcagcgccgggccgccccgactccgagcggctgctgagatgagtgcagtgtcgcagccccaggctgctcccagcccgctggagaagtcgcccagcacggcgatcctgtgcaacacgtgtgggaatgtgtgcaagggcgaggtgctgcgggtgcaggacaagtacttccacatcaagtgcttcgtctgtaaagcatgtggctgcgacctggccgagggcggcttcttcgtgcggcagggcgagtacatctgcacgctggactaccagaggctctacggcacccgctgcttcagctgcgaccagttcattgagggtgaggtggtgtcggcgctgggcaagacctaccaccccgactgcttcgtgtgtgccgtctgccggctgcccttcccccccggggaccgagtgaccttcaacgggaaggaatgcatgtgccagaagtgttccctgcccgtatcggtgggcagcagcgcgcacctgtcccagggcctccgaagttgtgggggctgcggcacagaaatcaagaatggccaggccctggtagccttggacaagcactggcacttgggctgttttaagtgcaagagctgtgggaagctcctgaatgccgagtacatcagcaaggatgggctgccctactgcgaagctgactatcacgccaagttcggcatccgctgtgacagctgtgagaaatacatcacggggcgcgtgctggaggccggagagaagcactaccacccttcctgcgcgctatgtgtcaggtgcggccagatgtttgcagaaggcgaagagatgtatcttcaaggttcctccatctggcatccggcgtgtcgacaagcagccagaactgaagacagaaacaaggaaaccagaacttcctcagagagcatcatttctgtccctgcttccagcacctcagggtctccgagccgtgtgatttatgccaagcttggtggtgagatcctggactacagggacttggcagcccttcctaaaagtaaggccatctatgacatcgaccgccccgacatgatctcctactcaccctacatcagccactctgcaggggacaggcagagctacggcgagggggatcaggatgaccggtcctacaagcagtgtcggacctccagcccaagctccactgggtcggttagcctcgggcgctacactccgacctcacggtcaccacagcactacagccgtccagctggtactgtgagtgtgggtaccagtagctgcctctccctgtcccaacacccaagccctacatccgtgttcagacatcattacatcccctacttccgaggcagtgaaagtggccggagcacccccagcctctccgtgctctctgacagcaagccgccccccccacctaccagcaggcacctcgccactcacgtcccagacactggcgtaaaagataacatctataggaaaccccctatctacagacagcatgctgccaggcgatcggatggggaggatggaagcttggaccaggataacaggaagcagaagagcagctggctgatgctcaagggggatgcagacacaaggaccaattctccagacctggacacccagtccttgtcccacagcagcgggaccgacagagaccctctccaaaggatggcaggggacagctttcactcacgattcccctattccaaatctgaccctctcccaggacatggaaagaatggcttggaccagcggaatgccaatctggccccctgtggagcagacccggatgccagctggggcatgcgagaatacaagatctatccgtatgactccctcatcgtcacaaaccgaattcgcgtgaaactgcccaaagacgtggaccggacgagactggagagacacttgtcgcccgaggagttccaggaagtgtttgggatgagcatcgaggagtttgaccgcctggccctctggaagaggaatgaccttaagaagaaagcccttttgttctgacggctgccagcctgccccactggtgtgtgccgggcgccgaggccaggggcccctggcgagaaccgcacacacccctcccacacaccttgctctggcttctctgtgtccatggggtgggcgggagggggtcccccagcaggtgcggcccctgcacctgccggcgacactcctgccggtagtttagggccgagacggctagcttcacgccacccttccccgctgtggcttggtgtcagggagaggctgtagagtggctgtgtcgggcatcagatggagcacacaggtggctgcagcccagcccaccttcccagcgttctcgaggtgccctggccccggtgctgggcacgtgggggacagaggtggccgggacgtgagctgtgaggcttgttgatgatggttgctgacaccatcatcgggggtgggcacacggcccttcggagcctgggcagcctggcctcacaggcagactcgcagacggggcagtgagcgtctgggacagtgccaagagtggggtgtgtgatttttgcaggcgtctgtgatgggtctctttagggacaaatgtcaacaagggacaagacagggcaccttccgccagcgcccctccatgcgctgcgttcctcctccagatcgacccctagatgcctacacaatatctttaaagtaacacagaagtttttattttattaaaaagtatagcctacttaaacgcgagatgacatatatagagtttaattttacggtccctccgcaggggagcggcctccagccttattctccaccgctcggatctgtgtggtttcagtctgttcttggtgtggtcctcatacacagagctccctgtctagtttcttttctttttcttttttctttttctcgtcacacaggtaaccttaaagacagacccctctaaagaacgctttgtaaatacatgtgaggtatagccaccactgttttccttgctgttatttttccaagtcttggggagaaaacatcctcctctgatggccaaagccctggaatcaagggtttccacgtaccctgcctaatacccgacgtagctcttgatgcaccgtccttgtgctgtggctggcggtgtctcagcctgaaacataaaccccacatgccccaggagcgatgtgctccctgaaacagacaaccacacgctgttggggagagaaggatggagataggatggagataggatggagatgtggctcttctcatctttgaagccagcagggcatcccggagcaggaggctggccgggctccccaagcgaaggcgttggtgtctgtcattaggtgtgtgttagggtgcagcaccggccgtcacaggatgctgataagcgcgctgagaggtggatgaaacaccaaagtctgtttccccgtccgcagtgggtgttgcctctttgtgtgtgtcccgatgttcctgcctgtgagtcggccttactccgtttccttagcgcccatgacacgccaagtcccgtttcgcactcggcttctcacccgcccagctcggctagggagggggagtttttagcacctaatatgcttcctgccattgcgcaatctgagcctgagcaactggaaacccccatttctcattagtgcaatgtcatatctgatcccaggaagcctggaaaataaaagacgatgcattataacttgcggaagtac

SEQ ID NO: 103870 - DNA, 2589 bp, Homo sapiens
  Payload ID: 420
  Gene Symbol: ABLIM2
  Gene Name: actin binding LIM protein family, member 2
  Uniprot ID: Q6H8Q1
  ENST ID: ENST00000341937
  CDS Start-End: 66-1901
acctgcgggcccgagggtctggctgtcgcagcgccgggccgccccgactccgagcggctgctgagatgagtgcagtgtcgcagccccaggctgctcccagcccgctggagaagtcgcccagcacggcgatcctgtgcaacacgtgtgggaatgtgtgcaagggcgaggtgctgcgggtgcaggacaagtacttccacatcaagtgcttcgtctgtaaagcatgtggctgcgacctggccgagggcggcttcttcgtgcggcagggcgagtacatctgcacgctggactaccagaggctctacggcacccgctgcttcagctgcgaccagttcattgagggtgaggtggtgtcggcgctgggcaagacctaccaccccgactgcttcgtgtgtgccgtctgccggctgcccttcccccccggggaccgagtgaccttcaacgggaaggaatgcatgtgccagaagtgttccctgcccgtatcggtgggcagcagcgcgcacctgtcccagggcctccgaagttgtgggggctgcggcacagaaatcaagaatggccaggccctggtagccttggacaagcactggcacttgggctgttttaagtgcaagagctgtgggaagctcctgaatgccgagtacatcagcaaggatgggctgccctactgcgaagctgactatcacgccaagttcggcatccgctgtgacagctgtgagaaatacatcacggggcgcgtgctggaggccggagagaagcactaccacccttcctgcgcgctatgtgtcaggtgcggccagatgtttgcagaaggcgaagagatgtatcttcaaggttcctccatctggcatccggcgtgtcgacaagcagccagaactgaagacagaaacaaggaaaccagaacttcctcagagagcatcatttctgtccctgcttccagcacctcagggtctccgagccgtgtgatttatgccaagcttggtggtgagatcctggactacagggacttggcagcccttcctaaaagtaaggccatctatgacatcgaccgccccgacatgatctcctactcaccctacatcagccactctgcaggggacaggcagagctacggcgagggggatcaggatgaccggtcctacaagcagtgtcggacctccagcccaagctccactgggtcggttagcctcgggcgctacactccgacctcacggtcaccacagcactacagccgtccaggcagtgaaagtggccggagcacccccagcctctccgtgctctctgacagcaagccgcccccctccacctaccagcaggcacctcgccacttccacgtcccagacactggcgtaaaagataacatctataggaaaccccctatctacagacagcatgctgccaggcgatcggatggggaggatggaagcttggaccaggataacaggaagaagagcagctggctgatgctcaagggggatgcagacacaaggaccaattctccagacctggacacccagtccttgtcccacagcagcgggaccgacagagaccctctccaaaggatggcaggggacagctttcactcacgattcccctattccaaatctgaccctctcccaggacatggaaagaatggcttggaccagcggaatgccaatctggccccctgtggagcagacccggatgccagctggggcatgcgagaatacaagatctatccgtatgactccctcatcgtcacaaaccgaattcgcgtgaaactgcccaaagacgtggaccggacgagactggagagacacttgtcgcccgaggagttccaggaagtgtttgggatgagcatcgaggagtttgaccgcctggccctctggaagaggaatgaccttaagaagaaagcccttttgttctgacggctgccagcctgccccactggtgtgtgccgggcgccgaggccaggggcccctggcgagaaccgcacacacccctcccacacaccttgctctggcttctctgtgtccatggggtgggcgggagggggtcccccagcaggtgcggcccctgcacctgccggcgacactcctgccggtagtttagggccgagacggctagcttcacgccacccttccccgctgtggcttggtgtcagggagaggctgtagagtggctgtgtcgggcatcagatggagcacacaggtggctgcagcccagcccaccttcccagcgttctcgaggtgccctggccccggtgctgggcacgtgggggacagaggtggccgggacgtgagctgtgaggcttgttgatgatggttgctgacaccatcatcgggggtgggcacacggcccttcggagcctgggcagcctggcctcacaggcagactcgcagacggggcagtgagcgtctgggacagtgccaagagtggggtgtgtgatttttgcaggcgtctgtgatgggtctctttagggacaaatgtcaacaagggacaagacagggcaccttccgccagcgcccctccatgcgctgcgttcctcctccagatcgacccctagatgcctacacaatatctttaaagtaacacagaagtttttattttattaaa

SEQ ID NO: 103871 - DNA, 3396 bp, Homo sapiens
  Payload ID: 420
  Gene Symbol: ABLIM2
  Gene Name: actin binding LIM protein family, member 2
  Uniprot ID: Q6H8Q1
  ENST ID: ENST00000361737
  CDS Start-End: 123-1718
gtgcgcaaggagcgggcgcggagccggcgggcgggcggaggatagcgcgggcgcggcacctgcgggcccgagggtctggctgtcgcagcgccgggccgccccgactccgagcggctgctgagatgagtgcagtgtcgcagccccaggctgctcccagcccgctggagaagtcgcccagcacggcgatcctgtgcaacacgtgtgggaatgtgtgcaagggcgaggtgctgcgggtgcaggacaagtacttccacatcaagtgcttcgtctgtaaagcatgtggctgcgacctggccgagggcggcttcttcgtgcggcagggcgagtacatctgcacgctggactaccagaggctctacggcacccgctgcttcagctgcgaccagttcattgagggtgaggtggtgtcggcgctgggcaagacctaccaccccgactgcttcgtgtgtgccgtctgccggctgcccttcccccccggggaccgagtgaccttcaacgggaaggaatgcatgtgccagaagtgttccctgcccgtatcggtgggcagcagcgcgcacctgtcccagggcctccgaagttgtgggggctgcggcacagaaatcaagaatggccaggccctggtagccttggacaagcactggcacttgggctgttttaagtgcaagagctgtgggaagctcctgaatgccgagtacatcagcaaggatgggctgccctactgcgaagctgactatcacgccaagttcggcatccgctgtgacagctgtgagaaatacatcacggggcgcgtgctggaggccggagagaagcactaccacccttcctgcgcgctatgtgtcaggtgcggccagatgtttgcagaaggcgaagagatgtatcttcaaggttcctccatctggcatccggcgtgtcgacaagcagccagaactgaagacagaaacaaggaaaccagaacttcctcagagagcatcatttctgtccctgcttccagcacctcagggtctccgagccgtgtgatttatgccaagcttggtggtgagatcctggactacagggacttggcagcccttcctaaaagtaaggccatctatgacatcgaccgccccgacatgatctcctactcaccctacatcagccactctgcaggggacaggcagagctacggcgagtcccctcagttgctctcgccaacgccgaccgagggggatcaggatgaccggtcctacaagcagtgtcggacctccagcccaagctccactgggtcggttagcctcgggcgctacactccgacctcacggtcaccacagcactacagccgtccagctgccaggcgatcggatggggaggatggaagcttggaccaggataacaggaagaagagcagctggctgatgctcaagggggatgcagacacaaggaccaattctccagacctggacacccagtccttgtcccacagcagcgggaccgacagagaccctctccaaaggatggcaggggacagctttcactcacaatacaagatctatccgtatgactccctcatcgtcacaaaccgaattcgcgtgaaactgcccaaagacgtggaccggacgagactggagagacacttgtcgcccgaggagttccaggaagtgtttgggatgagcatcgaggagtttgaccgcctggccctctggaagaggaatgaccttaagaagaaagcccttttgttctgacggctgccagcctgccccactggtgtgtgccgggcgccgaggccaggggcccctggcgagaaccgcacacacccctcccacacaccttgctctggcttctctgtgtccatggggtgggcgggagggggtcccccagcaggtgcggcccctgcacctgccggcgacactcctgccggtagtttagggccgagacggctagcttcacgccacccttccccgctgtggcttggtgtcagggagaggctgtagagtggctgtgtcgggcatcagatggagcacacaggtggctgcagcccagcccaccttcccagcgttctcgaggtgccctggccccggtgctgggcacgtgggggacagaggtggccgggacgtgagctgtgaggcttgttgatgatggttgctgacaccatcatcgggggtgggcacacggcccttcggagcctgggcagcctggcctcacaggcagactcgcagacggggcagtgagcgtctgggacagtgccaagagtggggtgtgtgatttttgcaggcgtctgtgatgggtctctttagggacaaatgtcaacaagggacaagacagggcaccttccgccagcgcccctccatgcgctgcgttcctcctccagatcgacccctagatgcctacacaatatctttaaagtaacacagaagtttttattttattaaaaagtatagcctacttaaacgcgagatgacatatatagagtttaattttacggtccctccgcaggggagcggcctccagccttattctccaccgctcggatctgtgtggtttcagtctgttcttggtgtggtcctcatacacagagctccctgtctagtttcttttctttttcttttttctttttctcgtcacacaggtaaccttaaagacagacccctctaaagaacgctttgtaaatacatgtgaggtatagccaccactgttttccttgctgttatttttccaagtcttggggagaaaacatcctcctctgatggccaaagccctggaatcaagggtttccacgtaccctgcctaatacccgacgtagctcttgatgcaccgtccttgtgctgtggctggcggtgtctcagcctgaaacataaaccccacatgccccaggagcgatgtgctccctgaaacagacaaccacacgctgttggggagagaaggatggagataggatggagataggatggagatgtggctcttctcatctttgaagccagcagggcatcccggagcaggaggctggccgggctccccaagcgaaggcgttggtgtctgtcattaggtgtgtgttagggtgcagcaccggccgtcacaggatgctgataagcgcgctgagaggtggatgaaacaccaaagtctgtttccccgtccgcagtgggtgttgcctctttgtgtgtgtcccgatgttcctgcctgtgagtcggccttactccgtttccttagcgcccatgacacgccaagtcccgtttcgcactcggcttctcacccgcccagctcggctagggagggggagtttttagcacctaatatgcttcctgccattgcgcaatctgagcctgagcaactggaaacccccatttctcattagtgcaatgtcatatctgatcccaggaagcctggaaaataaaagacgatgcattataacttgcggaagtacaa

SEQ ID NO: 103872 - DNA, 2472 bp, Homo sapiens
  Payload ID: 420
  Gene Symbol: ABLIM2
  Gene Name: actin binding LIM protein family, member 2
  Uniprot ID: Q6H8Q1
  ENST ID: ENST00000361581
  CDS Start-End: 66-1784
acctgcgggcccgagggtctggctgtcgcagcgccgggccgccccgactccgagcggctgctgagatgagtgcagtgtcgcagccccaggctgctcccagcccgctggagaagtcgcccagcacggcgatcctgtgcaacacgtgtgggaatgtgtgcaagggcgaggtgctgcgggtgcaggacaagtacttccacatcaagtgcttcgtctgtaaagcatgtggctgcgacctggccgagggcggcttcttcgtgcggcagggcgagtacatctgcacgctggactaccagaggctctacggcacccgctgcttcagctgcgaccagttcattgagggtgaggtggtgtcggcgctgggcaagacctaccaccccgactgcttcgtgtgtgccgtctgccggctgcccttcccccccggggaccgagtgaccttcaacgggaaggaatgcatgtgccagaagtgttccctgcccgtatcggtgggcagcagcgcgcacctgtcccagggcctccgaagttgtgggggctgcggcacagaaatcaagaatggccaggccctggtagccttggacaagcactggcacttgggctgttttaagtgcaagagctgtgggaagctcctgaatgccgagtacatcagcaaggatgggctgccctactgcgaagctgactatcacgccaagttcggcatccgctgtgacagctgtgagaaatacatcacggggcgcgtgctggaggccggagagaagcactaccacccttcctgcgcgctatgtgtcaggtgcggccagatgtttgcagaaggcgaagagatgtatcttcaaggttcctccatctggcatccggcgtgtcgacaagcagccagaactgaagacagaaacaaggaaaccagaacttcctcagagagcatcatttctgtccctgcttccagcacctcagggtctccgagccgtgtgatttatgccaagcttggtggtgagatcctggactacagggacttggcagcccttcctaaaagtaaggccatctatgacatcgaccgccccgacatgatctcctactcaccctacatcagccactctgcaggggacaggcagagctacggcgagggggatcaggatgaccggtcctacaagcagtgtcggacctccagcccaagctccactgggtcggttagcctcgggcgctacactccgacctcacggtcaccacagcactacagccgtccaggcagtgaaagtggccggagcacccccagcctctccgtgctctctgacagcaagccgcccccctccacctaccagcaggcacctcgccacttccacgtcccagacactggcgtaaaagataacatctataggaaaccccctatctacagacagcatgctgccaggcgatcggatggggaggatggaagcttggaccaggataacaggaagaagagcagctggctgatgctcaagggggatgcagacacaaggaccaattctccagacctggacacccagtccttgtcccacagcagcgggaccgacagagaccctctccaaaggatggcaggggacagctttcactcacaatacaagatctatccgtatgactccctcatcgtcacaaaccgaattcgcgtgaaactgcccaaagacgtggaccggacgagactggagagacacttgtcgcccgaggagttccaggaagtgtttgggatgagcatcgaggagtttgaccgcctggccctctggaagaggaatgaccttaagaagaaagcccttttgttctgacggctgccagcctgccccactggtgtgtgccgggcgccgaggccaggggcccctggcgagaaccgcacacacccctcccacacaccttgctctggcttctctgtgtccatggggtgggcgggagggggtcccccagcaggtgcggcccctgcacctgccggcgacactcctgccggtagtttagggccgagacggctagcttcacgccacccttccccgctgtggcttggtgtcagggagaggctgtagagtggctgtgtcgggcatcagatggagcacacaggtggctgcagcccagcccaccttcccagcgttctcgaggtgccctggccccggtgctgggcacgtgggggacagaggtggccgggacgtgagctgtgaggcttgttgatgatggttgctgacaccatcatcgggggtgggcacacggcccttcggagcctgggcagcctggcctcacaggcagactcgcagacggggcagtgagcgtctgggacagtgccaagagtggggtgtgtgatttttgcaggcgtctgtgatgggtctctttagggacaaatgtcaacaagggacaagacagggcaccttccgccagcgcccctccatgcgctgcgttcctcctccagatcgacccctagatgcctacacaatatctttaaagtaacacagaagtttttattttattaaa

SEQ ID NO: 103873 - DNA, 2291 bp, Homo sapiens
  Payload ID: 420
  Gene Symbol: ABLIM2
  Gene Name: actin binding LIM protein family, member 2
  Uniprot ID: Q6H8Q1
  ENST ID: ENST00000407564
  CDS Start-End: 95-1660
gggcgggcggaggatagcgcgggcgcggcacctgcgggcccgagggtctggctgtcgcagcgccgggccgccccgactccgagcggctgctgagatgagtgcagtgtcgcagccccaggctgctcccagcccgctggagaagtcgcccagcacggcgatcctgtgcaacacgtgtgggaatgtgtgcaagggcgaggtgctgcgggtgcaggacaagtacttccacatcaagtgcttcgtctgtaaagcatgtggctgcgacctggccgagggcggcttcttcgtgcggcagggcgagtacatctgcacgctggactaccagaggctctacggcacccgctgcttcagctgcgaccagttcattgagggtgaggtggtgtcggcgctgggcaagacctaccaccccgactgcttcgtgtgtgccgtctgccggctgcccttcccccccggggaccgagtgaccttcaacgggaaggaatgcatgtgccagaagtgttccctgcccgtatcggtgggcagcagcgcgcacctgtcccagggcctccgaagttgtgggggctgcggcacagaaatcaagaatggccaggccctggtagccttggacaagcactggcacttgggctgttttaagtgcaagagctgtgggaagctcctgaatgccgagtacatcagcaaggatgggctgccctactgcgaagctgactatcacgccaagttcggcatccgctgtgacagctgtgagaaatacatcacggggcgcgtgctggaggccggagagaagcactaccacccttcctgcgcgctatgtgtcaggtgcggccagatgtttgcagaaggcgaagagatgtatcttcaaggttcctccatctggcatccggcgtgtcgacaagcagccagaactgaagacagaaacaaggaaaccagaacttcctcagagagcatcatttctgtccctgcttccagcacctcagggtctccgagccgtgtgatttatgccaagcttggtggtgagatcctggactacagggacttggcagcccttcctaaaagtaaggccatctatgacatcgaccgccccgacatgatctcctactcaccctacatcagccactctgcaggggacaggcagagctacggcgagggggatcaggatgaccggtcctacaagcagtgtcggacctccagcccaagctccactgggtcggttagcctcgggcgctacactccgacctcacggtcaccacagcactacagccgtccagctgccaggcgatcggatggggaggatggaagcttggaccaggataacaggaagcagaagagcagctggctgatgctcaagggggatgcagacacaaggaccaattctccagacctggacacccagtccttgtcccacagcagcgggaccgacagagaccctctccaaaggatggcaggggacagctttcactcacaatacaagatctatccgtatgactccctcatcgtcacaaaccgaattcgcgtgaaactgcccaaagacgtggaccggacgagactggagagacacttgtcgcccgaggagttccaggaagtgtttgggatgagcatcgaggagtttgaccgcctggccctctggaagaggaatgaccttaagaagaaagcccttttgttctgacggctgccagcctgccccactggtgtgtgccgggcgccgaggccaggggcccctggcgagaaccgcacacacccctcccacacaccttgctctggcttctctgtgtccatggggtgggcgggagggggtcccccagcaggtgcggcccctgcacctgccggcgacactcctgccggtagtttagggccgagacggctagcttcacgccacccttccccgctgtggcttggtgtcagggagaggctgtagagtggctgtgtcgggcatcagatggagcacacaggtggctgcagcccagcccaccttcccagcgttctcgaggtgccctggccccggtgctgggcacgtgggggacagaggtggccgggacgtgagctgtgaggcttgttgatgatggttgctgacaccatcatcgggggtgggcacacggcccttcggagcctgggcagcctggcctcacaggcagactcgcagacggggcagtgagcgtctgggacagtgccaagagtggggtgtgtgatttttgcaggcgtctgtgatgggtctctttagggacaaatgtcaacaagggacaagacagggcaccttccgccagcgcccctccatgcgctgcgttcctcctccagatcga

SEQ ID NO: 103874 - DNA, 2573 bp, Homo sapiens
  Payload ID: 420
  Gene Symbol: ABLIM2
  Gene Name: actin binding LIM protein family, member 2
  Uniprot ID: Q6H8Q1
  ENST ID: ENST00000428004
  CDS Start-End: 144-1556
tgcggcggcgctgcctggcgtgtgcgcaaggagcgggcgcggagccggcgggcgggcggaggatagcgcgggcgcggcacctgcgggcccgagggtctggctgtcgcagcgccgggccgccccgactccgagcggctgctgagatgagtgcagtgtcgcagccccaggctgctcccagcccgctggagaagtcgcccagcacggcgatcctgtgcaacacgtgtgggaatgtgtgcaagggcgaggtgctgcgggtgcaggacaagtacttccacatcaagtgcttcgtctgtaaagcatgtggctgcgacctggccgagggcggcttcttcgtgcggcagggcgagtacatctgcacgctggactaccagaggctctacggcacccgctgcttcagctgcgaccagttcattgagggtgaggtggtgtcggcgctgggcaagacctaccaccccgactgcttcgtgtgtgccgtctgccggctgcccttcccccccggggaccgagtgaccttcaacgggaaggaatgcatgtgccagaagtgttccctgcccgtatcggtgggcagcagcgcgcacctgtcccagggcctccgaagttgtgggggctgcggcacagaaatcaagaatggccaggccctggtagccttggacaagcactggcacttgggctgttttaagtgcaagagctgtgggaagctcctgaatgccgagtacatcagcaaggatgggctgccctactgcgaagctgactatcacgccaagttcggcatccgctgtgacagctgtgagaaatacatcacggggcgcgtgctggaggccggagagaagcactaccacccttcctgcgcgctatgtgtcaggtgcggccagatgtttgcagaaggcgaagagatgtatcttcaaggttcctccatctggcatccggcgtgtcgacaagcagccagaactgaagacagaaacaaggaaaccagaacttcctcagagagcatcatttctgtccctgcttccagcacctcagggtctccgagccgtgtgatttatgccaagcttggtggtgagatcctggactacagggacttggcagcccttcctaaaagtaaggccatctatgacatcgaccgccccgacatgatctcctactcaccctacatcagccactctgcaggggacaggcagagctacggcgagtcccctcagttgctctcgccaacgccgaccgagggggatcaggatgaccggtcctacaagcagtgtcggacctccagcccaagctccactgggtcggttagcctcgggcgctacactccgacctcacggtcaccacagcactacagccgtccagctgccaggcgatcggatggggaggatggaagcttggaccaggataacaggaagcagaagagcagctggctgatgctcaagggggatgcagacacaaggaccaattctccagacctggacacccagtccttgtcccacagcagcgggaccgacagagaccctctccaaaggatggcaggggacagctttcactcacgtgagtggttcttttgaagaaggagccgtgatgtgcacaaaatgcctcgcggcaaagaggccccagaactcagagctatccccctacatctaagccttgcctgttaaaaagcatgaaagcaaagcccacaaatctaaggaccgaccggaaggaaatatggggcttttgcagtttgccggcttcccaagaactgtccccgagccagtgtgctaacgagggccacgcctgcatgtcccctcacagatttccaaggtgtgcaagaatgcagaaacccagacctgctcctgggctgtttaggagaaaggcgtccgggctgccgggtggaagtcagggcctgttccctccagagcagacatgggcatggtccggctgatgagtgcagacttggagttggtgatgggcaccatccctgtcccctgtgactcatcctgaacgaggcacagcctcaggcttcatagagagacagtgatggtgtctgcctgaccctaggggtgttttgaagactgaatcaggagtgattttcaaatgtagagaaaactccagataatgctgtttgcttccggccgctgtaaatcataggtgaaaaccagtagcaagtgctcactcagtgcctcccagaagcggtctgcgggtctcagctgggctgggggcagttttcattgggcaaggcttgggcttagcttcgaagcaggggctgggagaggatggatgggggtgtgagagcagaagaaagacctggctttgcagtgaggcagtcccaagttcaaatctgagctcaccactgacccgtcgtgtgatgggcgccaggtgttaggagactggaactgggtatgtgtgtggcattcggccggccatagtagctgctcagtaaacagaaactgtttctcatcctcatcctcatcctcatgcctgcaaactgtaaaccgtcctacttaacaatgaaagtagaaaagtgtttcaatgtgacaggaaagagtgaagacacagaagcttggaaatgatgatgtgttaaagaatcactttaaacaaagaaa

SEQ ID NO: 103875 - DNA, 2902 bp, Homo sapiens
  Payload ID: 420
  Gene Symbol: ABLIM2
  Gene Name: actin binding LIM protein family, member 2
  Uniprot ID: Q6H8Q1
  ENST ID: ENST00000447017
  CDS Start-End: 21-1958
gactccgagcggctgctgagatgagtgcagtgtcgcagccccaggctgctcccagcccgctggagaagtcgcccagcacggcgatcctgtgcaacacgtgtgggaatgtgtgcaagggcgaggtgctgcgggtgcaggacaagtacttccacatcaagtgcttcgtctgtaaagcatgtggctgcgacctggccgagggcggcttcttcgtgcggcagggcgagtacatctgcacgctggactaccagaggctctacggcacccgctgcttcagctgcgaccagttcattgagggtgaggtggtgtcggcgctgggcaagacctaccaccccgactgcttcgtgtgtgccgtctgccggctgcccttcccccccggggaccgagtgaccttcaacgggaaggaatgcatgtgccagaagtgttccctgcccgtatcggtgggcagcagcgcgcacctgtcccagggcctccgaagttgtgggggctgcggcacagaaatcaagaatggccaggccctggtagccttggacaagcactggcacttgggctgttttaagtgcaagagctgtgggaagctcctgaatgccgagtacatcagcaaggatgggctgccctactgcgaagctgactatcacgccaagttcggcatccgctgtgacagctgtgagaaatacatcacggggcgcgtgctggaggccggagagaagcactaccacccttcctgcgcgctatgtgtcaggtgcggccagatgtttgcagaaggcgaagagatgtatcttcaaggttcctccatctggcatccggcgtgtcgacaagcagccagaactgaagacagaaacaaggaaaccagaacttcctcagagagcatcatttctgtccctgcttccagcacctcagggtctccgagccgtgtgatttatgccaagcttggtggtgagatcctggactacagggacttggcagcccttcctaaaagtaaggccatctatgacatcgaccgccccgacatgatctcctactcaccctacatcagccactctgcaggggacaggcagagctacggcgagggggatcaggatgaccggtcctacaagcagtgtcggacctccagcccaagctccactgggtcggttagcctcgggcgctacactccgacctcacggtcaccacagcactacagccgtccagctggtactgtgagtgtgggtaccagtagctgcctctccctgtcccaacacccaagccctacatccgtgttcagacatcattacatcccctacttccgaggcagtgaaagtggccggagcacccccagcctctccgtgctctctgacagcaagccgcccccctccacctaccagcaggcacctcgccacttccacgtcccagacactggcgtaaaagataacatctataggaaaccccctatctacagacagcatgctgccaggcgatcggatggggaggatggaagcttggaccaggataacaggaagcagaagagcagctggctgatgctcaagggggatgcagacacaaggaccaattctccagacctggacacccagtccttgtcccacagcagcgggaccgacagagaccctctccaaaggatggcaggggacagctttcactcacgattcccctattccaaatctgaccctctcccaggacatggaaagaatggcttggaccagcggaatgccaatctggccccctgtggagcagacccggatgccagctggggcatgcgagaatacaagatctatccgtatgactccctcatcgtcacaaaccgaattcgcgtgaaactgcccaaagacgtggaccggacgagactggagagacacttgtcgcccgaggagttccaggaagtgtttgggatgagcatcgaggagtttgaccgcctggccctctggaagaggaatgaccttaagaagaaagcccttttgttctgacggctgccagcctgccccactggtgtgtgccgggcgccgaggccaggggcccctggcgagaaccgcacacacccctcccacacaccttgctctggcttctctgtgtccatggggtgggcgggagggggtcccccagcaggtgcggcccctgcacctgccggcgacactcctgccggtagtttagggccgagacggctagcttcacgccacccttccccgctgtggcttggtgtcagggagaggctgtagagtggctgtgtcgggcatcagatggagcacacaggtggctgcagcccagcccaccttcccagcgttctcgaggtgccctggccccggtgctgggcacgtgggggacagaggtggccgggacgtgagctgtgaggcttgttgatgatggttgctgacaccatcatcgggggtgggcacacggcccttcggagcctgggcagcctggcctcacaggcagactcgcagacggggcagtgagcgtctgggacagtgccaagagtggggtgtgtgatttttgcaggcgtctgtgatgggtctctttagggacaaatgtcaacaagggacaagacagggcaccttccgccagcgcccctccatgcgctgcgttcctcctccagatcgacccctagatgcctacacaatatctttaaagtaacacagaagtttttattttattaaaaagtatagcctacttaaacgcgagatgacatatatagagtttaattttacggtccctccgcaggggagcggcctccagccttattctccaccgctcggatctgtgtggtttcagtctgttcttggtgtggtcctcatacacagagctccctgtctagtttcttttctttttcttttttctttttctcgtcacacaggtaaccttaaagacagacccctctaaagaacgctttgtaaatacatgtgaggtatagcca

SEQ ID NO: 103876 - DNA, 1680 bp, Homo sapiens
  Payload ID: 420
  Gene Symbol: ABLIM2
  Gene Name: actin binding LIM protein family, member 2
  Uniprot ID: Q6H8Q1
  ENST ID: ENST00000505872
  CDS Start-End: 1-1680
atgagtgcagtgtcgcagccccaggctgctcccagcccgctggagaagtcgcccagcacggcgatcctgtgcaacacgtgtgggaatgtgtgcaagggcgaggtgctgcgggtgcaggacaagtacttccacatcaagtgcttcgtctgtaaagcatgtggctgcgacctggccgagggcggcttcttcgtgcggcagggcgagtacatctgcacgctggactaccagaggctctacggcacccgctgcttcagctgcgaccagttcattgagggtgaggtggtgtcggcgctgggcaagacctaccaccccgactgcttcgtgtgtgccgtctgccggctgcccttcccccccggggaccgagtgaccttcaacgggaaggaatgcatgtgccagaagtgttccctgcccgtatcggtgggcagcagcgcgcacctgtcccagggcctccgaagttgtgggggctgcggcacagaaatcaagaatggccaggccctggtagccttggacaagcactggcacttgggctgttttaagtgcaagagctgtgggaagctcctgaatgccgagtacatcagcaaggatgggctgccctactgcgaagctgactatcacgccaagttcggcatccgctgtgacagctgtgagaaatacatcacggggcgcgtgctggaggccggagagaagcactaccacccttcctgcgcgctatgtgtcaggtgcggccagatgtttgcagaaggcgaagagatgtatcttcaaggttcctccatctggcatccggcgtgtcgacaagcagccagaactgaagacagaaacaaggaaaccagaacttcctcagagagcatcatttctgtccctgcttccagcacctcagggtctccgagccgtgtgatttatgccaagcttggtggtgagatcctggactacagggacttggcagcccttcctaaaagtaaggccatctatgacatcgaccgccccgacatgatctcctactcaccctacatcagccactctgcaggggacaggcagagctacggcgagggggatcaggatgaccggtcctacaagcagtgtcggacctccagcccaagctccactgggtcggttagcctcgggcgctacactccgacctcacggtcaccacagcactacagccgtccagctgccaggcgatcggatggggaggatggaagcttggaccaggataacaggaagaagagcagctggctgatgctcaagggggatgcagacacaaggaccaattctccagacctggacacccagtccttgtcccacagcagcgggaccgacagagaccctctccaaaggatggcaggggacagctttcactcacgattcccctattccaaatctgaccctctcccaggacatggaaagaatggcttggaccagcggaatgccaatctggccccctgtggagcagacccggatgccagctggggcatgcgagaatacaagatctatccgtatgactccctcatcgtcacaaaccgaattcgcgtgaaactgcccaaagacgtggaccggacgagactggagagacacttgtcgcccgaggagttccaggaagtgtttgggatgagcatcgaggagtttgaccgcctggccctctggaagaggaatgaccttaagaagaaagcccttttgttctga

SEQ ID NO: 103877 - DNA, 1028 bp, Homo sapiens
  Payload ID: 420
  Gene Symbol: ABLIM2
  Gene Name: actin binding LIM protein family, member 2
  ENST ID: ENST00000510277
  CDS Start-End: 114-1028
ggagcacggcactcaagcagggccgtcagactgggctctggtgcccagaagctgtgcaggccggagagaagcactaccacccttcctgcgcgctatgtgtcaggtgcggccagatgtttgcagaaggcgaagagatgtatcttcaaggttcctccatctggcatccggcgtgtcgacaagcagccagaactgaagacagaaacaaggaaaccagaacttcctcagagagcatcatttctgtccctgcttccagcacctcagggtctccgagccgtgtgatttatgccaagcttggtggtgagatcctggactacagggacttggcagcccttcctaaaagtaaggccatctatgacatcgaccgccccgacatgatctcctactcaccctacatcagccactctgcaggggacaggcagagctacggcgagtcccctcagttgctctcgccaacgccgaccgagggggatcaggatgaccggtcctacaagcagtgtcggacctccagcccaagctccactgggtcggttagcctcgggcgctacactccgacctcacggtcaccacagcactacagccgtccagctggtactgtgagtgtgggtaccagtagctgcctctccctgtcccaacacccaagccctacatccgtgttcagacatcattacatcccctacttccgaggcagtgaaagtggccggagcacccccagcctctccgtgctctctgacagcaagccgcccccctccacctaccagcaggcacctcgccacttccacgtcccagacactggcgtaaaagataacatctataggaaaccccctatctacagacagcatgctgccaggcgatcggatggggaggatggaagcttggaccaggataacaggaagaagagcagctggctgatgctcaagggggatgcagacacaaggaccaattctccagacctggacacccagtccttgtcccacagcagcgggaccgacagagaccctctccaaaggatggcaggggacagctttcac

SEQ ID NO: 103878 - DNA, 2974 bp, Homo sapiens
  Payload ID: 420
  Gene Symbol: ABLIM2
  Gene Name: actin binding LIM protein family, member 2
  Uniprot ID: Q6H8Q1
  ENST ID: ENST00000514025
  CDS Start-End: 273-1313
agaaggggagctgccgccgccgcggtggcactgcctgatgctcggcccagtgtgccggtgccccgctgggtgacagtggactcccagggcgcagcaggagcaggtgacagactgttggctgaaggtgagggtgtccaccctcgcaggcacacgttccagggagcacggcactcaagcagggccgtcagactgggctctggtgcccagaagctgtgcaggccggagagaagcactaccacccttcctgcgcgctatgtgtcaggtgcggccagatgtttgcagaaggcgaagagatgtatcttcaaggttcctccatctggcatccggcgtgtcgacaagcagccagaactgaagacagaaacaaggaaaccagaacttcctcagagagcatcatttctgtccctgcttccagcacctcagggtctccgagccgtgtgatttatgccaagcttggtggtgagatcctggactacagggacttggcagcccttcctaaaagtaaggccatctatgacatcgaccgccccgacatgatctcctactcaccctacatcagccactctgcaggggacaggcagagctacggcgagtcccctcagttgctctcgccaacgccgaccgagggggatcaggatgaccggtcctacaagcagtgtcggacctccagcccaagctccactgggtcggttagcctcgggcgctacactccgacctcacggtcaccacagcactacagccgtccagacactggcgtaaaagataacatctataggaaaccccctatctacagacagcatgctgccaggcgatcggatggggaggatggaagcttggaccaggataacaggaagcagaagagcagctggctgatgctcaagggggatgcagacacaaggaccaattctccagacctggacacccagtccttgtcccacagcagcgggaccgacagagaccctctccaaaggatggcaggggacagctttcactcacgattcccctattccaaatctgaccctctcccaggacatggaaagaatggcttggaccagcggaatgccaatctggccccctgtggagcagacccggatgccagctggggcatgcgagaatacaagatctatccgtatgactccctcatcgtcacaaaccgaattcgcgtgaaactgcccaaagacgtggaccggacgagactggagagacacttgtcgcccgaggagttccaggaagtgtttgggatgagcatcgaggagtttgaccgcctggccctctggaagaggaatgaccttaagaagaaagcccttttgttctgacggctgccagcctgccccactggtgtgtgccgggcgccgaggccaggggcccctggcgagaaccgcacacacccctcccacacaccttgctctggcttctctgtgtccatggggtgggcgggagggggtcccccagcaggtgcggcccctgcacctgccggcgacactcctgccggtagtttagggccgagacggctagcttcacgccacccttccccgctgtggcttggtgtcagggagaggctgtagagtggctgtgtcgggcatcagatggagcacacaggtggctgcagcccagcccaccttcccagcgttctcgaggtgccctggccccggtgctgggcacgtgggggacagaggtggccgggacgtgagctgtgaggcttgttgatgatggttgctgacaccatcatcgggggtgggcacacggcccttcggagcctgggcagcctggcctcacaggcagactcgcagacggggcagtgagcgtctgggacagtgccaagagtggggtgtgtgatttttgcaggcgtctgtgatgggtctctttagggacaaatgtcaacaagggacaagacagggcaccttccgccagcgcccctccatgcgctgcgttcctcctccagatcgacccctagatgcctacacaatatctttaaagtaacacagaagtttttattttattaaaaagtatagcctacttaaacgcgagatgacatatatagagtttaattttacggtccctccgcaggggagcggcctccagccttattctccaccgctcggatctgtgtggtttcagtctgttcttggtgtggtcctcatacacagagctccctgtctagtttcttttctttttcttttttctttttctcgtcacacaggtaaccttaaagacagacccctctaaagaacgctttgtaaatacatgtgaggtatagccaccactgttttccttgctgttatttttccaagtcttggggagaaaacatcctcctctgatggccaaagccctggaatcaagggtttccacgtaccctgcctaatacccgacgtagctcttgatgcaccgtccttgtgctgtggctggcggtgtctcagcctgaaacataaaccccacatgccccaggagcgatgtgctccctgaaacagacaaccacacgctgttggggagagaaggatggagataggatggagataggatggagatgtggctcttctcatctttgaagccagcagggcatcccggagcaggaggctggccgggctccccaagcgaaggcgttggtgtctgtcattaggtgtgtgttagggtgcagcaccggccgtcacaggatgctgataagcgcgctgagaggtggatgaaacaccaaagtctgtttccccgtccgcagtgggtgttgcctctttgtgtgtgtcccgatgttcctgcctgtgagtcggccttactccgtttccttagcgcccatgacacgccaagtcccgtttcgcactcggcttctcacccgcccagctcggctagggagggggagtttttagcacctaatatgcttcctgccattgcgcaatctgagcctgagcaactggaaacccccatttctcattagtgcaatgtcatatctgatcccaggaagcctggaaaataaaagacgatgcattat

SEQ ID NO: 103879 - DNA, 1972 bp, Homo sapiens
  Payload ID: 420
  Gene Symbol: ABLIM2
  Gene Name: actin binding LIM protein family, member 2
  ENST ID: ENST00000545242
  CDS Start-End: 21-1961
gactccgagcggctgctgagatgagtgcagtgtcgcagccccaggctgctcccagcccgctggagaagtcgcccagcacggcgatcctgtgcaacacgtgtgggaatgtgtgcaagggcgaggtgctgcgggtgcaggacaagtacttccacatcaagtgcttcgtctgtaaagcatgtggctgcgacctggccgagggcggcttcttcgtgcggcagggcgagtacatctgcacgctggactaccagaggctctacggcacccgctgcttcagctgcgaccagttcattgagggtgaggtggtgtcggcgctgggcaagacctaccaccccgactgcttcgtgtgtgccgtctgccggctgcccttcccccccggggaccgagtgaccttcaacgggaaggaatgcatgtgccagaagtgttccctgcccgtatcggtgggcagcagcgcgcacctgtcccagggcctccgaagttgtgggggctgcggcacagaaatcaagaatggccaggccctggtagccttggacaagcactggcacttgggctgttttaagtgcaagagctgtgggaagctcctgaatgccgagtacatcagcaaggatgggctgccctactgcgaagctgactatcacgccaagttcggcatccgctgtgacagctgtgagaaatacatcacggggcgcgtgctggaggccggagagaagcactaccacccttcctgcgcgctatgtgtcaggtgcggccagatgtttgcagaaggcgaagagatgtatcttcaaggttcctccatctggcatccggcgtgtcgacaagcagccagaactgaagacagaaacaaggaaaccagaacttcctcagagagcatcatttctgtccctgcttccagcacctcagggtctccgagccgtgtgatttatgccaagcttggtggtgagatcctggactacagggacttggcagcccttcctaaaagtaaggccatctatgacatcgaccgccccgacatgatctcctactcaccctacatcagccactctgcaggggacaggcagagctacggcgagggggatcaggatgaccggtcctacaagcagtgtcggacctccagcccaagctccactgggtcggttagcctcgggcgctacactccgacctcacggtcaccacagcactacagccgtccagctggtactgtgagtgtgggtaccagtagctgcctctccctgtcccaacacccaagccctacatccgtgttcagacatcattacatcccctacttccgaggcagtgaaagtggccggagcacccccagcctctccgtgctctctgacagcaagccgccccccccacctaccagcaggcacctcgccacttccacgtcccaggccccagacactggcgtaaaagataacatctataggaaaccccctatctacagacagcatgctgccaggcgatcggatggggaggatggaagcttggaccaggataacaggaagcagaagagcagctggctgatgctcaagggggatgcagacacaaggaccaattctccagacctggacacccagtccttgtcccacagcagcgggaccgacagagaccctctccaaaggatggcaggggacagctttcactcacgattcccctattccaaatctgaccctctcccaggacatggaaagaatggcttggaccagcggaatgccaatctggccccctgtggagcagacccggatgccagctggggcatgcgagaacagatctatccgtatgactccctcatcgtcacaaaccgaattcgcgtgaaactgcccaaagacgtggaccggacgagactggagagacacttgtcgcccgaggagttccaggaagtgtttgggatgagcatcgaggagtttgaccgcctggccctctggaagaggaatgaccttaagaagaaagcccttttgttctgacggctgccagc

SEQ ID NO: 103880 - DNA, 4326 bp, Homo sapiens
  Payload ID: 421
  Gene Symbol: ABLIM3
  Gene Name: actin binding LIM protein family, member 3
  Uniprot ID: O94929
  ENST ID: ENST00000309868
  CDS Start-End: 240-2291
ctgccaacccgcgagcccgcatcatggatgtcgagctcccctatttcgcattgctagccctggaattcgagaccccagacgaggaccaggattcatgaaatcagtcgcaggggccggggcaggggcctctggctcccgacactggccgagaggtgatgagtgaggttcgaagaacggaagatttaaaaagcagccggggcctccgtattgaatgaaagacccagtgcaaagacatcaccatgaacactagcattccttatcagcagaatccttacaatccacggggcagctccaatgtcatccagtgctaccgctgtggagacacctgcaaaggggaagtggtccgcgtgcacaacaaccacttccacatcagatgcttcacctgtcaagtatgtggctgtggcctggcccagtcaggcttcttcttcaagaaccaggagtacatctgcacccaggactaccagcaactctatggcacccgctgtgacagctgccgggacttcatcacaggcgaagtcatctcggccctgggccgcacttaccaccccaagtgcttcgtgtgcagcttgtgcaggaagcctttccccattggagacaaggtgaccttcagcggtaaagaatgtgtgtgccaaacgtgctcccagtccatggccagcagtaagcccatcaagattcgtggaccaagccactgtgccgggtgcaaggaggagatcaagcacggccagtcactcctggctctggacaagcagtggcacgtcagctgcttcaagtgccagacctgcagcgtcatcctcaccggggagtatatcagcaaggatggtgttccatactgtgagtccgactaccatgcccagtttggcattaaatgtgagacttgtgaccgatacatcagtggcagagtcttggaggcaggagggaagcactaccacccaacctgtgccaggtgtgtacgctgccaccagatgttcaccgaaggagaggaaatgtacctcacaggttccgaggtttggcaccccatctgcaaacaggcagcccgggcagagaagaagttaaagcatagacggacatctgaaacctccatctcaccccctggatccagcattgggtcacccaaccgagtcatctgcgctaaagtggataatgagatccttaattacaaagacctggcggctctccccaaggttaagtctatctacgaggtacaacgccccgacctcatttcctatgagcctcattccagatacatgtccgacgagatgctggagagatgtggctatggagagtcgctgggaacattatctccctactcccaggacatctacgagaacctggacctccggcagagacgggcctccagcccggggtacatagactcccccacctacagccggcagggcatgtcccccaccttctcccgctcacctcaccactactaccgctctgggcccgagagtggccggagctctccataccatagccagttagatgtgaggtcctccactccaacctcttaccaggctcccaagcactttcacatcccagctggagacagtaacatctaccggaaacccccgatctacaaacggcatggtgatttgtctacagcaaccaagagcaaaacaagtgaagacatcagccagacctccaagtacagtcccatctactcgccagacccctactatgcttcggagtctgagtactggacctaccatgggtcccccaaagtgccccgagccagaaggttctcgtctggaggagaggaggatgattttgaccgcagcatgcacaagctccaaagtggaattggccggctgattctgaaggaagaaatgaaggcccggtcgagctcctatgcagatccctggacccctccccggagctccaccagcagccgggaagccctgcacacagctggctatgagatgtccctcaatggctcccctcggtcgcactacctggctgacagtgatcctctcatctccaaatctgcctccctgcctgcctaccgaagaaatgggctgcacaggacacccagcgcagacctcttccactacgacagcatgaacgcagtcaactggggcatgcgagagtacaagatctacccttatgaactgctgctggtgactacaagaggaagaaaccgactgcccaaggatgtagacaggacccgtttagagcgccacctgtcccaggaagagttctaccaagtctttggcatgaccatctctgagtttgaccggctggccctctggaagaggaatgaactgaagaagcaagcccggctgttctaggcagaggctctataaatatatatgcatttatataaagatatatgtaaaatctctctactgaagctcggtataatcctctcttgtgtaatgggacacactgcctgccatgagacttgcttttctgtactgtcaggcaagcccacgtcatcgagatatttttatgctccttactttctcttttctaagtgctgtgggatctgggaagggatttgaggggactctgtccttttattggggatcctttttatactgaaacatctgtcctaacttgagtgccccaaggtccaactctctttcctaaagaaggtgcctgaagaagtctctcttctctctgcttcgtggcccctttcttaaatttctagggctgatgctgaccatgtggtttccacaccttattggccccagaggggccctcccatgggaagatctgcagcagtctccccaaatcagtgagcacctttgagcgcccacgaagaactttctcaacacccccaattaggagctcagtgctctcttggggcaatgcagttaaaagggtgagcctcaaatctagtcattacaccagtcaacagaagtggacagggcctaggcctctcctcagctccttaaccctcctccttctgccctggattgtaacctctcccttgtccaaatctaggattcctggtaggaaaaggaaaaggcccttcccttccctccaccacttccaactggcccctttgcctgacctggacttggagaaccagaggaaaagagagggagcggaagtgggagatggagcagggcacctgttagaatcagagctgcaggatttcttgggaccctcctctctccctcactgctcccagcacctcctgacccttccctctttcaaggagaagcccatgattgcagcttgtattctttagccttattacaatctatgtgcctgacaactcaacacaccgcagggctaatgttcccaccagagctccaactgaacaaccagacagacaactctcatcatcctccagagagaaaataggccgtgtctcaaagaaaggttcttggtctatgcctctggtctgtgggctggcagggcaaccataccatacccccgccagtcctcggctcctgctgcaaagttggccatgtttcacagggaaacttttggaagagtggctgcttatgagattccaaaatgaagtgttggccaacaccgctcatggccatcctggattttcccagtggcttcccttcctgctcgcctccctgaacaggggagaaagcttaacctctcttctcctctccaaacctttcaccttgaatgggtaatgtttggtgggggctgttccttcttggagaagccttgagtcggaccattttgagatcatggaggaaggatgaagaagtgaaaatgacaataatgactctcaagaggctggcgatgtgacatggcaaatgtagaactgacttaaattgaacaaaccctcactgagcacctctgatgttgagcacctgctgaatactgagcactgaatgggggagggggaggggagcacggggtgagtcaacctgggactcggtctcagggatatgcctaccaatagcgggtatcgtaaggcatgtacccaaacataacggatgtaaggcagaaagtgatcggagaaggaatgagaaagtgtgcgtgatgttaatgaaaagtcatatgcagctagagcagacccaggaaagctttctggaagagattgcatctgaggaaattcaggaaggatctttgtagattggggggagattctaaattgaaggggtgatggggtgaggggccagagggaagtctgctgtgttctcatgtaggatgtcagccctccctgcaacttctctttttggccaatgtcttttcactttcctgaccctttagaatcatccccagccagacgcaatcatggaagttgccttattgtcactggttaagaacttggcgagattgaagggcttttgttattgttgttggatatttttgtttcccataaaagcacatcatttcaaccctaaa

SEQ ID NO: 103881 - DNA, 4164 bp, Homo sapiens
  Payload ID: 421
  Gene Symbol: ABLIM3
  Gene Name: actin binding LIM protein family, member 3
  Uniprot ID: O94929
  ENST ID: ENST00000326685
  CDS Start-End: 260-2026
gagcggccgcgccccctgcgctgccaacccgcgagcccgcatcatggatgtcgagctcccctatttcgcattgctagccctggaattcgagaccccagacgaggaccaggattcatgaaatcagtcgcaggggccggggcaggggcctctggctcccgacactggccgagaggtgatgagtgaggttcgaagaacggaagatttaaaaagcagccggggcctccgtattgaatgaaagacccagtgcaaagacatcaccatgaacactagcattccttatcagcagaatccttacaatccacggggcagctccaatgtcatccagtgctaccgctgtggagacacctgcaaaggggaagtggtccgcgtgcacaacaaccacttccacatcagatgcttcacctgtcaagtatgtggctgtggcctggcccagtcaggcttcttcttcaagaaccaggagtacatctgcacccaggactaccagcaactctatggcacccgctgtgacagctgccgggacttcatcacaggcgaagtcatctcggccctgggccgcacttaccaccccaagtgcttcgtgtgcagcttgtgcaggaagcctttccccattggagacaaggtgaccttcagcggtaaagaatgtgtgtgccaaacgtgctcccagtccatggccagcagtaagcccatcaagattcgtggaccaagccactgtgccgggtgcaaggaggagatcaagcacggccagtcactcctggctctggacaagcagtggcacgtcagctgcttcaagtgccagacctgcagcgtcatcctcaccggggagtatatcagcaaggatggtgttccatactgtgagtccgactaccatgcccagtttggcattaaatgtgagacttgtgaccgatacatcagtggcagagtcttggaggcaggagggaagcactaccacccaacctgtgccaggtgtgtacgctgccaccagatgttcaccgaaggagaggaaatgtacctcacaggttccgaggtttggcaccccatctgcaaacaggcagcccgggcagagaagaagttaaagcatagacggacatctgaaacctccatctcaccccctggatccagcattgggtcacccaaccgagtcatctgcgacatctacgagaacctggacctccggcagagacgggcctccagcccggggtacatagactcccccacctacagccggcagggcatgtcccccaccttctcccgctcacctcaccactactaccgctctgctggagacagtaacatctaccggaaacccccgatctacaaacggcatggtgatttgtctacagcaaccaagagcaaaacaagtgaagacatcagccagacctccaagtacagtcccatctactcgccagacccctactatgcttcggagtctgagtactggacctaccatgggtcccccaaagtgccccgagccagaaggttctcgtctggaggagaggaggatgattttgaccgcagcatgcacaagctccaaagtggaattggccggctgattctgaaggaagaaatgaaggcccggtcgagctcctatgcagatccctggacccctccccggagctccaccagcagccgggaagccctgcacacagctggctatgagatgtccctcaatggctcccctcggtcgcactacctggctgacagtgatcctctcatctccaaatctgcctccctgcctgcctaccgaagaaatgggctgcacaggacacccagcgcagacctcttccactacgacagcatgaacgcagtcaactggggcatgcgagagtacaagatctacccttatgaactgctgctggtgactacaagaggaagaaaccgactgcccaaggatgtagacaggacccgtttagagcgccacctgtcccaggaagagttctaccaagtctttggcatgaccatctctgagtttgaccggctggccctctggaagaggaatgaactgaagaagcaagcccggctgttctaggcagaggctctataaatatatatgcatttatataaagatatatgtaaaatctctctactgaagctcggtataatcctctcttgtgtaatgggacacactgcctgccatgagacttgcttttctgtactgtcaggcaagcccacgtcatcgagatatttttatgctccttactttctcttttctaagtgctgtgggatctgggaagggatttgaggggactctgtccttttattggggatcctttttatactgaaacatctgtcctaacttgagtgccccaaggtccaactctctttcctaaagaaggtgcctgaagaagtctctcttctctctgcttcgtggcccctttcttaaatttctagggctgatgctgaccatgtggtttccacaccttattggccccagaggggccctcccatgggaagatctgcagcagtctccccaaatcagtgagcacctttgagcgcccacgaagaactttctcaacacccccaattaggagctcagtgctctcttggggcaatgcagttaaaagggtgagcctcaaatctagtcattacaccagtcaacagaagtggacagggcctaggcctctcctcagctccttaaccctcctccttctgccctggattgtaacctctcccttgtccaaatctaggattcctggtaggaaaaggaaaaggcccttcccttccctccaccacttccaactggcccctttgcctgacctggacttggagaaccagaggaaaagagagggagcggaagtgggagatggagcagggcacctgttagaatcagagctgcaggatttcttgggaccctcctctctccctcactgctcccagcacctcctgacccttccctctttcaaggagaagcccatgattgcagcttgtattctttagccttattacaatctatgtgcctgacaactcaacacaccgcagggctaatgttcccaccagagctccaactgaacaaccagacagacaactctcatcatcctccagagagaaaataggccgtgtctcaaagaaaggttcttggtctatgcctctggtctgtgggctggcagggcaaccataccatacccccgccagtcctcggctcctgctgcaaagttggccatgtttcacagggaaacttttggaagagtggctgcttatgagattccaaaatgaagtgttggccaacaccgctcatggccatcctggattttcccagtggcttcccttcctgctcgcctccctgaacaggggagaaagcttaacctctcttctcctctccaaacctttcaccttgaatgggtaatgtttggtgggggctgttccttcttggagaagccttgagtcggaccattttgagatcatggaggaaggatgaagaagtgaaaatgacaataatgactctcaagaggctggcgatgtgacatggcaaatgtagaactgacttaaattgaacaaaccctcactgagcacctctgatgttgagcacctgctgaatactgagcactgaatgggggagggggaggggagcacggggtgagtcaacctgggactcggtctcagggatatgcctaccaatagcgggtatcgtaaggcatgtacccaaacataacggatgtaaggcagaaagtgatcggagaaggaatgagaaagtgtgcgtgatgttaatgaaaagtcatatgcagctagagcagacccaggaaagctttctggaagagattgcatctgaggaaattcaggaaggatctttgtagattggggggagattctaaattgaaggggtgatggggtgaggggccagagggaagtctgctgtgttctcatgtaggatgtcagccctccctgcaacttctctttttggccaatgtcttttcactttcctgaccctttagaatcatccccagccagacgcaatcatggaagttgccttattgtcactggttaagaacttggcgagattgaagggcttttgttattgttgttggatatttttgtttcccataaaagcacatcatttcaaccctaaacctgtgtgcttctgttgtttcttgtgtgggagtggaaatgactgacatgggaagaggctgaaccctgcacatttttcaaaatgaaagcaccaaaacagcagcc

SEQ ID NO: 103882 - DNA, 2290 bp, Homo sapiens
  Payload ID: 421
  Gene Symbol: ABLIM3
  Gene Name: actin binding LIM protein family, member 3
  ENST ID: ENST00000356541
  CDS Start-End: 1725-2237
ctaagcctcgattgaaggagcacatcccttccattgaagctgcagaggagcagctgccaccctgtgcacccacacttgcttaagggtctagctggataacaaaaggaggcccagaatcggtggagcttggagatgagcgaagcagtcctgcaccaggttctgaactaattagctggtggaggggacaatacgagtttaaacagcggctctgggtgcctaagattctacattttatacagacatccttggttccagagggggctgagcaggggggtccgaggtgagtctgtgagcatgtgcaagtctgtaccagcttgtgaaggacatgccatgtcccctgagtactcatagaaagacaccaacatgacaaaggtagtttggctttatacctagaaaaggcccccaggtcacaagcttctcaggactttgtgggattttccaggtgggccctgaggggtggcactaaagcagactcaagaggagtctggggtggaggtgggttgcttggaaaagagggcggaggaaaaagctaaatgcagtcagccaggaggggctgcccaggacccaagtcaaagagaagaatttgaaagctttggaagcaagtgctgttgtgggggctgcatagcccagggctggctgaagctgatccaccacgctctgccactctggctccacagagcacagagcttgtccctaaagcttcctgtagctgaccatgagaaatggtcatgcagccacacacacttccccagcccctctctctgctctaccagcctgtcacccacgtttgggccacgagaagtcactgctctgtaagtagttgtgactgcagtgggtctttttggtcacccctgtcctgggcttacttcaggtggaagcttgaagctggatggcagctgagccagcagaccgattctgacacttacagatgaggaaactaaggcagagatggtaggacctgcccagtgttacagctgagtaaagtggcagagctgggaccagaacccaggtttgctgactccctgtctagcactccttccttcaggctatgtagtccctgagcagaatgtggcatctcaggttgtgagaaatgatggagttcaaatttataacaaggaaggcttctaaagggctaggaaggcttctaaagggctggggctcacctgggacctgtccagtcttatttgaggagccacacccttagaggtcattctggaacagacctgggaatccatggaatgtgctggaaagagccctgggctgggatctggtccagttctggtgctcacatgctatgtggtcttaagcaagccccttcccctctctggtgctccaattactaaatgcaaaatgagggtttggccccagtgcttttccagctccgatgctccatggcccagttctaacagagagccctgatcttgaagtggactcactcccctgggctggagcctggtaaagataggaaaagggtacacagtcccatcccggtcactctgccttcctgaagtgctctccttgggtcctctgcaggtgatttgtctacagcaaccaagagcaaaacaagtgaagacatcagccagacctccaagtacagtcccatctactcgccagacccctactatgcttcggagtctgagtactggacctaccatgggtcccccaaagtgccccgagccagaaggttctcgtctggaggagaggaggatgattttgaccgcagcatgcacaagctccaaagtggaattggccggctgattctgaaggaagaaatgaaggcccggtcgagctcctatgcagatccctggacccctccccggagctccaccagcagccgggaagccctgcacacagctggctatgagatgtccctcaatggctcccctcggtcgcactacctggctgacagtgatcctctcatctccaaatctgcctccctgcctgcctaccgaagaaatgggctgcacaggacacccagcgcagacctcttccactacgacagcatgaacgcagtcaactggggcatgcgaggtgagtgcaagatctacccttatgaactgctgctggtgactacaagaggaagaaaccgactgcccaaggatgtagacaggacccgtttagagcgccacctgtcccaggaagagttctaccaagtctttggcatgaccatctctgagtttgaccggctggccctctggaagaggaatgaactgaagaagcaagcccggctgttctaggcagaggctctataaatatatatgcatttatataaagatatatgtaaaatctc

SEQ ID NO: 103883 - DNA, 2011 bp, Homo sapiens
  Payload ID: 421
  Gene Symbol: ABLIM3
  Gene Name: actin binding LIM protein family, member 3
  ENST ID: ENST00000508983
  CDS Start-End: 50-2002
cagccggggcctccgtattgaatgaaagacccagtgcaaagacatcaccatgaacactagcattccttatcagcagaatccttacaatccacggggcagctccaatgtcatccagtgctaccgctgtggagacacctgcaaaggggaagtggtccgcgtgcacaacaaccacttccacatcagatgcttcacctgtcaagtatgtggctgtggcctggcccagtcaggcttcttcttcaagaaccaggagtacatctgcacccaggactaccagcaactctatggcacccgctgtgacagctgccgggacttcatcacaggcgaagtcatctcggccctgggccgcacttaccaccccaagtgcttcgtgtgcagcttgtgcaggaagcctttccccattggagacaaggtgaccttcagcggtaaagaatgtgtgtgccaaacgtgctcccagtccatggccagcagtaagcccatcaagattcgtggaccaagccactgtgccgggtgcaaggaggagatcaagcacggccagtcactcctggctctggacaagcagtggcacgtcagctgcttcaagtgccagacctgcagcgtcatcctcaccggggagtatatcagcaaggatggtgttccatactgtgagtccgactaccatgcccagtttggcattaaatgtgagacttgtgaccgatacatcagtggcagagtcttggaggcaggagggaagcactaccacccaacctgtgccaggtgtgtacgctgccaccagatgttcaccgaaggagaggaaatgtacctcacaggttccgaggtttggcaccccatctgcaaacaggcagcccgggcagagaagaagttaaagcatagacggacatctgaaacctccatctcaccccctggatccagcattgggtcacccaaccgagtcatctgcgctaaagtggataatgagatccttaattacaaagacctggcggctctccccaaggttaagtctatctacgaggtacaacgccccgacctcatttcctatgagcctcattccagatacatgtccgacgagatgctggagagatgtggctatggagagtcgctgggaacattatctccctactcccaggacatctacgagaacctggacctccggcagagacgggcctccagcccggggtacatagactcccccacctacagccggcagggcatgtcccccaccttctcccgctcacctcaccactactaccgctctgctggagacagtaacatctaccggaaacccccgatctacaaacggcatggtgatttgtctacagcaaccaagagcaaaacaagtgaagacatcagccagacctccaagtacagtcccatctactcgccagacccctactatgcttcggagtctgagtactggacctaccatgggtcccccaaagtgccccgagccagaaggttctcgtctggaggagaggaggatgattttgaccgcagcatgcacaagctccaaagtggaattggccggctgattctgaaggaagaaatgaaggcccggtcgagctcctatgcagatccctggacccctccccggagctccaccagcagccgggaagccctgcacacagctggctatgagatgtccctcaatggctcccctcggtcgcactacctggctgacagtgatcctctcatctccaaatctgcctccctgcctgcctaccgaagaaatgggctgcacaggacacccagcgcagacctcttccactacgacagcatgaacgcagtcaactggggcatgcgagagtacaagatctacccttatgaactgctgctggtgactacaagaggaagaaaccgactgcccaaggatgtagacaggacccgtttagagcgccacctgtcccaggaagagttctaccaagtctttggcatgaccatctctgagtttgaccggctggccctctggaagaggaatgaactgaagaagcaagcccggctgttctaggcagaggct

SEQ ID NO: 103884 - DNA, 4178 bp, Homo sapiens
  Payload ID: 421
  Gene Symbol: ABLIM3
  Gene Name: actin binding LIM protein family, member 3
  ENST ID: ENST00000515171
  CDS Start-End: 346-801
agccgctgggcaggaatagtccggggtgcgcgcgagcaggcgctgccaaccccacttctgcccgggattccaatctgaggagcaggaggaccggggcgccggtgtcctgccgcctccttctccttgctctcacctgcgcctattagtccacgcgccttcaaggccaggggctacagcccagacagagaggggacagcagagggagagagagcacctgaggatacagagctggcactggactgccttttcaccccccaggtgatgagtgaggttcgaagaacggaagatttaaaaagcagccggggcctccgtattgaatgaaagacccagtgcaaagacatcaccatgaacactagcattccttatcagcagaatccttacaatccacggggcagctccaatgtcatccagtgctaccgctgtggagacacctgcaaaggggaagtggtccgcgtgcacaacaaccacttccacatcagatgcttcacctgtcaagtatgtggctgtggcctggcccagtcaggcttcttcttcaagaaccaggagtacatctgcacccaggactaccagcaactctatggcacccgctgtgacagctgccgggacttcatcacaggcgaagtcatctcggccctgggccgcacttaccaccccaagtgcttcgtgtgcagcttgtgcaggacatctccagggatggagagctcatccctgcctcctgctttaccttccgcatcaccatcacttgttaattcagcaagtgaagcctttccccattggagacaaggtgaccttcagcggtaaagaatgtgtgtgccaaacgtgctcccagtccatggccagcagtaagcccatcaagattcgtggaccaagccactgtgccgggtgcaaggaggagatcaagcacggccagtcactcctggctctggacaagcagtggcacgtcagctgcttcaagtgccagacctgcagcgtcatcctcaccggggagtatatcagcaaggatggtgttccatactgtgagtccgactaccatgcccagtttggcattaaatgtgagacttgtgaccgatacatcagtggcagagtcttggaggcaggagggaagcactaccacccaacctgtgccaggtgtgtacgctgccaccagatgttcaccgaaggagaggaaatgtacctcacaggttccgaggtttggcaccccatctgcaaacaggcagcccgggcagagaagaagttaaagcatagacggacatctgaaacctccatctcaccccctggatccagcattgggtcacccaaccgagtcatctgcgacatctacgagaacctggacctccggcagagacgggcctccagcccggggtacatagactcccccacctacagccggcagggcatgtcccccaccttctcccgctcacctcaccactactaccgctctggtgatttgtctacagcaaccaagagcaaaacaagtgaagacatcagccagacctccaagtacagtcccatctactcgccagacccctactatgcttcggagtctgagtactggacctaccatgggtcccccaaagtgccccgagccagaaggttctcgtctggaggagaggaggatgattttgaccgcagcatgcacaagctccaaagtggaattggccggctgattctgaaggaagaaatgaaggcccggtcgagctcctatgcagatccctggacccctccccggagctccaccagcagccgggaagccctgcacacagctggctatgagatgtccctcaatggctcccctcggtcgcactacctggctgacagtgatcctctcatctccaaatctgcctccctgcctgcctaccgaagaaatgggctgcacaggacacccagcgcagacctcttccactacgacagcatgaacgcagtcaactggggcatgcgagagtacaagatctacccttatgaactgctgctggtgactacaagaggaagaaaccgactgcccaaggatgtagacaggacccgtttagagcgccacctgtcccaggaagagttctaccaagtctttggcatgaccatctctgagtttgaccggctggccctctggaagaggaatgaactgaagaagcaagcccggctgttctaggcagaggctctataaatatatatgcatttatataaagatatatgtaaaatctctctactgaagctcggtataatcctctcttgtgtaatgggacacactgcctgccatgagacttgcttttctgtactgtcaggcaagcccacgtcatcgagatatttttatgctccttactttctcttttctaagtgctgtgggatctgggaagggatttgaggggactctgtccttttattggggatcctttttatactgaaacatctgtcctaacttgagtgccccaaggtccaactctctttcctaaagaaggtgcctgaagaagtctctcttctctctgcttcgtggcccctttcttaaatttctagggctgatgctgaccatgtggtttccacaccttattggccccagaggggccctcccatgggaagatctgcagcagtctccccaaatcagtgagcacctttgagcgcccacgaagaactttctcaacacccccaattaggagctcagtgctctcttggggcaatgcagttaaaagggtgagcctcaaatctagtcattacaccagtcaacagaagtggacagggcctaggcctctcctcagctccttaaccctcctccttctgccctggattgtaacctctcccttgtccaaatctaggattcctggtaggaaaaggaaaaggcccttcccttccctccaccacttccaactggcccctttgcctgacctggacttggagaaccagaggaaaagagagggagcggaagtgggagatggagcagggcacctgttagaatcagagctgcaggatttcttgggaccctcctctctccctcactgctcccagcacctcctgacccttccctctttcaaggagaagcccatgattgcagcttgtattctttagccttattacaatctatgtgcctgacaactcaacacaccgcagggctaatgttcccaccagagctccaactgaacaaccagacagacaactctcatcatcctccagagagaaaataggccgtgtctcaaagaaaggttcttggtctatgcctctggtctgtgggctggcagggcaaccataccatacccccgccagtcctcggctcctgctgcaaagttggccatgtttcacagggaaacttttggaagagtggctgcttatgagattccaaaatgaagtgttggccaacaccgctcatggccatcctggattttcccagtggcttcccttcctgctcgcctccctgaacaggggagaaagcttaacctctcttctcctctccaaacctttcaccttgaatgggtaatgtttggtgggggctgttccttcttggagaagccttgagtcggaccattttgagatcatggaggaaggatgaagaagtgaaaatgacaataatgactctcaagaggctggcgatgtgacatggcaaatgtagaactgacttaaattgaacaaaccctcactgagcacctctgatgttgagcacctgctgaatactgagcactgaatgggggagggggaggggagcacggggtgagtcaacctgggactcggtctcagggatatgcctaccaatagcgggtatcgtaaggcatgtacccaaacataacggatgtaaggcagaaagtgatcggagaaggaatgagaaagtgtgcgtgatgttaatgaaaagtcatatgcagctagagcagacccaggaaagctttctggaagagattgcatctgaggaaattcaggaaggatctttgtagattggggggagattctaaattgaaggggtgatggggtgaggggccagagggaagtctgctgtgttctcatgtaggatgtcagccctccctgcaacttctctttttggccaatgtcttttcactttcctgaccctttagaatcatccccagccagacgcaatcatggaagttgccttattgtcactggttaagaacttggcgagattgaagggcttttgttattgttgttggatatttttgtttcccataaaagcacatcatttcaaccctaaa

SEQ ID NO: 103885 - DNA, 2774 bp, Homo sapiens
  Payload ID: 421
  Gene Symbol: ABLIM3
  Gene Name: actin binding LIM protein family, member 3
  Uniprot ID: O94929
  ENST ID: ENST00000504238
  CDS Start-End: 276-1910
caatctgaggagcaggaggaccggggcgccggtgtcctgccgcctccttctccttgctctcacctgcgcctattagtccacgcgccttcaaggccaggggctacagcccagacagagaggggacagcagagggagagagagcacctgaggatacagagctggcactggactgccttttcaccccccaggtgatgagtgaggttcgaagaacggaagatttaaaaagcagccggggcctccgtattgaatgaaagacccagtgcaaagacatcaccatgaacactagcattccttatcagcagaatccttacaatccacggggcagctccaatgtcatccagtgctaccgctgtggagacacctgcaaaggggaagtggtccgcgtgcacaacaaccacttccacatcagatgcttcacctgtcaagtatgtggctgtggcctggcccagtcaggcttcttcttcaagaaccaggagtacatctgcacccaggactaccagcaactctatggcacccgctgtgacagctgccgggacttcatcacaggcgaagtcatctcggccctgggccgcacttaccaccccaagtgcttcgtgtgcagcttgtgcaggaagcctttccccattggagacaaggtgaccttcagcggtaaagaatgtgtgtgccaaacgtgctcccagtccatggccagcagtaagcccatcaagattcgtggaccaagccactgtgccgggtgcaaggaggagatcaagcacggccagtcactcctggctctggacaagcagtggcacgtcagctgcttcaagtgccagacctgcagcgtcatcctcaccggggagtatatcagcaaggatggtgttccatactgtgagtccgactaccatgcccagtttggcattaaatgtgagacttgtgaccgatacatcagtggcagagtcttggaggcaggagggaagcactaccacccaacctgtgccaggtgtgtacgctgccaccagatgttcaccgaaggagaggaaatgtacctcacaggttccgaggtttggcaccccatctgcaaacaggcagcccgggcagagaagaagttaaagcatagacggacatctgaaacctccatctcaccccctggatccagcattgggtcacccaaccgagtcatctgcgacatctacgagaacctggacctccggcagagacgggcctccagcccggggtacatagactcccccacctacagccggcagggcatgtcccccaccttctcccgctcacctcaccactactaccgctctggtgatttgtctacagcaaccaagagcaaaacaagtgaagacatcagccagacctccaagtacagtcccatctactcgccagacccctactatgcttcggagtctgagtactggacctaccatgggtcccccaaagtgccccgagccagaaggttctcgtctggaggagaggaggatgattttgaccgcagcatgcacaagctccaaagtggaattggccggctgattctgaaggaagaaatgaaggcccggtcgagctcctatgcagatccctggacccctccccggagctccaccagcagccgggaagccctgcacacagctggctatgagatgtccctcaatggctcccctcggtcgcactacctggctgacagtgatcctctcatctccaaatctgcctccctgcctgcctaccgaagaaatgggctgcacaggacacccagcgcagacctcttccactacgacagcatgaacgcagtcaactggggcatgcgagagtacaagatctacccttatgaactgctgctggtgactacaagaggaagaaaccgactgcccaaggatgtagacaggacccgtttagagggaaacttttggaagagtggctgcttatgagattccaaaatgaagtgttggccaacaccgctcatggccatcctggattttcccagtggcttcccttcctgctcgcctccctgaacaggggagaaagcttaacctctcttctcctctccaaacctttcaccttgaatgggtaatgtttggtgggggctgttccttcttggagaagccttgagtcggaccattttgagatcatggaggaaggatgaagaagtgaaaatgacaataatgactctcaagaggctggcgatgtgacatggcaaatgtagaactgacttaaattgaacaaaccctcactgagcacctctgatgttgagcacctgctgaatactgagcactgaatgggggagggggaggggagcacggggtgagtcaacctgggactcggtctcagggatatgcctaccaatagcgggtatcgtaaggcatgtacccaaacataacggatgtaaggcagaaagtgatcggagaaggaatgagaaagtgtgcgtgatgttaatgaaaagtcatatgcagctagagcagacccaggaaagctttctggaagagattgcatctgaggaaattcaggaaggatctttgtagattggggggagattctaaattgaaggggtgatggggtgaggggccagagggaagtctgctgtgttctcatgtaggatgtcagccctccctgcaacttctctttttggccaatgtcttttcactttcctgaccctttagaatcatccccagccagacgcaatcatggaagttgccttattgtcactggttaagaacttggcgagattgaagggcttttgttattgttgttggatatttttgtttcccataaaagcacatcatttcaaccctaaa

SEQ ID NO: 103886 - DNA, 4569 bp, Homo sapiens
  Payload ID: 421
  Gene Symbol: ABLIM3
  Gene Name: actin binding LIM protein family, member 3
  Uniprot ID: O94929
  ENST ID: ENST00000506113
  CDS Start-End: 483-2534
ggccggggcaggggcctctggctcccgacactggccgagaggtgggttccggggcgggtcgctgctccttgaagccgggcggggacgcgctgcccccgccctgcctccctgtggtccacaccccctttgggctccggagccgctgggcaggaatagtccggggtgcgcgcgagcaggcgctgccaaccccacttctgcccgggattccaatctgaggagcaggaggaccggggcgccggtgtcctgccgcctccttctccttgctctcacctgcgcctattagtccacgcgccttcaaggccaggggctacagcccagacagagaggggacagcagagggagagagagcacctgaggatacagagctggcactggactgccttttcaccccccaggtgatgagtgaggttcgaagaacggaagatttaaaaagcagccggggcctccgtattgaatgaaagacccagtgcaaagacatcaccatgaacactagcattccttatcagcagaatccttacaatccacggggcagctccaatgtcatccagtgctaccgctgtggagacacctgcaaaggggaagtggtccgcgtgcacaacaaccacttccacatcagatgcttcacctgtcaagtatgtggctgtggcctggcccagtcaggcttcttcttcaagaaccaggagtacatctgcacccaggactaccagcaactctatggcacccgctgtgacagctgccgggacttcatcacaggcgaagtcatctcggccctgggccgcacttaccaccccaagtgcttcgtgtgcagcttgtgcaggaagcctttccccattggagacaaggtgaccttcagcggtaaagaatgtgtgtgccaaacgtgctcccagtccatggccagcagtaagcccatcaagattcgtggaccaagccactgtgccgggtgcaaggaggagatcaagcacggccagtcactcctggctctggacaagcagtggcacgtcagctgcttcaagtgccagacctgcagcgtcatcctcaccggggagtatatcagcaaggatggtgttccatactgtgagtccgactaccatgcccagtttggcattaaatgtgagacttgtgaccgatacatcagtggcagagtcttggaggcaggagggaagcactaccacccaacctgtgccaggtgtgtacgctgccaccagatgttcaccgaaggagaggaaatgtacctcacaggttccgaggtttggcaccccatctgcaaacaggcagcccgggcagagaagaagttaaagcatagacggacatctgaaacctccatctcaccccctggatccagcattgggtcacccaaccgagtcatctgcgctaaagtggataatgagatccttaattacaaagacctggcggctctccccaaggttaagtctatctacgaggtacaacgccccgacctcatttcctatgagcctcattccagatacatgtccgacgagatgctggagagatgtggctatggagagtcgctgggaacattatctccctactcccaggacatctacgagaacctggacctccggcagagacgggcctccagcccggggtacatagactcccccacctacagccggcagggcatgtcccccaccttctcccgctcacctcaccactactaccgctctgggcccgagagtggccggagctctccataccatagccagttagatgtgaggtcctccactccaacctcttaccaggctcccaagcactttcacatcccagctggagacagtaacatctaccggaaacccccgatctacaaacggcatggtgatttgtctacagcaaccaagagcaaaacaagtgaagacatcagccagacctccaagtacagtcccatctactcgccagacccctactatgcttcggagtctgagtactggacctaccatgggtcccccaaagtgccccgagccagaaggttctcgtctggaggagaggaggatgattttgaccgcagcatgcacaagctccaaagtggaattggccggctgattctgaaggaagaaatgaaggcccggtcgagctcctatgcagatccctggacccctccccggagctccaccagcagccgggaagccctgcacacagctggctatgagatgtccctcaatggctcccctcggtcgcactacctggctgacagtgatcctctcatctccaaatctgcctccctgcctgcctaccgaagaaatgggctgcacaggacacccagcgcagacctcttccactacgacagcatgaacgcagtcaactggggcatgcgagagtacaagatctacccttatgaactgctgctggtgactacaagaggaagaaaccgactgcccaaggatgtagacaggacccgtttagagcgccacctgtcccaggaagagttctaccaagtctttggcatgaccatctctgagtttgaccggctggccctctggaagaggaatgaactgaagaagcaagcccggctgttctaggcagaggctctataaatatatatgcatttatataaagatatatgtaaaatctctctactgaagctcggtataatcctctcttgtgtaatgggacacactgcctgccatgagacttgcttttctgtactgtcaggcaagcccacgtcatcgagatatttttatgctccttactttctcttttctaagtgctgtgggatctgggaagggatttgaggggactctgtccttttattggggatcctttttatactgaaacatctgtcctaacttgagtgccccaaggtccaactctctttcctaaagaaggtgcctgaagaagtctctcttctctctgcttcgtggcccctttcttaaatttctagggctgatgctgaccatgtggtttccacaccttattggccccagaggggccctcccatgggaagatctgcagcagtctccccaaatcagtgagcacctttgagcgcccacgaagaactttctcaacacccccaattaggagctcagtgctctcttggggcaatgcagttaaaagggtgagcctcaaatctagtcattacaccagtcaacagaagtggacagggcctaggcctctcctcagctccttaaccctcctccttctgccctggattgtaacctctcccttgtccaaatctaggattcctggtaggaaaaggaaaaggcccttcccttccctccaccacttccaactggcccctttgcctgacctggacttggagaaccagaggaaaagagagggagcggaagtgggagatggagcagggcacctgttagaatcagagctgcaggatttcttgggaccctcctctctccctcactgctcccagcacctcctgacccttccctctttcaaggagaagcccatgattgcagcttgtattctttagccttattacaatctatgtgcctgacaactcaacacaccgcagggctaatgttcccaccagagctccaactgaacaaccagacagacaactctcatcatcctccagagagaaaataggccgtgtctcaaagaaaggttcttggtctatgcctctggtctgtgggctggcagggcaaccataccatacccccgccagtcctcggctcctgctgcaaagttggccatgtttcacagggaaacttttggaagagtggctgcttatgagattccaaaatgaagtgttggccaacaccgctcatggccatcctggattttcccagtggcttcccttcctgctcgcctccctgaacaggggagaaagcttaacctctcttctcctctccaaacctttcaccttgaatgggtaatgtttggtgggggctgttccttcttggagaagccttgagtcggaccattttgagatcatggaggaaggatgaagaagtgaaaatgacaataatgactctcaagaggctggcgatgtgacatggcaaatgtagaactgacttaaattgaacaaaccctcactgagcacctctgatgttgagcacctgctgaatactgagcactgaatgggggagggggaggggagcacggggtgagtcaacctgggactcggtctcagggatatgcctaccaatagcgggtatcgtaaggcatgtacccaaacataacggatgtaaggcagaaagtgatcggagaaggaatgagaaagtgtgcgtgatgttaatgaaaagtcatatgcagctagagcagacccaggaaagctttctggaagagattgcatctgaggaaattcaggaaggatctttgtagattggggggagattctaaattgaaggggtgatggggtgaggggccagagggaagtctgctgtgttctcatgtaggatgtcagccctccctgcaacttctctttttggccaatgtcttttcactttcctgaccctttagaatcatccccagccagacgcaatcatggaagttgccttattgtcactggttaagaacttggcgagattgaagggcttttgttattgttgttggatatttttgtttcccataaaagcacatcatttcaaccctaaa

SEQ ID NO: 103887 - DNA, 2287 bp, Homo sapiens
  Payload ID: 421
  Gene Symbol: ABLIM3
  Gene Name: actin binding LIM protein family, member 3
  Uniprot ID: O94929
  ENST ID: ENST00000517451
  CDS Start-End: 1725-2234
ctaagcctcgattgaaggagcacatcccttccattgaagctgcagaggagcagctgccaccctgtgcacccacacttgcttaagggtctagctggataacaaaaggaggcccagaatcggtggagcttggagatgagcgaagcagtcctgcaccaggttctgaactaattagctggtggaggggacaatacgagtttaaacagcggctctgggtgcctaagattctacattttatacagacatccttggttccagagggggctgagcaggggggtccgaggtgagtctgtgagcatgtgcaagtctgtaccagcttgtgaaggacatgccatgtcccctgagtactcatagaaagacaccaacatgacaaaggtagtttggctttatacctagaaaaggcccccaggtcacaagcttctcaggactttgtgggattttccaggtgggccctgaggggtggcactaaagcagactcaagaggagtctggggtggaggtgggttgcttggaaaagagggcggaggaaaaagctaaatgcagtcagccaggaggggctgcccaggacccaagtcaaagagaagaatttgaaagctttggaagcaagtgctgttgtgggggctgcatagcccagggctggctgaagctgatccaccacgctctgccactctggctccacagagcacagagcttgtccctaaagcttcctgtagctgaccatgagaaatggtcatgcagccacacacacttccccagcccctctctctgctctaccagcctgtcacccacgtttgggccacgagaagtcactgctctgtaagtagttgtgactgcagtgggtctttttggtcacccctgtcctgggcttacttcaggtggaagcttgaagctggatggcagctgagccagcagaccgattctgacacttacagatgaggaaactaaggcagagatggtaggacctgcccagtgttacagctgagtaaagtggcagagctgggaccagaacccaggtttgctgactccctgtctagcactccttccttcaggctatgtagtccctgagcagaatgtggcatctcaggttgtgagaaatgatggagttcaaatttataacaaggaaggcttctaaagggctaggaaggcttctaaagggctggggctcacctgggacctgtccagtcttatttgaggagccacacccttagaggtcattctggaacagacctgggaatccatggaatgtgctggaaagagccctgggctgggatctggtccagttctggtgctcacatgctatgtggtcttaagcaagccccttcccctctctggtgctccaattactaaatgcaaaatgagggtttggccccagtgcttttccagctccgatgctccatggcccagttctaacagagagccctgatcttgaagtggactcactcccctgggctggagcctggtaaagataggaaaagggtacacagtcccatcccggtcactctgccttcctgaagtgctctccttgggtcctctgcaggtgatttgtctacagcaaccaagagcaaaacaagtgaagacatcagccagacctccaagtacagtcccatctactcgccagacccctactatgcttcggagtctgagtactggacctaccatgggtcccccaaagtgccccgagccagaaggttctcgtctggaggagaggaggatgattttgaccgcagcatgcacaagctccaaagtggaattggccggctgattctgaaggaagaaatgaaggcccggtcgagctcctatgcagatccctggacccctccccggagctccaccagcagccgggaagccctgcacacagctggctatgagatgtccctcaatggctcccctcggtcgcactacctggctgacagtgatcctctcatctccaaatctgcctccctgcctgcctaccgaagaaatgggctgcacaggacacccagcgcagacctcttccactacgacagcatgaacgcagtcaactggggcatgcgagagtacaagatctacccttatgaactgctgctggtgactacaagaggaagaaaccgactgcccaaggatgtagacaggacccgtttagagcgccacctgtcccaggaagagttctaccaagtctttggcatgaccatctctgagtttgaccggctggccctctggaagaggaatgaactgaagaagcaagcccggctgttctaggcagaggctctataaatatatatgcatttatataaagatatatgtaaaatctc

SEQ ID NO: 103888 - DNA, 2755 bp, Homo sapiens
  Payload ID: 422
  Gene Symbol: ABRA
  Gene Name: actin binding Rho activating protein
  Uniprot ID: Q8N0Z2
  ENST ID: ENST00000311955
  CDS Start-End: 56-1201
cacactcattttagccagtgtccaggctatcagcagagaaagacaggtgggcagcatggctccgggcgaaaaggaaagcggggagggcccagccaagagcgccctccggaagatacgcacagccaccctggtcatcagcttggcccgaggttggcagcagtgggcgaatgagaacagcatcaggcaggcccaggagcctacaggctggctgccgggagggacccaggactcacctcaagctcctaaaccaatcacaccccctacttcacaccagaaagctcagagtgccccaaagtcgccaccccgcctgccagaaggacatggagatggacaaagctcagagaaagcccctgaggtttctcacatcaaaaagaaagaggtgtccaaaacggtggtcagcaagacttatgagagaggaggggacgtgagccacctcagccacaggtacgagagggatgctggtgtgcttgaacctgggcagccagagaatgacattgacagaatcctccacagccacggctccccaacgcggaggagaaaatgtgccaacctggtgtctgagctaaccaagggctggagagtgatggagcaggaggagcccacatggaggagtgacagcgtagacacagaggacagcggctatggaggagaggctgaggagaggcccgagcaggatggagtgcaggtggctgtggtcaggatcaagcgccccttgccctcccaggtaaacagatttacagagaaactcaactgcaaagcccaacagaaatatagcccagtgggcaacttgaaagggagatggcagcagtgggctgatgaacacatacaatcccagaagctcaatcctttcagtgaagagtttgattacgagctggccatgtccacccgcctacacaaaggagatgagggctatggccgccccaaagaaggaaccaaaactgctgaaagggccaagcgtgctgaggagcacatctacagggaaatgatggacatgtgcttcattatctgcacaatggctcgccacagacgagatggcaagatccaggttacttttggagatctctttgacagatacgttcgtatttcagataaagtagtgggcattctcatgcgtgccaggaaacatggactggtagactttgaaggagagatgctatggcaaggccgagatgaccatgttgtgattacgctactcaagtgaaccttcaaaaacaaaagccaaatttggcccactatggtcttaatgctaaatgctcatgtaggtaaaatgaaaatgcaaactctctgtaataagttagtaaatattaaacaatttttacataaacgactttctggcattctatttctatctagaatgaggaattttggagattttgagaaggcacaaagcatttcagaaagcacatagaatgttaatgtataataatagtattaatagttgaaattccacagggtgtttttgtttttgttttgagacagattctctttatgtcaccaaagctggtcttttaactcctggcctcaagtgatcctctcacctcagcctcccaagtagctgggattataggcatgagcaacagcacccagccacttgtatattttaggcaaaatatttagctagtcattgtagaaactactatagatttttaattaaacattacatctaagaagaatgctgacttgagataaatatcagtagaacatataataatgtgtctttatttggaaaaaagaaaataccattaagtttggtaaaactaaacttaaaattttttcagaagcttgactttgtattattgtttatatcatagcatcacttacaaaacaagcacatatataaaaagttgtcaagatgttgctgaaattgttgaagttcctctgtgggcttggattctaacaggtttccagtaagagttcaccttcctcttgtttgatttcagcaaatcacataaaaacagacacttcctgtcttagtaccaacaaaggaaggcacaccctcactaaaagtagagcagaggtgagagattcagatttacttgcctttgtaggacttcttggagaagtttattgtttcattacatgtcagcatataacgagtcaagctgcttgcattaacatcaatgcaatgatatgtatttctccaacaatggagaaatacagaaaatctatgaagtggaatgttcagtattagaaaaatcccatagaatcattggtgaattaaaaacagatttgagacagtttaatgttcctcatactgtaacaaagaaaactttatgaaatgtttaagtcataaaactgcaatattagttctgccaaagtaaaaaatatacaatgatgatggcaaggagaaaatcattggacattaatgtgcctatgtgatcttaaaaacaaatggaatggaatgtgagattgcaattcttactggattcaatgaaattactaaaatgcattgatagtatagcactttggtgttaaatgtaaaaattaatgtctaaatatgatacctcaaaataataggtattagactgctataagaattatatttgttttcatgtatgagtctctttcaaactgaaggttctggtatcttaagaaagtatgcgtattttgtttccataccgtatttataaagctataagttaatgaccaatatttctaagtaggatttcatgtaagatgcacacttctattacaagtgaaacctacgccaaatgttaaagacaaatagcataagaataaaagatgttttcttgta

SEQ ID NO: 103889 - DNA, 7516 bp, Homo sapiens
  Payload ID: 423
  Gene Symbol: AFAP1
  Gene Name: actin filament associated protein 1
  Uniprot ID: Q8N556
  ENST ID: ENST00000358461
  CDS Start-End: 274-2466
gggcgcccggctccgctgggggcgggacggcgggcggcgggcggggccgtgtgcgcctgcgtggtgtctgtcccggccgcagccccacgccggctgcagctccgcgagccgagccggatctcgagcggggtacacgggctgaggcggcggcggcggccccgccccggggctccattgttaaggcggctgcggctctgtcggctgttcagctgcgctccagtcggcccaggcgccgcggcgaggagcgagcgctgcgaggtggcggcctgagcaatggaagagttaatagttgaacttcgtctctttcttgaactcctggaccatgaatatctaacctcaactgtcagggagaaaaaggcagtgataaccaacattctgctaagaatacagtcatccaaaggttttgatgtgaaggaccatgctcagaagcaggagaccgctaacagcctgccagcccctcctcagatgcccctgccggagatccctcagccctggctgcctcctgacagtgggcctccaccattgccaacatcctccctcccagaaggttattatgaggaagctgtgccgctgagccccggaaaagctccggaatacatcacatcaaattatgattccgatgcgatgagcagctcttatgagtcgtatgatgaagaggaggaggatgggaaggggaagaaaacccggcaccagtggccctccgaggaggcctccatggacctggtcaaggacgccaaaatctgcgccttcctgctgcggaagaagcggttcggccagtggaccaagttgctctgcgtcatcaaagacaccaaactgctgtgctataaaagttccaaggaccagcagcctcagatggaactgccactccaaggctgtaacattacgtacatcccgaaagacagcaaaaagaagaagcacgagctgaagattactcagcagggcacggacccgcttgttctcgccgtccagagcaaggaacaggccgagcagtggctgaaggtgatcaaagaagcctacagtggttgtagtggccccgtggattcagagtgtcctcctccaccaagctccccggtgcacaaggcagaactggagaagaaactgtcttcagagagacccagctcagatggggagggtgttgtggaaaatggaattaccacatgtaatggaaaggagcaagtgaagaggaagaaaagttccaaatcagaggccaagggcactgtgtcgaaagtcactgggaaaaaaatcaccaagatcatcagtctgggaaagaaaaagccgtccacagacgagcagacctcctcagctgaggaagatgttcccacctgcggctatctgaacgtgctctccaacagccgctggcgagagcgctggtgccgagtgaaagataacaagctcattttccacaaggacaggaccgacctgaagacccatattgtgtctattccgctccgtggctgcgaggtgatcccgggtttggattctaaacatcctctgacgttccggctgctgcgcaacggccaggaggttgcagtattggaggcatcttcttctgaagacatgggcaggtggattgggattttactcgcagagacgggatcgtccacagacccggaggctctgcactatgactacattgatgtggagatgtctgcaagtgtcattcagacagccaaacagaccttctgtttcatgaacaggcgtgttatatctgctaacccatatctagggggcacctccaacggctatgcccaccccagcgggacggcacttcattatgacgatgtcccgtgcatcaacggctcgctcaagggtaaaaagccccccgtggcgtctaatggggtcacaggaaaagggaagactctgagcagtcagccaaagaaagcggatcccgcggctgttgtgaaaaggacgggttcgaatgctgcccagtacaagtatggcaagaaccgggtagaagcagatgccaagcggctacagaccaaagaggaggagctgctgaagaggaaagaggccctgcggaataggctggcccagctccgcaaggaaagaaaagaccttcgagcggctattgaagtgaacgccggcaggaagccgcaggcgatcctggaggagaagctgaagcagctggaggaggagtgccggcagaaggaggcggagcgtgtcagcctggagctggagctgacggaggtcaaggagagcctgaagaaagcgctggcgggcggagtcaccctggggctggccatcgagcccaagtcagggacatcgagtccacagtctccagtgttccggcaccggaccctggaaaactcgcccatctccagctgtgacaccagtgacaccgagggccccgtgccggtgaacagcgcggccgtcttgaagaagagccaggctgccccgggcagctccccctgccgagggcatgtgctgcggaaggccaaggaatgggaattgaagaacgggacctaggggacagcagcaccactccagcctcagagactgcacacccccttgcctgtatcctcatctgtgtgacggcaggaagctctgcccagagtggcctcagctgcacgactccagaggctccacgactgagctctgaggccagtgcctgtcccccaggcccacttgtattctttctactgtaaaatggcgcctttaaaaaagatgtaagactttggttcccaactttgttaaaaaacaaaaaaagtgatggaaaggtgtttgaaaggatgctatcaggcgaagtgacatctttctaaccagataggccattgctttcaccgattccaacccagccctggactgaggatggatggttccatgagcccccagatgaaaacctggattcgacagggaagagcttggatccccggctgccccgggcatgagtgtggctggccatgggcactgggctcgccttgcacgcccaccaggagggccaggggcatacgcagtcctgacgtggactttgtgtcttggcgtaccctctccacgtgcccgtccccctcgtcatcagaggtaaaggcatgagaaaatcgcgctgtgaaacgttttttaccttttattattattttttggacagatgcttttgtcaccaagacatgaaaagctgccattcttcttaacctgttttttaggaatgtctttttactgtgtgtcacacttagatcaaggagttttcagaggttccttattttattaattaattatttgtgctgcttttgacaggtagcagagggttttaatacttcactaacagtacaccctcctcccccttgggctagcatccccagcccttaatccacgtcggagccggcaggtgcttctcacaccaggagcctctgggggcaggggctggctcctcgccgctgtacaggacgtttactgctgcttggggccagggcagtcctttgaaagggaagcaagttccggaatttgttcgctcatggaactataacaccttagagcaagaggcaggaattccagggcctcctgcccctccccttcctccagcttgtcaagttaaaccactaatgtgttggtgggcctggccgtgctgcctctcctgagtagggtgggtgcaagtagggcctctttcccagctttcttgcttgccttctgtgcaatatttcttggagaatttggatgcctaaggcataaaggaaaaaaacagagttcatagtttgagctggtatttaccccctgggtttaaaaatcagattaacttcttggtctcccggaggctgctgtcaggaattctccagtacgggaagatgcagtcacttatgacgaaataagtcacccctgaacgcctccgcaggcagattcatggagaccagtcccagtagcaaccgccccttccccaagcatagaatacagaggtgccatacttggtgtaagccttccttctgtccactgtccagaatgtcctttttcacacagaggaagagatggcgggaaaacactgactgactccttgggtttcccccagacatactttcagagcgctagctgtgtggtgcacgggactttacagttaggattcatgtttaaggtggtggcgcttgaggcctgcaagggccacgttggattactgaagcggaaagcggtctcccatgtataagaaaaagttttacaacacgaattggaagctgcttgagtccacctgaacttgaattgattgcaaagccatctgctgggaacggttttgggttcctgagccatcagccagcctttctttcccctctgatgcacgttcctcccggcctagtccgtggaggcccatcacaccagcatccgtgacgccagcttcccactaggacatccaggcaggtcgggcggggacgccacacacctcagggccgtccgctgcattgccatagaggagccctccctccagtggtcacttcccaccattgcaggcagacttcccaccattgcaggcagctgggcccacttcatatcacacaaaatgaattttctataaagggaaaaaagtttgctcctccatagatttttgctgccttcgggtcaaatagtttccctggttgacactcttgggccactctgattggcagcctgctttgccaaagagaactgtgtgaggttttggtggttagtaagagaagggggagatggccagcctgaagtcacggtcctggcccagcacaggtgggcagcagcgagctggcaggtgaagtgtgagcagcacgcaaagtgtcacgtgggccttagccgtcacccaccagcttcctcaccaggcaaggaggccccggagccttagcagggacttgcccaacggcacagctgattggtgctcgactcccagcatgcatattttgttgtaaaaacccaggtttgtaattcacatccacaaccctaagccttttaaagcggaggcaaacgttaacaaaccccatcgtggtccatggagcctttcaaaatgggtgccctggaggggcctgacagtgggttccttccatggcggatactcccttgaaatttcacattccatcaaagtttaaagcatttacttcagaataagttatttatgtgtatatgttcaataaatatagtttttaatttatatctgtacatattagacacacgcgagccatcttgccagaattctgacagtgatgtcattttattcccctcccaaaacatgccccaggaacaagcaccccttgcctctgtggcagctgcgagtgtgtctgatttcataacgaagccaggctgagggcaagaggcccgacaggcaggccagggtccccggagaagccggatttcttcgcaatgtcactggtacttagcagatggtcgtgttcacaggggctagccacctgtactacggtgccgaccgcaatgcgaggaatgtggtggccacgcgatggagctggccggaggacaggtcaggtgagggggccgacccctgcggggctcagggctccttccattctaaccttgagccacagtgtcactcttcagggctctgctcctggctctattttgttaaggtgtcatcagccttcaacctccatttatatatttttataatgttaagccactgaccaactttttcatagaaacaactatcagattcgagggctccctttgtccccctgacctgggcacaggcatgggcgatggctccctcttcccagaatctgcggggaactggggcaaggcccatctgtctgcaaggctggtagctctctccctcggcttccagagtccacggcagttgcaaggtaaccagtgtggatctgctgagtcaccccaggcaccagacttaccccaggagcatgggccactgtccatggggccttccttgagaccttcccttggggctggcgggcggcggcttaccagctgggtcagtcccatctcgcccctctgtgcctatgccctggcgttgccaggcttaaccttcccctgtatcttactcatcccagaattattactggccatttctaaatagacaaaaactaccctaaaatgtggagatttactccttttgaaaagtctgtttcaaaaagtgtggcctcagctctggaggccacccccaggaaggagtttgaggttcattgtcattatggccacagtttggtgcttgtgcacgggactcaaagggcagcgtcgaagctggggttaggtgtagggttgtgagcaaagctcccctgtttgtggccacaccttccctttccaaaaaggctattaattctactcacccactatttggggggatgtaaattttgcccacagactttgccacccaggtgaggtgctgtgttcatgcacggaactgatgtcattagacaccatccaaggatgggcagcctgcagtgtggccggcgactgccatccagagaaaaggcaccttgtgccacagggcggggccgacaccctgagctcacaggtggcccctgcattcaggtggatgtccatccttgaaacagcctcttctgggaacacagcactggaggtctccaggcatcagggttggccggcagggtgccctgcagcttacataaaggtcgtggcaatgtttcaatgttaaactaaactattgccttcctcttacttttcctaaaatgattttctaatgggaacagtcacttcaagttcatgacatagtttgaaggaggataattcattttttcctggttgtcactgtcttcttatccccttggtgggctgggttcatactgtgaaataaactaaaatgaaaccaaaacgttcctgccgtaaatacgtggcacagcactgcagaaaaagcagtcacctctattcgtgagtccccaagccatagcagggcgtctgtaaaagaagggaaactgcacccaggaagtggtgggcgtcagacgcatcctttcgcccgtagttcatgaaatagttccggctttggtcttccagaaaatctcaacttcaccgtgcacaagtgttaccgggtctttttagtgtagccatggaagatactttcaaaaggacatcttcagatcataagtcttaggaccaaaggtgtttttaatgagataatctttttgattttctaacaagaaaggaaatattcactttacattttaacatcaacttttaagtgatattcagaattaattgaccatggtgatacgttgtaaaatgttttcatattaagaatgtaattatttccttattgtattttttaaaagctaaagtcatatttaaaattctctttgaaagaaacaggcaaagaaacagcaaagatttttttaaattaaatatgttagtagtgcccacttcaaatgactgtaaatatattttcactgtttctcaatgtatttaattcataaagtaaaaattttatgaaaagaaacttgcaaggaaaatcctagttttcagtccactcgccccactttgtagtagcttcactgaatttcctgctttcctggttgaattttctactgtttcacgtggtgtaaccctagactggcgcccttggcgtgcccctttgtgtatgaataaacttctctccccc

SEQ ID NO: 103890 - DNA, 7479 bp, Homo sapiens
  Payload ID: 423
  Gene Symbol: AFAP1
  Gene Name: actin filament associated protein 1
  Uniprot ID: Q8N556
  ENST ID: ENST00000360265
  CDS Start-End: 236-2428
ctcccagttgaattttgctgccttaaagcagaagcaaaggagtagtgcatttgttaagaagaagacgcctgaatcttttagtggacctgctttcagcaaacttgttttttaggtcagaatactatatccaatgatcaagctaaacatgaaatgcttcgagtaagactcagtattcatactttgacatttgcaaatcactgggtctaataatactcttcctcttttgttgtcagcaatggaagagttaatagttgaacttcgtctctttcttgaactcctggaccatgaatatctaacctcaactgtcagggagaaaaaggcagtgataaccaacattctgctaagaatacagtcatccaaaggttttgatgtgaaggaccatgctcagaagcaggagaccgctaacagcctgccagcccctcctcagatgcccctgccggagatccctcagccctggctgcctcctgacagtgggcctccaccattgccaacatcctccctcccagaaggttattatgaggaagctgtgccgctgagccccggaaaagctccggaatacatcacatcaaattatgattccgatgcgatgagcagctcttatgagtcgtatgatgaagaggaggaggatgggaaggggaagaaaacccggcaccagtggccctccgaggaggcctccatggacctggtcaaggacgccaaaatctgcgccttcctgctgcggaagaagcggttcggccagtggaccaagttgctctgcgtcatcaaagacaccaaactgctgtgctataaaagttccaaggaccagcagcctcagatggaactgccactccaaggctgtaacattacgtacatcccgaaagacagcaaaaagaagaagcacgagctgaagattactcagcagggcacggacccgcttgttctcgccgtccagagcaaggaacaggccgagcagtggctgaaggtgatcaaagaagcctacagtggttgtagtggccccgtggattcagagtgtcctcctccaccaagctccccggtgcacaaggcagaactggagaagaaactgtcttcagagagacccagctcagatggggagggtgttgtggaaaatggaattaccacatgtaatggaaaggagcaagtgaagaggaagaaaagttccaaatcagaggccaagggcactgtgtcgaaagtcactgggaaaaaaatcaccaagatcatcagtctgggaaagaaaaagccgtccacagacgagcagacctcctcagctgaggaagatgttcccacctgcggctatctgaacgtgctctccaacagccgctggcgagagcgctggtgccgagtgaaagataacaagctcattttccacaaggacaggaccgacctgaagacccatattgtgtctattccgctccgtggctgcgaggtgatcccgggtttggattctaaacatcctctgacgttccggctgctgcgcaacggccaggaggttgcagtattggaggcatcttcttctgaagacatgggcaggtggattgggattttactcgcagagacgggatcgtccacagacccggaggctctgcactatgactacattgatgtggagatgtctgcaagtgtcattcagacagccaaacagaccttctgtttcatgaacaggcgtgttatatctgctaacccatatctagggggcacctccaacggctatgcccaccccagcgggacggcacttcattatgacgatgtcccgtgcatcaacggctcgctcaagggtaaaaagccccccgtggcgtctaatggggtcacaggaaaagggaagactctgagcagtcagccaaagaaagcggatcccgcggctgttgtgaaaaggacgggttcgaatgctgcccagtacaagtatggcaagaaccgggtagaagcagatgccaagcggctacagaccaaagaggaggagctgctgaagaggaaagaggccctgcggaataggctggcccagctccgcaaggaaagaaaagaccttcgagcggctattgaagtgaacgccggcaggaagccgcaggcgatcctggaggagaagctgaagcagctggaggaggagtgccggcagaaggaggcggagcgtgtcagcctggagctggagctgacggaggtcaaggagagcctgaagaaagcgctggcgggcggagtcaccctggggctggccatcgagcccaagtcagggacatcgagtccacagtctccagtgttccggcaccggaccctggaaaactcgcccatctccagctgtgacaccagtgacaccgagggccccgtgccggtgaacagcgcggccgtcttgaagaagagccaggctgccccgggcagctccccctgccgagggcatgtgctgcggaaggccaaggaatgggaattgaagaacgggacctaggggacagcagcaccactccagcctcagagactgcacacccccttgcctgtatcctcatctgtgtgacggcaggaagctctgcccagagtggcctcagctgcacgactccagaggctccacgactgagctctgaggccagtgcctgtcccccaggcccacttgtattctttctactgtaaaatggcgcctttaaaaaagatgtaagactttggttcccaactttgttaaaaaacaaaaaaagtgatggaaaggtgtttgaaaggatgctatcaggcgaagtgacatctttctaaccagataggccattgctttcaccgattccaacccagccctggactgaggatggatggttccatgagcccccagatgaaaacctggattcgacagggaagagcttggatccccggctgccccgggcatgagtgtggctggccatgggcactgggctcgccttgcacgcccaccaggagggccaggggcatacgcagtcctgacgtggactttgtgtcttggcgtaccctctccacgtgcccgtccccctcgtcatcagaggtaaaggcatgagaaaatcgcgctgtgaaacgttttttaccttttattattattttttggacagatgcttttgtcaccaagacatgaaaagctgccattcttcttaacctgttttttaggaatgtctttttactgtgtgtcacacttagatcaaggagttttcagaggttccttattttattaattaattatttgtgctgcttttgacaggtagcagagggttttaatacttcactaacagtacaccctcctcccccttgggctagcatccccagcccttaatccacgtcggagccggcaggtgcttctcacaccaggagcctctgggggcaggggctggctcctcgccgctgtacaggacgtttactgctgcttggggccagggcagtcctttgaaagggaagcaagttccggaatttgttcgctcatggaactataacaccttagagcaagaggcaggaattccagggcctcctgcccctccccttcctccagcttgtcaagttaaaccactaatgtgttggtgggcctggccgtgctgcctctcctgagtagggtgggtgcaagtagggcctctttcccagctttcttgcttgccttctgtgcaatatttcttggagaatttggatgcctaaggcataaaggaaaaaaacagagttcatagtttgagctggtatttaccccctgggtttaaaaatcagattaacttcttggtctcccggaggctgctgtcaggaattctccagtacgggaagatgcagtcacttatgacgaaataagtcacccctgaacgcctccgcaggcagattcatggagaccagtcccagtagcaaccgccccttccccaagcatagaatacagaggtgccatacttggtgtaagccttccttctgtccactgtccagaatgtcctttttcacacagaggaagagatggcgggaaaacactgactgactccttgggtttcccccagacatactttcagagcgctagctgtgtggtgcacgggactttacagttaggattcatgtttaaggtggtggcgcttgaggcctgcaagggccacgttggattactgaagcggaaagcggtctcccatgtataagaaaaagttttacaacacgaattggaagctgcttgagtccacctgaacttgaattgattgcaaagccatctgctgggaacggttttgggttcctgagccatcagccagcctttctttcccctctgatgcacgttcctcccggcctagtccgtggaggcccatcacaccagcatccgtgacgccagcttcccactaggacatccaggcaggtcgggcggggacgccacacacctcagggccgtccgctgcattgccatagaggagccctccctccagtggtcacttcccaccattgcaggcagacttcccaccattgcaggcagctgggcccacttcatatcacacaaaatgaattttctataaagggaaaaaagtttgctcctccatagatttttgctgccttcgggtcaaatagtttccctggttgacactcttgggccactctgattggcagcctgctttgccaaagagaactgtgtgaggttttggtggttagtaagagaagggggagatggccagcctgaagtcacggtcctggcccagcacaggtgggcagcagcgagctggcaggtgaagtgtgagcagcacgcaaagtgtcacgtgggccttagccgtcacccaccagcttcctcaccaggcaaggaggccccggagccttagcagggacttgcccaacggcacagctgattggtgctcgactcccagcatgcatattttgttgtaaaaacccaggtttgtaattcacatccacaaccctaagccttttaaagcggaggcaaacgttaacaaaccccatcgtggtccatggagcctttcaaaatgggtgccctggaggggcctgacagtgggttccttccatggcggatactcccttgaaatttcacattccatcaaagtttaaagcatttacttcagaataagttatttatgtgtatatgttcaataaatatagtttttaatttatatctgtacatattagacacacgcgagccatcttgccagaattctgacagtgatgtcattttattcccctcccaaaacatgccccaggaacaagcaccccttgcctctgtggcagctgcgagtgtgtctgatttcataacgaagccaggctgagggcaagaggcccgacaggcaggccagggtccccggagaagccggatttcttcgcaatgtcactggtacttagcagatggtcgtgttcacaggggctagccacctgtactacggtgccgaccgcaatgcgaggaatgtggtggccacgcgatggagctggccggaggacaggtcaggtgagggggccgacccctgcggggctcagggctccttccattctaaccttgagccacagtgtcactcttcagggctctgctcctggctctattttgttaaggtgtcatcagccttcaacctccatttatatatttttataatgttaagccactgaccaactttttcatagaaacaactatcagattcgagggctccctttgtccccctgacctgggcacaggcatgggcgatggctccctcttcccagaatctgcggggaactggggcaaggcccatctgtctgcaaggctggtagctctctccctcggcttccagagtccacggcagttgcaaggtaaccagtgtggatctgctgagtcaccccaggcaccagacttaccccaggagcatgggccactgtccatggggccttccttgagaccttcccttggggctggcgggcggcggcttaccagctgggtcagtcccatctcgcccctctgtgcctatgccctggcgttgccaggcttaaccttcccctgtatcttactcatcccagaattattactggccatttctaaatagacaaaaactaccctaaaatgtggagatttactccttttgaaaagtctgtttcaaaaagtgtggcctcagctctggaggccacccccaggaaggagtttgaggttcattgtcattatggccacagtttggtgcttgtgcacgggactcaaagggcagcgtcgaagctggggttaggtgtagggttgtgagcaaagctcccctgtttgtggccacaccttccctttccaaaaaggctattaattctactcacccactatttggggggatgtaaattttgcccacagactttgccacccaggtgaggtgctgtgttcatgcacggaactgatgtcattagacaccatccaaggatgggcagcctgcagtgtggccggcgactgccatccagagaaaaggcaccttgtgccacagggcggggccgacaccctgagctcacaggtggcccctgcattcaggtggatgtccatccttgaaacagcctcttctgggaacacagcactggaggtctccaggcatcagggttggccggcagggtgccctgcagcttacataaaggtcgtggcaatgtttcaatgttaaactaaactattgccttcctcttacttttcctaaaatgattttctaatgggaacagtcacttcaagttcatgacatagtttgaaggaggataattcattttttcctggttgtcactgtcttcttatccccttggtgggctgggttcatactgtgaaataaactaaaatgaaaccaaaacgttcctgccgtaaatacgtggcacagcactgcagaaaaagcagtcacctctattcgtgagtccccaagccatagcagggcgtctgtaaaagaagggaaactgcacccaggaagtggtgggcgtcagacgcatcctttcgcccgtagttcatgaaatagttccggctttggtcttccagaaaatctcaacttcaccgtgcacaagtgttaccgggtctttttagtgtagccatggaagatactttcaaaaggacatcttcagatcataagtcttaggaccaaaggtgtttttaatgagataatctttttgattttctaacaagaaaggaaatattcactttacattttaacatcaacttttaagtgatattcagaattaattgaccatggtgatacgttgtaaaatgttttcatattaagaatgtaattatttccttattgtattttttaaaagctaaagtcatatttaaaattctctttgaaagaaacaggcaaagaaacagcaaagatttttttaaattaaatatgttagtagtgcccacttcaaatgactgtaaatatattttcactgtttctcaatgtatttaattcataaagtaaaaattttatgaaaagaaacttgcaaggaaaatcctagttttcagtccactcgccccactttgtagtagcttcactgaatttcctgctttcctggttgaattttctactgtttcacgtggtgtaaccctagactggcgcccttggcgtgcccctttgtgtatgaataaacttctctccccca

SEQ ID NO: 103891 - DNA, 2590 bp, Homo sapiens
  Payload ID: 423
  Gene Symbol: AFAP1
  Gene Name: actin filament associated protein 1
  Uniprot ID: Q8N556
  ENST ID: ENST00000382543
  CDS Start-End: 5-2449
agcaatggaagagttaatagttgaacttcgtctctttcttgaactcctggaccatgaatatctaacctcaactgtcagggagaaaaaggcagtgataaccaacattctgctaagaatacagtcatccaaaggttttgatgtgaaggaccatgctcagaagcaggagaccgctaacagcctgccagcccctcctcagatgcccctgccggagatccctcagccctggctgcctcctgacagtgggcctccaccattgccaacatcctccctcccagaaggttattatgaggaagctgtgccgctgagccccggaaaagctccggaatacatcacatcaaattatgattccgatgcgatgagcagctcttatgagtcgtatgatgaagaggaggaggatgggaaggggaagaaaacccggcaccagtggccctccgaggaggcctccatggacctggtcaaggacgccaaaatctgcgccttcctgctgcggaagaagcggttcggccagtggaccaagttgctctgcgtcatcaaagacaccaaactgctgtgctataaaagttccaaggaccagcagcctcagatggaactgccactccaaggctgtaacattacgtacatcccgaaagacagcaaaaagaagaagcacgagctgaagattactcagcagggcacggacccgcttgttctcgccgtccagagcaaggaacaggccgagcagtggctgaaggtgatcaaagaagcctacagtggttgtagtggccccgtggattcagagtgtcctcctccaccaagctccccggtgcacaaggcagaactggagaagaaactgtcttcagagagacccagctcagatggggagggtgttgtggaaaatggaattaccacatgtaatggaaaggagcaagtgaagaggaagaaaagttccaaatcagaggccaagggcactgtgtcgaaagtcactgggaaaaaaatcaccaagatcatcagtctgggaaagaaaaagccgtccacagacgagcagacctcctcagctgaggaagatgttcccacctgcggctatctgaacgtgctctccaacagccgctggcgagagcgctggtgccgagtgaaagataacaagctcattttccacaaggacaggaccgacctgaagacccatattgtgtctattccgctccgtggctgcgaggtgatcccgggtttggattctaaacatcctctgacgttccggctgctgcgcaacggccaggaggttgcagtattggaggcatcttcttctgaagacatgggcaggtggattgggattttactcgcagagacgggatcgtccacagacccggaggctctgcactatgactacattgatgtggagatgtctgcaagtgtcattcagacagccaaacagaccttctgtttcatgaacaggcgtgttatatctgctaacccatatctagggggcacctccaacggctatgcccaccccagcgggacggcacttcattatgacgatgtcccgtgcatcaacggctcgtgggaaccggaagacggctttcctgcttcctgcagcagaggcttgggagaagaggtgctttatgataacgcaggcctgtacgataacttgccgcctccgcacatctttgcccgctactctcctgctgacagaaaggcctctaggctgtctgctgacaagctgtcctctaaccattacaaataccctgcctccgctcagtctgtcactaatacctcttctgtggggagggcgtctctcgggctcaactcgcagctcaagggtaaaaagccccccgtggcgtctaatggggtcacaggaaaagggaagactctgagcagtcagccaaagaaagcggatcccgcggctgttgtgaaaaggacgggttcgaatgctgcccagtacaagtatggcaagaaccgggtagaagcagatgccaagcggctacagaccaaagaggaggagctgctgaagaggaaagaggccctgcggaataggctggcccagctccgcaaggaaagaaaagaccttcgagcggctattgaagtgaacgccggcaggaagccgcaggcgatcctggaggagaagctgaagcagctggaggaggagtgccggcagaaggaggcggagcgtgtcagcctggagctggagctgacggaggtcaaggagagcctgaagaaagcgctggcgggcggagtcaccctggggctggccatcgagcccaagtcagggacatcgagtccacagtctccagtgttccggcaccggaccctggaaaactcgcccatctccagctgtgacaccagtgacaccgagggccccgtgccggtgaacagcgcggccgtcttgaagaagagccaggctgccccgggcagctccccctgccgagggcatgtgctgcggaaggccaaggaatgggaattgaagaacgggacctaggggacagcagcaccactccagcctcagagactgcacacccccttgcctgtatcctcatctgtgtgacggcaggaagctctgcccagagtggcctcagctgcacgactccagaggctccacgactgagctctgaggccagtg

SEQ ID NO: 103892 - DNA, 7768 bp, Homo sapiens
  Payload ID: 423
  Gene Symbol: AFAP1
  Gene Name: actin filament associated protein 1
  Uniprot ID: Q8N556
  ENST ID: ENST00000420658
  CDS Start-End: 274-2718
gggcgcccggctccgctgggggcgggacggcgggcggcgggcggggccgtgtgcgcctgcgtggtgtctgtcccggccgcagccccacgccggctgcagctccgcgagccgagccggatctcgagcggggtacacgggctgaggcggcggcggcggccccgccccggggctccattgttaaggcggctgcggctctgtcggctgttcagctgcgctccagtcggcccaggcgccgcggcgaggagcgagcgctgcgaggtggcggcctgagcaatggaagagttaatagttgaacttcgtctctttcttgaactcctggaccatgaatatctaacctcaactgtcagggagaaaaaggcagtgataaccaacattctgctaagaatacagtcatccaaaggttttgatgtgaaggaccatgctcagaagcaggagaccgctaacagcctgccagcccctcctcagatgcccctgccggagatccctcagccctggctgcctcctgacagtgggcctccaccattgccaacatcctccctcccagaaggttattatgaggaagctgtgccgctgagccccggaaaagctccggaatacatcacatcaaattatgattccgatgcgatgagcagctcttatgagtcgtatgatgaagaggaggaggatgggaaggggaagaaaacccggcaccagtggccctccgaggaggcctccatggacctggtcaaggacgccaaaatctgcgccttcctgctgcggaagaagcggttcggccagtggaccaagttgctctgcgtcatcaaagacaccaaactgctgtgctataaaagttccaaggaccagcagcctcagatggaactgccactccaaggctgtaacattacgtacatcccgaaagacagcaaaaagaagaagcacgagctgaagattactcagcagggcacggacccgcttgttctcgccgtccagagcaaggaacaggccgagcagtggctgaaggtgatcaaagaagcctacagtggttgtagtggccccgtggattcagagtgtcctcctccaccaagctccccggtgcacaaggcagaactggagaagaaactgtcttcagagagacccagctcagatggggagggtgttgtggaaaatggaattaccacatgtaatggaaaggagcaagtgaagaggaagaaaagttccaaatcagaggccaagggcactgtgtcgaaagtcactgggaaaaaaatcaccaagatcatcagtctgggaaagaaaaagccgtccacagacgagcagacctcctcagctgaggaagatgttcccacctgcggctatctgaacgtgctctccaacagccgctggcgagagcgctggtgccgagtgaaagataacaagctcattttccacaaggacaggaccgacctgaagacccatattgtgtctattccgctccgtggctgcgaggtgatcccgggtttggattctaaacatcctctgacgttccggctgctgcgcaacggccaggaggttgcagtattggaggcatcttcttctgaagacatgggcaggtggattgggattttactcgcagagacgggatcgtccacagacccggaggctctgcactatgactacattgatgtggagatgtctgcaagtgtcattcagacagccaaacagaccttctgtttcatgaacaggcgtgttatatctgctaacccatatctagggggcacctccaacggctatgcccaccccagcgggacggcacttcattatgacgatgtcccgtgcatcaacggctcgtgggaaccggaagacggctttcctgcttcctgcagcagaggcttgggagaagaggtgctttatgataacgcaggcctgtacgataacttgccgcctccgcacatctttgcccgctactctcctgctgacagaaaggcctctaggctgtctgctgacaagctgtcctctaaccattacaaataccctgcctccgctcagtctgtcactaatacctcttctgtggggagggcgtctctcgggctcaactcgcagctcaagggtaaaaagccccccgtggcgtctaatggggtcacaggaaaagggaagactctgagcagtcagccaaagaaagcggatcccgcggctgttgtgaaaaggacgggttcgaatgctgcccagtacaagtatggcaagaaccgggtagaagcagatgccaagcggctacagaccaaagaggaggagctgctgaagaggaaagaggccctgcggaataggctggcccagctccgcaaggaaagaaaagaccttcgagcggctattgaagtgaacgccggcaggaagccgcaggcgatcctggaggagaagctgaagcagctggaggaggagtgccggcagaaggaggcggagcgtgtcagcctggagctggagctgacggaggtcaaggagagcctgaagaaagcgctggcgggcggagtcaccctggggctggccatcgagcccaagtcagggacatcgagtccacagtctccagtgttccggcaccggaccctggaaaactcgcccatctccagctgtgacaccagtgacaccgagggccccgtgccggtgaacagcgcggccgtcttgaagaagagccaggctgccccgggcagctccccctgccgagggcatgtgctgcggaaggccaaggaatgggaattgaagaacgggacctaggggacagcagcaccactccagcctcagagactgcacacccccttgcctgtatcctcatctgtgtgacggcaggaagctctgcccagagtggcctcagctgcacgactccagaggctccacgactgagctctgaggccagtgcctgtcccccaggcccacttgtattctttctactgtaaaatggcgcctttaaaaaagatgtaagactttggttcccaactttgttaaaaaacaaaaaaagtgatggaaaggtgtttgaaaggatgctatcaggcgaagtgacatctttctaaccagataggccattgctttcaccgattccaacccagccctggactgaggatggatggttccatgagcccccagatgaaaacctggattcgacagggaagagcttggatccccggctgccccgggcatgagtgtggctggccatgggcactgggctcgccttgcacgcccaccaggagggccaggggcatacgcagtcctgacgtggactttgtgtcttggcgtaccctctccacgtgcccgtccccctcgtcatcagaggtaaaggcatgagaaaatcgcgctgtgaaacgttttttaccttttattattattttttggacagatgcttttgtcaccaagacatgaaaagctgccattcttcttaacctgttttttaggaatgtctttttactgtgtgtcacacttagatcaaggagttttcagaggttccttattttattaattaattatttgtgctgcttttgacaggtagcagagggttttaatacttcactaacagtacaccctcctcccccttgggctagcatccccagcccttaatccacgtcggagccggcaggtgcttctcacaccaggagcctctgggggcaggggctggctcctcgccgctgtacaggacgtttactgctgcttggggccagggcagtcctttgaaagggaagcaagttccggaatttgttcgctcatggaactataacaccttagagcaagaggcaggaattccagggcctcctgcccctccccttcctccagcttgtcaagttaaaccactaatgtgttggtgggcctggccgtgctgcctctcctgagtagggtgggtgcaagtagggcctctttcccagctttcttgcttgccttctgtgcaatatttcttggagaatttggatgcctaaggcataaaggaaaaaaacagagttcatagtttgagctggtatttaccccctgggtttaaaaatcagattaacttcttggtctcccggaggctgctgtcaggaattctccagtacgggaagatgcagtcacttatgacgaaataagtcacccctgaacgcctccgcaggcagattcatggagaccagtcccagtagcaaccgccccttccccaagcatagaatacagaggtgccatacttggtgtaagccttccttctgtccactgtccagaatgtcctttttcacacagaggaagagatggcgggaaaacactgactgactccttgggtttcccccagacatactttcagagcgctagctgtgtggtgcacgggactttacagttaggattcatgtttaaggtggtggcgcttgaggcctgcaagggccacgttggattactgaagcggaaagcggtctcccatgtataagaaaaagttttacaacacgaattggaagctgcttgagtccacctgaacttgaattgattgcaaagccatctgctgggaacggttttgggttcctgagccatcagccagcctttctttcccctctgatgcacgttcctcccggcctagtccgtggaggcccatcacaccagcatccgtgacgccagcttcccactaggacatccaggcaggtcgggcggggacgccacacacctcagggccgtccgctgcattgccatagaggagccctccctccagtggtcacttcccaccattgcaggcagacttcccaccattgcaggcagctgggcccacttcatatcacacaaaatgaattttctataaagggaaaaaagtttgctcctccatagatttttgctgccttcgggtcaaatagtttccctggttgacactcttgggccactctgattggcagcctgctttgccaaagagaactgtgtgaggttttggtggttagtaagagaagggggagatggccagcctgaagtcacggtcctggcccagcacaggtgggcagcagcgagctggcaggtgaagtgtgagcagcacgcaaagtgtcacgtgggccttagccgtcacccaccagcttcctcaccaggcaaggaggccccggagccttagcagggacttgcccaacggcacagctgattggtgctcgactcccagcatgcatattttgttgtaaaaacccaggtttgtaattcacatccacaaccctaagccttttaaagcggaggcaaacgttaacaaaccccatcgtggtccatggagcctttcaaaatgggtgccctggaggggcctgacagtgggttccttccatggcggatactcccttgaaatttcacattccatcaaagtttaaagcatttacttcagaataagttatttatgtgtatatgttcaataaatatagtttttaatttatatctgtacatattagacacacgcgagccatcttgccagaattctgacagtgatgtcattttattcccctcccaaaacatgccccaggaacaagcaccccttgcctctgtggcagctgcgagtgtgtctgatttcataacgaagccaggctgagggcaagaggcccgacaggcaggccagggtccccggagaagccggatttcttcgcaatgtcactggtacttagcagatggtcgtgttcacaggggctagccacctgtactacggtgccgaccgcaatgcgaggaatgtggtggccacgcgatggagctggccggaggacaggtcaggtgagggggccgacccctgcggggctcagggctccttccattctaaccttgagccacagtgtcactcttcagggctctgctcctggctctattttgttaaggtgtcatcagccttcaacctccatttatatatttttataatgttaagccactgaccaactttttcatagaaacaactatcagattcgagggctccctttgtccccctgacctgggcacaggcatgggcgatggctccctcttcccagaatctgcggggaactggggcaaggcccatctgtctgcaaggctggtagctctctccctcggcttccagagtccacggcagttgcaaggtaaccagtgtggatctgctgagtcaccccaggcaccagacttaccccaggagcatgggccactgtccatggggccttccttgagaccttcccttggggctggcgggcggcggcttaccagctgggtcagtcccatctcgcccctctgtgcctatgccctggcgttgccaggcttaaccttcccctgtatcttactcatcccagaattattactggccatttctaaatagacaaaaactaccctaaaatgtggagatttactccttttgaaaagtctgtttcaaaaagtgtggcctcagctctggaggccacccccaggaaggagtttgaggttcattgtcattatggccacagtttggtgcttgtgcacgggactcaaagggcagcgtcgaagctggggttaggtgtagggttgtgagcaaagctcccctgtttgtggccacaccttccctttccaaaaaggctattaattctactcacccactatttggggggatgtaaattttgcccacagactttgccacccaggtgaggtgctgtgttcatgcacggaactgatgtcattagacaccatccaaggatgggcagcctgcagtgtggccggcgactgccatccagagaaaaggcaccttgtgccacagggcggggccgacaccctgagctcacaggtggcccctgcattcaggtggatgtccatccttgaaacagcctcttctgggaacacagcactggaggtctccaggcatcagggttggccggcagggtgccctgcagcttacataaaggtcgtggcaatgtttcaatgttaaactaaactattgccttcctcttacttttcctaaaatgattttctaatgggaacagtcacttcaagttcatgacatagtttgaaggaggataattcattttttcctggttgtcactgtcttcttatccccttggtgggctgggttcatactgtgaaataaactaaaatgaaaccaaaacgttcctgccgtaaatacgtggcacagcactgcagaaaaagcagtcacctctattcgtgagtccccaagccatagcagggcgtctgtaaaagaagggaaactgcacccaggaagtggtgggcgtcagacgcatcctttcgcccgtagttcatgaaatagttccggctttggtcttccagaaaatctcaacttcaccgtgcacaagtgttaccgggtctttttagtgtagccatggaagatactttcaaaaggacatcttcagatcataagtcttaggaccaaaggtgtttttaatgagataatctttttgattttctaacaagaaaggaaatattcactttacattttaacatcaacttttaagtgatattcagaattaattgaccatggtgatacgttgtaaaatgttttcatattaagaatgtaattatttccttattgtattttttaaaagctaaagtcatatttaaaattctctttgaaagaaacaggcaaagaaacagcaaagatttttttaaattaaatatgttagtagtgcccacttcaaatgactgtaaatatattttcactgtttctcaatgtatttaattcataaagtaaaaattttatgaaaagaaacttgcaaggaaaatcctagttttcagtccactcgccccactttgtagtagcttcactgaatttcctgctttcctggttgaattttctactgtttcacgtggtgtaaccctagactggcgcccttggcgtgcccctttgtgtatgaataaacttctctccccc

SEQ ID NO: 103893 - DNA, 356 bp, Homo sapiens
  Payload ID: 423
  Gene Symbol: AFAP1
  Gene Name: actin filament associated protein 1
  ENST ID: ENST00000614385
  CDS Start-End: 1-279
ggaattaccacatgtaatggaaaggagcaagtgaagaggaagaaaagttccaaatcagaggccaagggcactgtgtcgaaagtcactgggaaaaaaatcaccaagatcatcagtctgggaaagaaaaagccgtccacagacgagcagacctcctcagctgaggaagatgttcccacctgcggtaagactgcgcttcccggagacgagcagcgtgcacctaagtgggtttcattttctcctgcagtggtgtcggtacccagttcatccaaggctcgttaatttgagctcttttgcattggacttggaatcattcagatagtgggaaatgtattaaatgtttacatttttgcctctta

SEQ ID NO: 103894 - DNA, 4177 bp, Homo sapiens
  Payload ID: 424
  Gene Symbol: AFAP1L1
  Gene Name: actin filament associated protein 1-like 1
  Uniprot ID: Q8TED9
  ENST ID: ENST00000296721
  CDS Start-End: 99-2405
ccgctgggctggcctgagagcgcagcgcgccggccgctaccagccgcgccggagcccctgcgccctgcggcccgctccccggggaccgggccggcgccatggaccgaggccaggtgctggagcagctgctcccagagctcaccgggctgctcagcctcctggaccacgagtacctcagcgataccaccctggaaaagaagatggccgtggcctccatcctgcagagcctgcagccccttccagcaaaggaggtctcctacctgtatgtgaacacagcagacctccactcggggcccagcttcgtggaatccctctttgaagaatttgactgtgacctgagtgaccttcgggacatgccagaggatgatggggagcccagcaaaggagccagccctgagctagccaagagcccacgcctgagaaacgcggccgacctgcctccaccgctccccaacaagcctccccctgaggactactatgaagaggcccttcctctgggacccggcaagtcgcctgagtacatcagctcccacaatggctgcagcccctcacactcgattgtggatggctactatgaggacgcagacagcagctaccctgcaaccagggtgaacggcgagcttaagagctcctataatgactctgacgcaatgagcagctcctatgagtcctacgatgaagaggaggaggaagggaagagcccgcagccccgacaccagtggccctcagaggaggcctccatgcacctggtgagggaatgcaggatatgtgccttcctgctgcggaaaaagcgtttcgggcagtgggccaagcagctgacggtcatcagggaggaccagctcctgtgttacaaaagctccaaggatcggcagccacatctgaggttggcactggatacctgcagcatcatctacgtgcccaaggacagccggcacaagaggcacgagctgcgtttcacccagggggctaccgaggtcttggtgctggcactgcagagccgagagcaggccgaggagtggctgaaggtcatccgagaagtgagcaagccagttgggggagctgagggagtggaggtccccagatccccagtcctcctgtgcaagttggacctggacaagaggctgtcccaagagaagcagacctcagattctgacagcgtgggtgtgggtgacaactgttctacccttggccgccgggagacctgtgatcacggcaaagggaagaagagcagcctggcagaactgaagggctcaatgagcagggctgcgggccgcaagatcacccgtatcattggcttctccaagaagaagacactggccgatgacctgcagacgtcctccaccgaggaggaggttccctgctgtggctacctgaacgtgctggtgaaccagggctggaaggaacgctggtgccgcctgaagtgcaacactctgtatttccacaaggatcacatggacctgcgaacccatgtgaacgccatcgccctgcaaggctgtgaggtggccccgggctttgggccccgacacccatttgccttcaggatcctgcgcaaccggcaggaggtggccatcttggaggcaagctgttcagaggacatgggtcgctggctcgggctgctgctggtggagatgggctccagagtcactccggaggcgctgcactatgactacgtggatgtggagaccttaaccagcatcgtcagtgctgggcgcaactccttcctatatgcaagatcctgccagaatcagtggcctgagccccgagtctatgatgatgttccttatgaaaagatgcaggacgaggagcccgagcgccccacaggggcccaggtgaagcgtcacgcctcctcctgcagtgagaagtcccatcgtgtggacccgcaggtcaaagtcaaacgccacgcctccagtgccaatcaatacaagtatggcaagaaccgagccgaggaggatgcccggaggtacttggtagaaaaagagaagctggagaaagagaaagagacgattcggacagagctgatagcactgagacaggagaagagggaactgaaggaagccattcggagcagcccaggagcaaaattaaaggctctggaagaagccgtggccaccctggaagctcagtgtcgggcaaaggaggagcgccggattgacctggagctgaagctggtggctgtgaaggagcgcttgcagcagtccctggcaggagggccagccctggggctctccgtgagcagcaagcccaagagtggggaaactgcaaataaaccccagaacagcgttccagagcaacctctccctgtcaactgtgtttctgagctgaggaagaggagcccatccatcgtagcctccaaccaaggaagggtgctacagaaagccaaggaatgggaaatgaagaagacctaggaagaggatgaggatttcattccaaaggaaataccagcttgtccacctgaggaagaaatgcttttttcacaaggagacaccaagagaagactaggaagtagccctcgttctccagggcacccaaaataccagcctttattgtctgcatgattttaggggatatggggagggaacaagtagaagggaagagggaaatggagagcatccttatgactttacaaagggtggaaatgaggatggagggatacagaagtctgcacagctgtaaaggttttatagatgtctttgccttcccttctgaggaagggaagaagtaatgaaagcacatgtgaataaccccttccatcccattcacagcatcgcactcccagtccttaaggcaaagggaggcagtgctgaagcattggtggtgcagtgtaaagagacaagacctgatcatctgatcacacttgtgccaacttgattcatattgggcattactaacaacccctggtcaaggtaaataggttgaacaatcaataacattatccctgcctgcatacatgtgaacaaaagctatagaggacatgcaaattctacagtcattcctcatatgctttagacagagtgcagctactggaatcttccagatttcagtgttttaaaatcagagctctgaatacacaaaaggaaagagaaatggagcagctgacatattttaagctcacagtgatactcagtgacaggagcacagagctctaatgtccacaggatgttgtagggtagggtctctcagtaaatcaagtcccttacctatgttctgacactgaggctcttggagctatgggttagaaatccaggaggcaatatgtctttattctaatgaagtcctcatcttgcactcagaggcccactagtttgcccttctatatattaagtaaaaccaagagaaattaagaggatgatggcttctttctgtcacatgggtgctaaaccttttacaaacacttgatacttctatagagggaccaaggacctcaagtcctgggcagtctccttactgtgctactcactactgtctcaacactgtagtgagtctgtctttaacacatttccttccaataaagataaaaccacttaactcttaagtgccagtgcttagctcaagaggaaagaaggaaaatcccagaataaccgtggccactttgctataggggttacatattttaacccacctaaggttttacagactttagcctcactcaaactttatcaccctctgaggtagctggagaccacagcaggaaaaataacctgaccagtaatcacccactgattagtggcagagcgtaggacttaggggttataagcccagatccagatagggctaggtttgagccatgcctctaatgaccagctgggtgaccttgggaaagtcacttgattgctctgattcttgttttccttatctgtgaaatgggactaacaattgttacttttctcccaagattgttgggaagatttaataagataatatatagtaggcatcttgcatagtgtctgagaaataagaaatgctcagtcaatagtggctctcattagccaggcatggtggtactcgcctgtagtcccagctactcaggaggctgaggcaggaggaccgcttgagcccaggagtttgagactgtagtgcactatgatcacgcctgtgaattgccactgcactccagcctaagcaaatagcaagaccccatctattaaaaaaaaaaagtggctattattagctatatcag

SEQ ID NO: 103895 - DNA, 2319 bp, Homo sapiens
  Payload ID: 424
  Gene Symbol: AFAP1L1
  Gene Name: actin filament associated protein 1-like 1
  Uniprot ID: Q8TED9
  ENST ID: ENST00000515000
  CDS Start-End: 51-2228
ccggagcccctgcgccctgcggcccgctccccggggaccgggccggcgccatggaccgaggccaggtgctggagcagctgctcccagagctcaccgggctgctcagcctcctggaccacgagtacctcagcgataccaccctggaaaagaagatggccgtggcctccatcctgcagagcctgcagccccttccagcaaaggaggtctcctacctgtatgtgaacacagcagacctccactcggggcccagcttcgtggaatccctctttgaagaatttgactgtgacctgagtgaccttcgggacatgccagaggatgatggggagcccagcaaaggagccagccctgagctagccaagagcccacgcctgagaaacgcggccgacctgcctccaccgctccccaacaagcctccccctgaggactactatgaagaggcccttcctctgggacccggcaagtcgcctgagtacatcagctcccacaatggctgcagcccctcacactcgattgtggatggctactatgaggacgcagacagcagctaccctgcaaccagggtgaacggcgagcttaagagctcctataatgactctgacgcaatgagcagctcctatgagtcctacgatgaagaggaggaggaagggaagagcccgcagccccgacaccagtggccctcagaggaggcctccatgcacctggtgagggaatgcaggatatgtgccttcctgctgcggaaaaagcgtttcgggcagtgggccaagcagctgacggtcatcagggaggaccagctcctgtgttacaaaagctccaaggatcggcagccacatctgaggttggcactggatacctgcagcatcatctacgtgcccaaggacagccggcacaagaggcacgagctgcgtttcacccagggggctaccgaggtcttggtgctggcactgcagagccgagagcaggccgaggagtggctgaaggtcatccgagaagtgagcaagccagttgggggagctgagggagtggaggtccccagatccccagtcctcctgtgcaagttggacctggacaagaggctgtcccaagagaagcagacctcagattctgacagcgtgggtgtgggtgacaactgttctacccttggccgccgggagacctgtgatcacggcaaagggaagaagagcagcctggcagaactgaagggctcaatgagcagggctgcgggccgcaagatcacccgtatcattggcttctccaagaagaagacactggccgatgacctgcagacgtcctccaccgaggaggaggttccctgctgtggctacctgaacgtgctggtgaaccagggctggaaggaacgctggtgccgcctgaagtgcaacactctgtatttccacaaggatcacatggacctgcgaacccatgtgaacgccatcgccctgcaaggctgtgaggtggccccgggctttgggccccgacacccatttgccttcaggatcctgcgcaaccggcaggaggtggccatcttggaggcaagctgttcagaggacatgggtcgctggctcgggctgctgctggtggagatgggctccagagtcactccggaggcgctgcactatgactacgtggatgtggagaccttaaccagcatcgtcagtgctgggcgcaactccttcctatatgcaagatcctgccagaatcagtggcctgagccccgagtctatgatgatgttccttatgaaaagatgcaggacgaggagcccgagcgccccacaggggcccaggtgaagcgtcacgcctcctcctgcagtgagaagtcccatcgtgtggacccgcaggtcaaagtcaaacgccacgcctccagtgccaatcaatacaagtatggcaagaaccgagccgaggaggatgcccggaggtacttggtagaaaaagagaagctggagaaagagaaagagacgattcggacagagctgatagcactgagacaggagaagagggaactgaaggaagccattcggagcagcccaggagcaaaattaaaggctctggaagaagccgtggccaccctggaagctcagtgtcgggcaaaggaggagcgccggattgacctggagctgaagctggtggctgtgaaggagcgcttgcagcagtccctggcaggagggccagccctggggctctccgtgagcagcaagcccaagagtggggaatgggaaatgaagaagacctaggaagaggatgaggatttcattccaaaggaaataccagcttgtccacctgaggaagaaatgcttttttcacaaggagacaccaagagaagac

SEQ ID NO: 103896 - DNA, 3705 bp, Homo sapiens
  Payload ID: 425
  Gene Symbol: AFAP1L2
  Gene Name: actin filament associated protein 1-like 2
  Uniprot ID: Q8N4X5
  ENST ID: ENST00000304129
  CDS Start-End: 31-2487
gagccgcgaggagcgcactccgtggccccgatggagcggtacaaagccctggaacagctgctgacagagttggatgacttcctcaagattcttgaccaggagaacctgagcagcacagcactggtgaagaagagctgcctggcggagctcctccggctttacaccaaaagcagcagctctgatgaggagtacatttatatgaacaaagtgaccatcaacaagcaacagaatgcagagtctcaaggcaaagcgcctgaggagcagggcctgctacccaatggggagcccagccagcactcctcggcccctcagaagagccttccagacctcccgccacccaagatgattccagaacggaaacagcttgccatcccaaagacggagtctccagagggctactatgaagaggctgagccatatgacacatccctcaatgaggacggagaggctgtgagcagctcctacgagtcctacgatgaagaggacggcagcaagggcaagtcggccccttaccagtggccctcgccggaggccggcatcgagctgatgcgtgacgcccgcatctgcgccttcctgtggcgcaagaagtggctgggacagtgggccaagcagctctgtgtcatcaaggacaacaggcttctgtgctacaaatcctccaaggaccacagccctcagctggacgtgaacctactgggcagcagcgtcattcacaaggagaagcaagtgcggaagaaggagcacaagctgaagatcacgccgatgaatgccgatgtgattgtgctgggcctgcagagcaaggaccaggctgagcagtggctcagggtcatccaggaagtgagcggcctgccttccgaaggagcatctgaaggaaaccagtacaccccggatgcccagcgctttaactgccagaaaccagatatagctgagaagtacctgtcggcttcagagtatgggagctccgtggatggccaccctgaggtcccagaaaccaaagacgtcaagaagaaatgttctgctggcctcaaactgagcaacctaatgaatctgggcaggaagaaatccacctcactggagcctgtggagaggtccctcgagacatccagttacctgaacgtgctggtgaacagccagtggaagtctcgctggtgctctgtcagggacaatcacctgcacttctaccaggaccggaaccggagcaaggtggcccagcaacccctcagcctggtgggctgcgaggtggtcccagaccccagccccgaccacctctactccttccgcatcctccacaagggcgaggagctggccaagcttgaggccaagtcttccgaggaaatgggccactggctgggtctcctgctctctgagtcaggctccaagacagacccagaagagttcacctacgactatgtggatgccgatagggtctcctgtattgtgagtgcggccaaaaactctctcttactgatgcagagaaagttctcagagcccaacacttacatcgatggcctgcctagccaggaccgccaggaggagctgtatgacgacgtggacctgtcagagctcacagctgcggtggagcctaccgaggaagccacccctgttgcagatgacccaaatgagagagaatctgaccgagtgtacctggacctcacacctgtcaagtcctttctgcatggccccagcagtgcacaggcccaggcctcctccccgacgttgtcctgcctggacaatgcaactgaggccctcccggcagactcaggcccaggtcccaccccagatgagccctgcataaagtgtccagagaacctgggagaacagcagctggagagtttggagccagaggatccttccctgagaatcaccaccgtcaaaatccagacggaacagcagagaatctccttcccaccgagctgcccggatgccgtggtggccaccccacctggtgccagcccacctgtgaaggacaggttgcgcgtgaccagtgcagagatcaagcttggcaagaatcggacagaagctgaggtgaagcggtacacagaggagaaggagaggcttgaaaagaagaaggaagaaatccgggggcacctggctcagctccggaaagagaaacgggagctaaaggaaaccctactgaaatgcacagacaaggaagtcctggcgagcctggagcagaagctgaaggaaattgacgaggagtgccggggcgaggagagcaggcgcgtggacctggagctcagcatcatggaggtgaaggacaacctgaagaaggctgaggcagggcctgtgacgttaggcaccaccgtggacaccacccacctggagaatgtgagcccccgccccaaagctgtcacacctgcctctgccccagactgtaccccagtcaactctgcaaccacactcaagaacaggcctctctcggtcgtggtcacaggcaaaggcactgtactccagaaagccaaggaatgggagaagaaaggagcaagttagaaaacaagcttcatctaaagactctcatgtcaatgtggaccttggtgacaatcctgctttgttaaagcaaaaactatgcgaaagggtgagtctgtttagaagaaaaagcaaagactgaggtactgtgaatggagagcttcagctaagaggaggctctgtcccttttcagagccaaaggaaataatacaacaaaaaggaggcttctttggagacctaagtctattggatgtaaacaagacgttgtatttagggatgttctgtgtttctttcttttttgaagttgtcatcaattgctttactaagatttttaaatagtgaaaacctcctgtttagactttggtggaagatgaatcaaggaagcagggccctgtcttatgggtcacgtgtctttggtgagtgagaagacctaaactcctggccatcatctcttatccaatacttagcagttggggattaaaccatccttgccttcagttctctccaatattaccaggcccaactcagtcttcagtgattttaaacagcattgacatcatctgtaaaaccatcatctgtaaaaccatctatgacatgagttttgagaaacaataatggggaaaatatttgggaccaagctgaagcactaatcccactaagttaaagacttctttccagtccaaggcaggcctgaatcaactgtctttaaataaaattttaagtgatgctgtattatatataggaaaaaatgcttaaaatcctgtcatttagaacagtgaaaagtatcttttgagattaaagtgactctttactgtaggaaaaatattactctgtgtttacagattcattgctgtggtcaggccatttttaagggaagagttatttaatataaatagtctctgattttaagttctgtttaatgttcattctccttccaagaacaaagtggtgatttttggttagggtgatcgccctcttaaaattggcagtgctgttccttgtgctgcccctgtcttttcctctgatggcatttttttttttttttttttaacacaggttgaaacatttcatctattatctctgcctcatttctggagggttgtgtatcagttctctaacacttgttcctgagaactaaatgtcttttttattcttatttcctctctcataaacatttggtgaccttttaccaagtggtgagttagttaggttttttaaaataaaatgttcattgtatttgaa

SEQ ID NO: 103897 - DNA, 3964 bp, Homo sapiens
  Payload ID: 425
  Gene Symbol: AFAP1L2
  Gene Name: actin filament associated protein 1-like 2
  Uniprot ID: Q8N4X5
  ENST ID: ENST00000369271
  CDS Start-End: 302-2746
gtgccaaggcggccgggggcggcgagcggggccgcgggcgcgcaccgactcaagagccgactgtcagcctcggcgggccggagttctccggcgctgggacaggggcgctgggacaggggcgctgggggcgagccctggcgggggccaggtccgaggaccctgggcgcggcggccccgccaggaggtccggccgcgagcgtgacctcacggggaggggccagcgcggcggcctgggcgctgagccgagcgccgggagagcagcgcagaagccgagccgcgaggagcgcactccgtggccccgatggagcggtacaaagccctggaacagctgctgacagagttggatgacttcctcaagattcttgaccaggagaacctgagcagcacagcactggtgaagaagagctgcctggcggagctcctccggctttacaccaaaagcagcagctctgatgaggagtacatttatatgaacaaagtgaccatcaacaagcaacagaatgcagagtctcaaggcaaagcgcctgaggagcagggcctgctacccaatggggagcccagccagcactcctcggcccctcagaagagccttccagacctcccgccacccaagatgattccagaacggaaacagcttgccatcccaaagacggagtctccagagggctactatgaagaggctgagccatatgacacatccctcaatgaggacggagaggctgtgagcagctcctacgagtcctacgatgaagaggacggcagcaagggcaagtcggccccttaccagtggccctcgccggaggccggcatcgagctgatgcgtgacgcccgcatctgcgccttcctgtggcgcaagaagtggctgggacagtgggccaagcagctctgtgtcatcaaggacaacaggcttctgtgctacaaatcctccaaggaccacagccctcagctggacgtgaacctactgggcagcagcgtcattcacaaggagaagcaagtgcggaagaaggagcacaagctgaagatcacgccgatgaatgccgatgtgattgtgctgggcctgcagagcaaggaccaggctgagcagtggctcagggtcatccaggaagtgagcggcctgccttccgaaggagcatctgaaggaaaccagtacaccccggatgcccagcgctttaactgccagaaaccagatatagctgagaagtacctgtcggcttcagagtatgggagctccgtggatggccaccctgaggtcccagaaaccaaagacgtcaagaagaaatgttctgctggcctcaaactgagcaacctaatgaatctgggcaggaagaaatccacctcactggagcctgtggagaggtccctcgagacatccagttacctgaacgtgctggtgaacagccagtggaagtctcgctggtgctctgtcagggacaatcacctgcacttctaccaggaccggaaccggagcaaggtggcccagcaacccctcagcctggtgggctgcgaggtggtcccagaccccagccccgaccacctctactccttccgcatcctccacaagggcgaggagctggccaagcttgaggccaagtcttccgaggaaatgggccactggctgggtctcctgctctctgagtcaggctccaagacagacccagaagagttcacctacgactatgtggatgccgatagggtctcctgtattgtgagtgcggccaaaaactctctcttactgatgcagagaaagttctcagagcccaacacttacatcgatggcctgcctagccaggaccgccaggaggagctgtatgacgacgtggacctgtcagagctcacagctgcggtggagcctaccgaggaagccacccctgttgcagatgacccaaatgagagagaatctgaccgagtgtacctggacctcacacctgtcaagtcctttctgcatggccccagcagtgcacaggcccaggcctcctccccgacgttgtcctgcctggacaatgcaactgaggccctcccggcagactcaggcccaggtcccaccccagatgagccctgcataaagtgtccagagaacctgggagaacagcagctggagagtttggagccagaggatccttccctgagaatcaccaccgtcaaaatccagacggaacagcagagaatctccttcccaccgagctgcccggatgccgtggtggccaccccacctggtgccagcccacctgtgaaggacaggttgcgcgtgaccagtgcagagatcaagcttggcaagaatcggacagaagctgaggtgaagcggtacacagaggagaaggagaggcttgaaaagaagaaggaagaaatccgggggcacctggctcagctccggaaagagaaacgggagctaaaggaaaccctactgaaatgcacagacaaggaagtcctggcgagcctggagcagaagctgaaggaaattgacgaggagtgccggggcgaggagagcaggcgcgtggacctggagctcagcatcatggaggtgaaggacaacctgaagaaggctgaggcagggcctgtgacgttaggcaccaccgtggacaccacccacctggagaatcccaaagctgtcacacctgcctctgccccagactgtaccccagtcaactctgcaaccacactcaagaacaggcctctctcggtcgtggtcacaggcaaaggcactgtactccagaaagccaaggaatgggagaagaaaggagcaagttagaaaacaagcttcatctaaagactctcatgtcaatgtggaccttggtgacaatcctgctttgttaaagcaaaaactatgcgaaagggtgagtctgtttagaagaaaaagcaaagactgaggtactgtgaatggagagcttcagctaagaggaggctctgtcccttttcagagccaaaggaaataatacaacaaaaaggaggcttctttggagacctaagtctattggatgtaaacaagacgttgtatttagggatgttctgtgtttctttcttttttgaagttgtcatcaattgctttactaagatttttaaatagtgaaaacctcctgtttagactttggtggaagatgaatcaaggaagcagggccctgtcttatgggtcacgtgtctttggtgagtgagaagacctaaactcctggccatcatctcttatccaatacttagcagttggggattaaaccatccttgccttcagttctctccaatattaccaggcccaactcagtcttcagtgattttaaacagcattgacatcatctgtaaaaccatcatctgtaaaaccatctatgacatgagttttgagaaacaataatggggaaaatatttgggaccaagctgaagcactaatcccactaagttaaagacttctttccagtccaaggcaggcctgaatcaactgtctttaaataaaattttaagtgatgctgtattatatataggaaaaaatgcttaaaatcctgtcatttagaacagtgaaaagtatcttttgagattaaagtgactctttactgtaggaaaaatattactctgtgtttacagattcattgctgtggtcaggccatttttaagggaagagttatttaatataaatagtctctgattttaagttctgtttaatgttcattctccttccaagaacaaagtggtgatttttggttagggtgatcgccctcttaaaattggcagtgctgttccttgtgctgcccctgtcttttcctctgatggcatttttttttttttttttttaacacaggttgaaacatttcatctattatctctgcctcatttctggagggttgtgtatcagttctctaacacttgttcctgagaactaaatgtcttttttattcttatttcctctctcataaacatttggtgaccttttaccaagtggtgagttagttaggttttttaaaataaaatgttcattgtatttgaa

SEQ ID NO: 103898 - DNA, 961 bp, Homo sapiens
  Payload ID: 425
  Gene Symbol: AFAP1L2
  Gene Name: actin filament associated protein 1-like 2
  ENST ID: ENST00000419268
  CDS Start-End: 26-961
gcgaggagcgcactccgtggccccgatggagcggtacaaagcacaggggtgttgctgtctggtggtacagagaaggatccggcaggtttctgcgtccctggaacagctgctgacagagttggatgacttcctcaagattcttgaccaggagaacctgagcagcacagcactggtgaagaagagctgcctggcggagctcctccggctttacaccaaaagcagcagctctgatgaggagtacatttatatgaacaaagtgaccatcaacaagcaacagaatgcagagtctcaaggcaaagcgcctgaggagcagggcctgctacccaatggggagcccagccagcactcctcggcccctcagaagagccttccagacctcccgccacccaagatgattccagaacggaaacagcttgccatcccaaagacggagtctccagagggctactatgaagaggctgagccatatgacacatccctcaatgaggacggagaggctgtgagcagctcctacgagtcctacgatgaagaggacggcagcaagggcaagtcggccccttaccagtggccctcgccggaggccggcatcgagctgatgcgtgacgcccgcatctgcgccttcctgtggcgcaagaagtggctgggacagtgggccaagcagctctgtgtcatcaaggacaacaggcttctgtgctacaaatcctccaaggaccacagccctcagctggacgtgaacctactgggcagcagcgtcattcacaaggagaagcaagtgcggaagaaggagcacaagctgaagatcacgccgatgaatgccgatgtgattgtgctgggcctgcagagcaaggaccaggctgagcagtggctcagggtcatccaggaagtgagcggcctgccttccgaaggagcatctgaaggaaaccagtacaccccggatgcccagcgctttaactgccagaaa

SEQ ID NO: 103899 - DNA, 1994 bp, Homo sapiens
  Payload ID: 426
  Gene Symbol: ACTG1
  Gene Name: actin gamma 1
  Uniprot ID: P63261
  ENST ID: ENST00000331925
  CDS Start-End: 148-1275
ggggccgcgcgcgccgccgggccgcgcgggcgcgccgcttccgcttaaataacggcgggggaggccgcggtcggtctcagtcgccgctgccagctctcgcactctgttcttccgccgctccgccgtcgcgtttctctgccggtcgcaatggaagaagagatcgccgcgctggtcattgacaatggctccggcatgtgcaaagctggttttgctggggacgacgctccccgagccgtgtttccttccatcgtcgggcgccccagacaccagggcgtcatggtgggcatgggccagaaggactcctacgtgggcgacgaggcccagagcaagcgtggcatcctgaccctgaagtaccccattgagcatggcatcgtcaccaactgggacgacatggagaagatctggcaccacaccttctacaacgagctgcgcgtggccccggaggagcacccagtgctgctgaccgaggcccccctgaaccccaaggccaacagagagaagatgactcagattatgtttgagaccttcaacaccccggccatgtacgtggccatccaggccgtgctgtccctctacgcctctgggcgcaccactggcattgtcatggactctggagacggggtcacccacacggtgcccatctacgagggctacgccctcccccacgccatcctgcgtctggacctggctggccgggacctgaccgactacctcatgaagatcctcactgagcgaggctacagcttcaccaccacggccgagcgggaaatcgtgcgcgacatcaaggagaagctgtgctacgtcgccctggacttcgagcaggagatggccaccgccgcatcctcctcttctctggagaagagctacgagctgcccgatggccaggtcatcaccattggcaatgagcggttccggtgtccggaggcgctgttccagccttccttcctgggtatggaatcttgcggcatccacgagaccaccttcaactccatcatgaagtgtgacgtggacatccgcaaagacctgtacgccaacacggtgctgtcgggcggcaccaccatgtacccgggcattgccgacaggatgcagaaggagatcaccgccctggcgcccagcaccatgaagatcaagatcatcgcacccccagagcgcaagtactcggtgtggatcggtggctccatcctggcctcactgtccaccttccagcagatgtggattagcaagcaggagtacgacgagtcgggcccctccatcgtccaccgcaaatgcttctaaacggactcagcagatgcgtagcatttgctgcatgggttaattgagaatagaaatttgcccctggcaaatgcacacacctcatgctagcctcacgaaactggaataagccttcgaaaagaaattgtccttgaagcttgtatctgatatcagcactggattgtagaacttgttgctgattttgaccttgtattgaagttaactgttccccttggtatttgtttaataccctgtacatatctttgagttcaacctttagtacgtgtggcttggtcacttcgtggctaaggtaagaacgtgcttgtggaagacaagtctgtggcttggtgagtctgtgtggccagcagcctctgatctgtgcagggtattaacgtgtcagggctgagtgttctgggatttctctagaggctggcaagaaccagttgttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattaggccccagcaacacgtcattgtgtaaggaaaaataaaagtgctgccgtaaccaa

SEQ ID NO: 103900 - DNA, 2256 bp, Homo sapiens
  Payload ID: 426
  Gene Symbol: ACTG1
  Gene Name: actin gamma 1
  Uniprot ID: P63261
  ENST ID: ENST00000575842
  CDS Start-End: 428-1555
ctctcgcactctgttcttccgccgctccgccgtcgcgtttctctgccggtgagcgccccgccccggggcctgagctggacgtcgcaggcctgcgccccccgaccccggctggccccgcttccagctgccgaggcctcgtcgcgccttccccgggaacaaaaggcggggtgggccgggtcaggcggacggggctgggggggcgccgggggtccagggcggggcccggccgcagtgcagacttccgagccgtggacgttacgtaaaaggcccggccttcggttccaggcggttgcgatcttggaggccacggccgctggggttggggcagggccgaggcttccccgcgggagggcattaggtggctgtggggaggggaccgtgttacagacgcgcccgcctgagtccatccttttccgggcaggtcgcaatggaagaagagatcgccgcgctggtcattgacaatggctccggcatgtgcaaagctggttttgctggggacgacgctccccgagccgtgtttccttccatcgtcgggcgccccagacaccagggcgtcatggtgggcatgggccagaaggactcctacgtgggcgacgaggcccagagcaagcgtggcatcctgaccctgaagtaccccattgagcatggcatcgtcaccaactgggacgacatggagaagatctggcaccacaccttctacaacgagctgcgcgtggccccggaggagcacccagtgctgctgaccgaggcccccctgaaccccaaggccaacagagagaagatgactcagattatgtttgagaccttcaacaccccggccatgtacgtggccatccaggccgtgctgtccctctacgcctctgggcgcaccactggcattgtcatggactctggagacggggtcacccacacggtgcccatctacgagggctacgccctcccccacgccatcctgcgtctggacctggctggccgggacctgaccgactacctcatgaagatcctcactgagcgaggctacagcttcaccaccacggccgagcgggaaatcgtgcgcgacatcaaggagaagctgtgctacgtcgccctggacttcgagcaggagatggccaccgccgcatcctcctcttctctggagaagagctacgagctgcccgatggccaggtcatcaccattggcaatgagcggttccggtgtccggaggcgctgttccagccttccttcctgggtatggaatcttgcggcatccacgagaccaccttcaactccatcatgaagtgtgacgtggacatccgcaaagacctgtacgccaacacggtgctgtcgggcggcaccaccatgtacccgggcattgccgacaggatgcagaaggagatcaccgccctggcgcccagcaccatgaagatcaagatcatcgcacccccagagcgcaagtactcggtgtggatcggtggctccatcctggcctcactgtccaccttccagcagatgtggattagcaagcaggagtacgacgagtcgggcccctccatcgtccaccgcaaatgcttctaaacggactcagcagatgcgtagcatttgctgcatgggttaattgagaatagaaatttgcccctggcaaatgcacacacctcatgctagcctcacgaaactggaataagccttcgaaaagaaattgtccttgaagcttgtatctgatatcagcactggattgtagaacttgttgctgattttgaccttgtattgaagttaactgttccccttggtatttgtttaataccctgtacatatctttgagttcaacctttagtacgtgtggcttggtcacttcgtggctaaggtaagaacgtgcttgtggaagacaagtctgtggcttggtgagtctgtgtggccagcagcctctgatctgtgcagggtattaacgtgtcagggctgagtgttctgggatttctctagaggctggcaagaaccagttgttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattaggccccagcaacacgtcattgtgtaaggaaaaataa

SEQ ID NO: 103901 - DNA, 2002 bp, Homo sapiens
  Payload ID: 426
  Gene Symbol: ACTG1
  Gene Name: actin gamma 1
  Uniprot ID: P63261
  ENST ID: ENST00000573283
  CDS Start-End: 173-1300
tctcgcactctgttcttccgccgctccgccgtcgcgtttctctgccggtgagcgccccgccccggggcctgagctggacgtcgcaggcctgcgccccccgaccccggctggccccgcttccagctgccgaggcctcgtcgcgccttccccgggaacaaaaggcggggtcgcaatggaagaagagatcgccgcgctggtcattgacaatggctccggcatgtgcaaagctggttttgctggggacgacgctccccgagccgtgtttccttccatcgtcgggcgccccagacaccagggcgtcatggtgggcatgggccagaaggactcctacgtgggcgacgaggcccagagcaagcgtggcatcctgaccctgaagtaccccattgagcatggcatcgtcaccaactgggacgacatggagaagatctggcaccacaccttctacaacgagctgcgcgtggccccggaggagcacccagtgctgctgaccgaggcccccctgaaccccaaggccaacagagagaagatgactcagattatgtttgagaccttcaacaccccggccatgtacgtggccatccaggccgtgctgtccctctacgcctctgggcgcaccactggcattgtcatggactctggagacggggtcacccacacggtgcccatctacgagggctacgccctcccccacgccatcctgcgtctggacctggctggccgggacctgaccgactacctcatgaagatcctcactgagcgaggctacagcttcaccaccacggccgagcgggaaatcgtgcgcgacatcaaggagaagctgtgctacgtcgccctggacttcgagcaggagatggccaccgccgcatcctcctcttctctggagaagagctacgagctgcccgatggccaggtcatcaccattggcaatgagcggttccggtgtccggaggcgctgttccagccttccttcctgggtatggaatcttgcggcatccacgagaccaccttcaactccatcatgaagtgtgacgtggacatccgcaaagacctgtacgccaacacggtgctgtcgggcggcaccaccatgtacccgggcattgccgacaggatgcagaaggagatcaccgccctggcgcccagcaccatgaagatcaagatcatcgcacccccagagcgcaagtactcggtgtggatcggtggctccatcctggcctcactgtccaccttccagcagatgtggattagcaagcaggagtacgacgagtcgggcccctccatcgtccaccgcaaatgcttctaaacggactcagcagatgcgtagcatttgctgcatgggttaattgagaatagaaatttgcccctggcaaatgcacacacctcatgctagcctcacgaaactggaataagccttcgaaaagaaattgtccttgaagcttgtatctgatatcagcactggattgtagaacttgttgctgattttgaccttgtattgaagttaactgttccccttggtatttgtttaataccctgtacatatctttgagttcaacctttagtacgtgtggcttggtcacttcgtggctaaggtaagaacgtgcttgtggaagacaagtctgtggcttggtgagtctgtgtggccagcagcctctgatctgtgcagggtattaacgtgtcagggctgagtgttctgggatttctctagaggctggcaagaaccagttgttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattaggccccagcaacacgtcattgtgtaaggaaaaataaa

SEQ ID NO: 103902 - DNA, 742 bp, Homo sapiens
  Payload ID: 426
  Gene Symbol: ACTG1
  Gene Name: actin gamma 1
  ENST ID: ENST00000575659
  CDS Start-End: 101-742
gcgggtggcggggaacccgggggtctcgaggcgccagcctcgcccccgcccccacgaccctggcggcctcgggtccgcaacgtggggaagaaaggtcgcaatggaagaagagatcgccgcgctggtcattgacaatggctccggcatgtgcaaagctggttttgctggggacgacgctccccgagccgtgtttccttccatcgtcgggcgccccagacaccagggcgtcatggtgggcatgggccagaaggactcctacgtgggcgacgaggcccagagcaagcgtggcatcctgaccctgaagtaccccattgagcatggcatcgtcaccaactgggacgacatggagaagatctggcaccacaccttctacaacgagctgcgcgtggccccggaggagcacccagtgctgctgaccgaggcccccctgaaccccaaggccaacagagagaagatgactcagattatgtttgagaccttcaacaccccggccatgtacgtggccatccaggccgtgctgtccctctacgcctctgggcgcaccactggcattgtcatggactctggagacggggtcacccacacggtgcccatctacgagggctacgccctcccccacgccatcctgcgtctggacctggctggccgggacctgaccgactacctcatgaagatcctcactgagcgaggctacagcttcaccaccacggccgagcgggaaatcgtgcgcgacatcaaggag

SEQ ID NO: 103903 - DNA, 2001 bp, Homo sapiens
  Payload ID: 426
  Gene Symbol: ACTG1
  Gene Name: actin gamma 1
  Uniprot ID: P63261
  ENST ID: ENST00000575087
  CDS Start-End: 192-1319
cgctgccagctctcgcactctgttcttccgccgctccgccgtcgcgtttctctgccggtgagcgccccgccccggggcctgagctggacgtcgcaggcctgcgccccccgaccccggctggccccgcttccagctgccgaggcctcgtcgcgccttccccgggaacaaaaggcggggtgggccgggtcgcaatggaagaagagatcgccgcgctggtcattgacaatggctccggcatgtgcaaagctggttttgctggggacgacgctccccgagccgtgtttccttccatcgtcgggcgccccagacaccagggcgtcatggtgggcatgggccagaaggactcctacgtgggcgacgaggcccagagcaagcgtggcatcctgaccctgaagtaccccattgagcatggcatcgtcaccaactgggacgacatggagaagatctggcaccacaccttctacaacgagctgcgcgtggccccggaggagcacccagtgctgctgaccgaggcccccctgaaccccaaggccaacagagagaagatgactcagattatgtttgagaccttcaacaccccggccatgtacgtggccatccaggccgtgctgtccctctacgcctctgggcgcaccactggcattgtcatggactctggagacggggtcacccacacggtgcccatctacgagggctacgccctcccccacgccatcctgcgtctggacctggctggccgggacctgaccgactacctcatgaagatcctcactgagcgaggctacagcttcaccaccacggccgagcgggaaatcgtgcgcgacatcaaggagaagctgtgctacgtcgccctggacttcgagcaggagatggccaccgccgcatcctcctcttctctggagaagagctacgagctgcccgatggccaggtcatcaccattggcaatgagcggttccggtgtccggaggcgctgttccagccttccttcctgggtatggaatcttgcggcatccacgagaccaccttcaactccatcatgaagtgtgacgtggacatccgcaaagacctgtacgccaacacggtgctgtcgggcggcaccaccatgtacccgggcattgccgacaggatgcagaaggagatcaccgccctggcgcccagcaccatgaagatcaagatcatcgcacccccagagcgcaagtactcggtgtggatcggtggctccatcctggcctcactgtccaccttccagcagatgtggattagcaagcaggagtacgacgagtcgggcccctccatcgtccaccgcaaatgcttctaaacggactcagcagatgcgtagcatttgctgcatgggttaattgagaatagaaatttgcccctggcaaatgcacacacctcatgctagcctcacgaaactggaataagccttcgaaaagaaattgtccttgaagcttgtatctgatatcagcactggattgtagaacttgttgctgattttgaccttgtattgaagttaactgttccccttggtatttgtttaataccctgtacatatctttgagttcaacctttagtacgtgtggcttggtcacttcgtggctaaggtaagaacgtgcttgtggaagacaagtctgtggcttggtgagtctgtgtggccagcagcctctgatctgtgcagggtattaacgtgtcagggctgagtgttctgggatttctctagaggctggcaagaaccagttgttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattaggccccagcaacacgtc

SEQ ID NO: 103904 - DNA, 856 bp, Homo sapiens
  Payload ID: 426
  Gene Symbol: ACTG1
  Gene Name: actin gamma 1
  ENST ID: ENST00000575994
  CDS Start-End: 213-856
ggagaggtggctcctcgccctgctggactggagccctgaaaactgggaaatggagccctggggccaccccgcggctgaggaccacgcctttcacaggccagcagtgcctgcagccctccctgcaggcatcggaggagcccccacctcagtgccaggccctgaccgctgccactcctgttggcatccctgtctccagtgattcccaggtcgcaatggaagaagagatcgccgcgctggtcattgacaatggctccggcatgtgcaaagctggttttgctggggacgacgctccccgagccgtgtttccttccatcgtcgggcgccccagacaccagggcgtcatggtgggcatgggccagaaggactcctacgtgggcgacgaggcccagagcaagcgtggcatcctgaccctgaagtaccccattgagcatggcatcgtcaccaactgggacgacatggagaagatctggcaccacaccttctacaacgagctgcgcgtggccccggaggagcacccagtgctgctgaccgaggcccccctgaaccccaaggccaacagagagaagatgactcagattatgtttgagaccttcaacaccccggccatgtacgtggccatccaggccgtgctgtccctctacgcctctgggcgcaccactggcattgtcatggactctggagacggggtcacccacacggtgcccatctacgagggctacgccctcccccacgccatcctgcgtctggacctggctggccgggacctgaccgactacctcatgaagatcctcactgagcgaggctacagcttcaccaccacggccgagcgggaaatcgtgcgcgacatcaaggagaa

SEQ ID NO: 103905 - DNA, 813 bp, Homo sapiens
  Payload ID: 426
  Gene Symbol: ACTG1
  Gene Name: actin gamma 1
  ENST ID: ENST00000571721
  CDS Start-End: 322-813
tcgcactctgttcttccgccgctccgccgtcgcgtttctctgccggtgagcgccccgccccggggcctgagctggacgtcgcaggcctgcgccccccgaccccggctggccccgcttccagctgccgaggcctcgtcgcgccttccccgggaacaaaaggcggggtgggccgggtcaggcggacggggctgggggggcgccgggggtccagggcggggcccggccgcagtgcagacttccgagccgtggacgttacgtaaaaggcccggccttcggttccaggcggttgcgatcttggaggccacggccgctggggtcgcaatggaagaagagatcgccgcgctggtcattgacaatggctccggcatgtgcaaagctggttttgctggggacgacgctccccgagccgtgtttccttccatcgtcgggcgccccagacaccagggcgtcatggtgggcatgggccagaaggactcctacgtgggcgacgaggcccagagcaagcgtggcatcctgaccctgaagtaccccattgagcatggcatcgtcaccaactgggacgacatggagaagatctggcaccacaccttctacaacgagctgcgcgtggccccggaggagcacccagtgctgctgaccgaggcccccctgaaccccaaggccaacagagagaagatgactcagattatgtttgagaccttcaacaccccggccatgtacgtggccatccaggccgtgctgtccctctacgcctctgggcgcaccactggcattgtcatggactctggagacggggtcacccacacggtgccc

SEQ ID NO: 103906 - DNA, 761 bp, Homo sapiens
  Payload ID: 426
  Gene Symbol: ACTG1
  Gene Name: actin gamma 1
  ENST ID: ENST00000571691
  CDS Start-End: 37-761
ccgccgctccgccgtcgcgtttctctgccggtcgcaatggaagaagagatcgccgcgctggtcattgacaatggctccggcatgtgcaaagctggttttgctggggacgacgctccccgagccgtgtttccttccatcgtcgggcgccccagacaccaggactcctacgtgggcgacgaggcccagagcaagcgtggcatcctgaccctgaagtaccccattgagcatggcatcgtcaccaactgggacgacatggagaagatctggcaccacaccttctacaacgagctgcgcgtggccccggaggagcacccagtgctgctgaccgaggcccccctgaaccccaaggccaacagagagaagatgactcagattatgtttgagaccttcaacaccccggccatgtacgtggccatccaggccgtgctgtccctctacgcctctgggcgcaccactggcattgtcatggactctggagacggggtcacccacacggtgcccatctacgagggctacgccctcccccacgccatcctgcgtctggacctggctggccgggacctgaccgactacctcatgaagatcctcactgagcgaggctacagcttcaccaccacggccgagcgggaaatcgtgcgcgacatcaaggagaagctgtgctacgtcgccctggacttcgagcaggagatggccaccgccgcatcctcctcttctctggagaagagctacgagctgcccgatggccaggtcatcaccattgg

SEQ ID NO: 103907 - DNA, 1720 bp, Homo sapiens
  Payload ID: 426
  Gene Symbol: ACTG1
  Gene Name: actin gamma 1
  Uniprot ID: P63261
  ENST ID: ENST00000576544
  CDS Start-End: 65-1192
ccgctgccagctctcgcactctgttcttccgccgctccgccgtcgcgtttctctgccggtcgcaatggaagaagagatcgccgcgctggtcattgacaatggctccggcatgtgcaaagctggttttgctggggacgacgctccccgagccgtgtttccttccatcgtcgggcgccccagacaccagggcgtcatggtgggcatgggccagaaggactcctacgtgggcgacgaggcccagagcaagcgtggcatcctgaccctgaagtaccccattgagcatggcatcgtcaccaactgggacgacatggagaagatctggcaccacaccttctacaacgagctgcgcgtggccccggaggagcacccagtgctgctgaccgaggcccccctgaaccccaaggccaacagagagaagatgactcagattatgtttgagaccttcaacaccccggccatgtacgtggccatccaggccgtgctgtccctctacgcctctgggcgcaccactggcattgtcatggactctggagacggggtcacccacacggtgcccatctacgagggctacgccctcccccacgccatcctgcgtctggacctggctggccgggacctgaccgactacctcatgaagatcctcactgagcgaggctacagcttcaccaccacggccgagcgggaaatcgtgcgcgacatcaaggagaagctgtgctacgtcgccctggacttcgagcaggagatggccaccgccgcatcctcctcttctctggagaagagctacgagctgcccgatggccaggtcatcaccattggcaatgagcggttccggtgtccggaggcgctgttccagccttccttcctgggtatggaatcttgcggcatccacgagaccaccttcaactccatcatgaagtgtgacgtggacatccgcaaagacctgtacgccaacacggtgctgtcgggcggcaccaccatgtacccgggcattgccgacaggatgcagaaggagatcaccgccctggcgcccagcaccatgaagatcaagatcatcgcacccccagagcgcaagtactcggtgtggatcggtggctccatcctggcctcactgtccaccttccagcagatgtggattagcaagcaggagtacgacgagtcgggcccctccatcgtccaccgcaaatgcttctaaacggactcagcagatgcgtagcatttgctgcatgggttaattgagaatagaaatttgcccctggcaaatgcacacacctcatgctagcctcacgaaactggaataagccttcgaaaagaaattgtccttgaagcttgtatctgatatcagcactggattgtagaacttgttgctgattttgaccttgtattgaagttaactgttccccttgggtattaacgtgtcagggctgagtgttctgggatttctctagaggctggcaagaaccagttgttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattaggccccagcaac

SEQ ID NO: 103908 - DNA, 1168 bp, Homo sapiens
  Payload ID: 426
  Gene Symbol: ACTG1
  Gene Name: actin gamma 1
  ENST ID: ENST00000572105
  CDS Start-End: 55-651
ctctcgcactctgttcttccgccgctccgccgtcgcgtttctctgccggtcgcaatggaagaagagatcgccgcgctggtcattgacaatggctccggcatgtgcaaagctggttttgctggggacgacgctccccgagccgtgtttccttccatcgtcgggcgccccagacaccagggcgtcatggtgggcatgggccagaaggactcctacgtgggcgacgaggcccagagcaagcgtggcatcctgaccctgaagtaccccattgagcatggcatcgtcaccaactgggacgacatggagaagatctggcaccacaccttctacaacgagctgcgcgtggccccggaggagcacccagtgctgctgaccgaggcccccctgaaccccaaggccaacagagagaagatgactcaggctctgttcctctcccggcatttcctccctgaagcctccagattatgtttgagaccttcaacaccccggccatgtacgtggccatccaggccgtgctgtccctctacgcctctgggcgcaccactggcattgtcatggactctggagacggggtcacccacacggtgcccatctacgagggctacgccctcccccacgccatcctgcgtctggacctggctggccgggacctgaccgactacctcatgaagatcctcactgagcgaggctacagcttcaccaccacggccgagcgggaaatcgtgcgcgacatcaaggagaagctgtgctacgtcgccctggacttcgagcaggagatggccaccgccgcatcctcctcttctctggagaagagctacgagctgcccgatggccaggtcatcaccattggcaatgagcggttccggtgtccggaggcgctgttccagccttccttcctgggtatggaatcttgcggcatccacgagaccaccttcaactccatcatgaagtgtgacgtggacatccgcaaagacctgtacgccaacacggtgctgtcgggcggcaccaccatgtacccgggcattgccgacaggatgcagaaggagatcaccgccctggcgcccagcaccatgaagatcaagatcatcgcacccccagagcgcaagtactcggtgtggatcggtggctccatcctggcctcactgtccaccttccagcagatgtggattag

SEQ ID NO: 103909 - DNA, 471 bp, Homo sapiens
  Payload ID: 426
  Gene Symbol: ACTG1
  Gene Name: actin gamma 1
  ENST ID: ENST00000570382
  CDS Start-End: 73-471
ctcagtcgccgctgccagctctcgcactctgttcttccgccgctccgccgtcgcgtttctctgccggtcgcaatggaagaagagatcgccgcgctggtcattgacaatggctccggcatgtgcaaagctggttttgctggggacgacgctccccgagccgtgtttccttccatcgtcgggcgccccagacaccagggcgtcatggtgggcatgggccagaaggactcctacgtgggcgacgaggcccagagcaagcgtggcatcctgaccctgaagtaccccattgagcatggcatcgtcaccaactgggacgacatggagaagatctggcaccacaccttctacaacgagctgcgcgtggccccggaggagcacccagtgctgctgaccgaggcccccctgaaccccaaggccgtgctgtccctctacgcctctgggcgcaccactggcattgtcatggactctggagac

SEQ ID NO: 103910 - DNA, 1723 bp, Homo sapiens
  Payload ID: 426
  Gene Symbol: ACTG1
  Gene Name: actin gamma 1
  Uniprot ID: P63261
  ENST ID: ENST00000615544
  CDS Start-End: 29-1156
ccgccgtcgcgtttctctgccggtcgcaatggaagaagagatcgccgcgctggtcattgacaatggctccggcatgtgcaaagctggttttgctggggacgacgctccccgagccgtgtttccttccatcgtcgggcgccccagacaccagggcgtcatggtgggcatgggccagaaggactcctacgtgggcgacgaggcccagagcaagcgtggcatcctgaccctgaagtaccccattgagcatggcatcgtcaccaactgggacgacatggagaagatctggcaccacaccttctacaacgagctgcgcgtggccccggaggagcacccagtgctgctgaccgaggcccccctgaaccccaaggccaacagagagaagatgactcagattatgtttgagaccttcaacaccccggccatgtacgtggccatccaggccgtgctgtccctctacgcctctgggcgcaccactggcattgtcatggactctggagacggggtcacccacacggtgcccatctacgagggctacgccctcccccacgccatcctgcgtctggacctggctggccgggacctgaccgactacctcatgaagatcctcactgagcgaggctacagcttcaccaccacggccgagcgggaaatcgtgcgcgacatcaaggagaagctgtgctacgtcgccctggacttcgagcaggagatggccaccgccgcatcctcctcttctctggagaagagctacgagctgcccgatggccaggtcatcaccattggcaatgagcggttccggtgtccggaggcgctgttccagccttccttcctgggtatggaatcttgcggcatccacgagaccaccttcaactccatcatgaagtgtgacgtggacatccgcaaagacctgtacgccaacacggtgctgtcgggcggcaccaccatgtacccgggcattgccgacaggatgcagaaggagatcaccgccctggcgcccagcaccatgaagatcaagatcatcgcacccccagagcgcaagtactcggtgtggatcggtggctccatcctggcctcactgtccaccttccagcagatgtggattagcaagcaggagtacgacgagtcgggcccctccatcgtccaccgcaaatgcttctaaacggactcagcagatgcgtagcatttgctgcatgggttaattgagaatagaaatttgcccctggcaaatgcacacacctcatgctagcctcacgaaactggaataagccttcgaaaagaaattgtccttgaagcttgtatctgatatcagcactggattgtagaacttgttgctgattttgaccttgtattgaagttaactgttccccttggtattaacgtgtcagggctgagtgttctgggatttctctagaggctggcaagaaccagttgttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattaggccccagcaacacgtcattgtgtaaggaaaaataaaagtgctgccgtaacc

SEQ ID NO: 103911 - DNA, 1565 bp, Homo sapiens
  Payload ID: 427
  Gene Symbol: ARPC1A
  Gene Name: actin related protein 2/3 complex, subunit 1A, 41kDa
  Uniprot ID: Q92747
  ENST ID: ENST00000262942
  CDS Start-End: 125-1237
gtcctccgcccgcgcccgacggagcctgttcgcgtcgactgcccagagtccgcgaatcctccgctccgagcccgtccggactcccccgatcccagctttctctcctttgaaaacactaagaataatgtcactgcatcagtttttactagagccaatcacctgtcatgcctggaacagggatcgtactcagattgccctcagtcccaataatcacgaagtgcacatctataagaagaacgggagccagtgggtgaaagctcatgaactcaaggagcacaacggacacatcacaggtattgactgggctcccaagagcgaccgcattgtcacttgtggggcagaccgcaatgcctatgtctggagtcagaaagatggtgtttggaagccaaccctggtgatcctgagaattaatcgcgcagctacttttgtgaagtggtcccccctagagaacaaatttgctgtgggaagtggagcacgactcatttctgtttgttactttgagtctgaaaatgactggtgggtgagcaagcacattaaaaagccgattcgctccacagtcctcagcttggattggcatcccaacaacgttttgctggcagcaggatcatgtgacttcaaatgcagagtgttttctgcctacattaaagaagtggatgaaaagccagccagcacgccctggggcagcaagatgccttttgggcagctgatgtcagagtttggtggcagtggcactggtggctgggtccacggggtaagcttctctgccagtgggagccgcctggcctgggtcagccacgacagcaccgtgtctgttgctgatgcctcaaaaagtgtgcaggtctcgactctgaagacagagttcctgccgctcctaagtgtgtcatttgtctcagagaacagcgtcgtggctgctggccatgactgctgcccaatgctctttaactacgatgaccgcggctgcctgaccttcgtctccaagttagatattccaaaacagagcatccaacgcaacatgtctgccatggaacgcttccgcaacatggacaagagagccacaactgaggaccgcaacacggccttggagacgctgcaccagaatagcatcactcaagtctctatttatgaggtggacaagcaagattgtcgcaaattttgcactactggcatcgatggagccatgacaatttgggatttcaagaccctcgagtcttccatccagggcctccggataatgtgaagctgagtgagcctccgccatccagcatgacaaactgtggccgaccgcagctgtgccgtggcacgatggcgaggaagccagccccaaggaaacactgaaaacacatatcacgccaatgccgtgtggttttgtttgaatataaaattggtgaaagtgttggtttttttaaggcagtaatttttttgtttgtttttttgcgatttcattccattcttgaccaaagcttctctttaagtagtttattatggaaaattgtcacactaacttaaaagacagggtgagggagatatgtaaattgtccactagaaaattaaataaaagaactgaa

SEQ ID NO: 103912 - DNA, 1516 bp, Homo sapiens
  Payload ID: 427
  Gene Symbol: ARPC1A
  Gene Name: actin related protein 2/3 complex, subunit 1A, 41kDa
  ENST ID: ENST00000432786
  CDS Start-End: 108-947
gacggagcctgttcgcgtcgactgcccagagtccgcgaatcctccgctccgagcccgtccggactcccccgatcccagctttctctcctttgaaaacactaagaataatgtcactgcatcagtttttactagagccaatcacctgtcatgcctggaacagggatcgtactcagattgccctcagtcccaataatcacgaagtgcacatctataagaagaacgggagccagtgggtgaaagctcatgaactcaaggagcacaacggacacatcacaggtattgactgggctcccaagagcgaccgcattgtcacttgtggggcagaccgcaatgcctatgtctggagtcagaaagatggtgtttggaagccaaccctggtgatcctgagaattaatcgcgcagctacttttgtgaagtggtcccccctagagaacaaatttgctgtgggaagtggagcacgactcatttctgtttgttactttgagtctgaaaatgactggtgggtgagcaagcacattaaaaagccgattcgctccacagtcctcagcttggattggcatcccaacaacgttttgctggcagcaggatcatgtgacttcaaatgcagagtgttttctgcctacattaaagaagtggatgaaaagccagccagcacgccctggggcagcaagatgccttttgggcagctgatgtcagagtttggtggcagtggcactggtggctgggtccacggggtaagcttctctgccagtgggagccgcctggcctgggtcagccacgacagcaccgtgtctgttgctgatgcctcaaaaagtgtgcaggtctcgactctgaagacagagttcctgccgctcctaagtgtgtcatttgtctcagagaacagctcttgtttcagggccatgactgctgcccaatgctctttaactacgatgaccgcggctgcctgaccttcgtctccaagttagatattccaaaacagagcatccaacgcaacatgtctgccatggaacgcttccgcaacatggacaagagagccacaactgaggaccgcaacacggccttggagacgctgcaccagaatagcatcactcaagtctctatttatgaggtggacaagcaagattgtcgcaaattttgcactactggcatcgatggagccatgacaatttgggatttcaagaccctcgagtcttccatccagggcctccggataatgtgaagctgagtgagcctccgccatccagcatgacaaactgtggccgaccgcagctgtgccgtggcacgatggcgaggaagccagccccaaggaaacactgaaaacacatatcacgccaatgccgtgtggttttgtttgaatataaaattggtgaaagtgttggtttttttaaggcagtaatttttttgtttgtttttttgcgatttcattccattcttgaccaaagcttctctttaagtagtttattatggaaaattgtcacactaacttaaaagacagggtgagggagatatgtaaatt

SEQ ID NO: 103913 - DNA, 1702 bp, Homo sapiens
  Payload ID: 427
  Gene Symbol: ARPC1A
  Gene Name: actin related protein 2/3 complex, subunit 1A, 41kDa
  ENST ID: ENST00000441989
  CDS Start-End: 137-298
ctctgggcttccgtcctccgcccgcgcccgacggagcctgttcgcgtcgactgcccagagtccgcgaatcctccgctccgagcccgtccggactcccccgatcccagctttctctcctttgaaaacactaagaataatgtcactgcatcagtttttactagagccaatcacctgtcatgcctggaacagggatcgtactcgaccagtctgtcttgattactatagcttggtgagattgccctcagtcccaataatcacgaagtgcacatctataagaagaacgggagccagtgggtgaaagctcatgaactcaaggagcacaacggacacatcacagggtatgcatatctgcagtgcagtgttgccaggcctcatcagattgccatcattcccacctgtcctgtatgagagtgctcattttcccacaccccgccacatacttgagatgggaagactgaagaatgcatgaaaggttcatccattgcttctgtattgactgggctcccaagagcgaccgcattgtcacttgtggggcagaccgcaatgcctatgtctggagtcagaaagatggtgtttggaagccaaccctggtgatcctgagaattaatcgcgcagctacttttgtgaagtggtcccccctagagaacaaatttgctgtgggaagtggagcacgactcatttctgtttgttactttgagtctgaaaatgactggtgggtgagcaagcacattaaaaagccgattcgctccacagtcctcagcttggattggcatcccaacaacgttttgctggcagcaggatcatgtgacttcaaatgcagagtgttttctgcctacattaaagaagtggatgaaaagccagccagcacgccctggggcagcaagatgccttttgggcagctgatgtcagagtttggtggcagtggcactggtggctgggtccacggggtaagcttctctgccagtgggagccgcctggcctgggtcagccacgacagcaccgtgtctgttgctgatgcctcaaaaagtgtgcaggtctcgactctgaagacagagttcctgccgctcctaagtgtgtcatttgtctcagagaacagcgtcgtggctgctggccatgactgctgcccaatgctctttaactacgatgaccgcggctgcctgaccttcgtctccaagttagatattccaaaacagagcatccaacgcaacatgtctgccatggaacgcttccgcaacatggacaagagagccacaactgaggaccgcaacacggccttggagacgctgcaccagaatagcatcactcaagtctctatttatgaggtggacaagcaagattgtcgcaaattttgcactactggcatcgatggagccatgacaatttgggatttcaaggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctg

SEQ ID NO: 103914 - DNA, 1551 bp, Homo sapiens
  Payload ID: 428
  Gene Symbol: ARPC1B
  Gene Name: actin related protein 2/3 complex, subunit 1B, 41kDa
  Uniprot ID: O15143
  ENST ID: ENST00000252725
  CDS Start-End: 121-1239
ggcaggccccgccccccgcccacgaggaagtggctgctgctccggcgcggagcccagagccggttcggcgcgtcgactgcccagagtccgcggccggggcgcgggaggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggtttgcaagcacatcaagaagcccatccgctccaccgtcctcagcctggactggcaccccaacaatgtgctgctggctgccggctcctgtgacttcaagtgtcggatcttttcagcctacatcaaggaggtggaggaacggccggcacccaccccgtggggctccaagatgccctttggggaactgatgttcgaatccagcagtagctgcggctgggtacatggcgtctgtttctcagccagcgggagccgcgtggcctgggtaagccacgacagcaccgtctgcctggctgatgccgacaagaagatggccgtcgcgactctggcctctgaaacactaccactgctggcgctgaccttcatcacagacaacagcctggtggcagcgggccacgactgcttcccggtgctgttcacctatgacgccgccgcggggatgctgagcttcggcgggcggctggacgttcctaagcagagctcgcagcgtggcttgacggcccgcgagcgcttccagaacctggacaagaaggcgagctccgagggtggcacggctgcgggcgcgggcctagactcgctgcacaagaacagcgtcagccagatctcggtgctcagcggcggcaaggccaagtgctcgcagttctgcaccactggcatggatggcggcatgagtatctgggatgtgaagagcttggagtcagccttgaaggacctcaagatcaaatgacctgtgaggaatatgttgccttcatcctagctgctggggaagcggggagaggggtcagggaggctaatggttgctttgctgaatgtttctggggtaccaatacgagttcccataggggctgctccctcaaaaagggaggggacagatggggagcttttcttacctattcaaggaatacgtgcctttttcttaaatgctttcatttattgaaaaaaaaaaaaaatgcccccaaagcactatgctggtcatgaactgcttcaaaatgtggaggtaataaaatgcaactgtgtaaaaaaaaaaaaaaaaaaaaaa

SEQ ID NO: 103915 - DNA, 561 bp, Homo sapiens
  Payload ID: 428
  Gene Symbol: ARPC1B
  Gene Name: actin related protein 2/3 complex, subunit 1B, 41kDa
  ENST ID: ENST00000458033
  CDS Start-End: 164-561
agagccggttcggcgcgtcgactgcccagagtccgcggccggggcgcgggaggctggagtgtggtgacactaccttgactcactgcagcatctgcctcccgggttccagtgattctcctgcctcagcctctcaggtagctgggattacaggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggt

SEQ ID NO: 103916 - DNA, 1715 bp, Homo sapiens
  Payload ID: 428
  Gene Symbol: ARPC1B
  Gene Name: actin related protein 2/3 complex, subunit 1B, 41kDa
  Uniprot ID: O15143
  ENST ID: ENST00000451682
  CDS Start-End: 310-1428
agagccggttcggcgcgtcgactgcccagagtccgcggccggggcgcgggagtgttcccccaggtgaacctaacttcctggcctccaagatttggggtcagagtcccaagctgcgtcatttagtagaagccgagtgactttgaacaaatcgttgcttttgtctgagcctgggtttcctcctgtacaaactgaagtgtcttgttctgttgcccaggctggagtgtggtgacactaccttgactcactgcagcatctgcctcccgggttccagtgattctcctgcctcagcctctcaggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggtttgcaagcacatcaagaagcccatccgctccaccgtcctcagcctggactggcaccccaacaatgtgctgctggctgccggctcctgtgacttcaagtgtcggatcttttcagcctacatcaaggaggtggaggaacggccggcacccaccccgtggggctccaagatgccctttggggaactgatgttcgaatccagcagtagctgcggctgggtacatggcgtctgtttctcagccagcgggagccgcgtggcctgggtaagccacgacagcaccgtctgcctggctgatgccgacaagaagatggccgtcgcgactctggcctctgaaacactaccactgctggcgctgaccttcatcacagacaacagcctggtggcagcgggccacgactgcttcccggtgctgttcacctatgacgccgccgcggggatgctgagcttcggcgggcggctggacgttcctaagcagagctcgcagcgtggcttgacggcccgcgagcgcttccagaacctggacaagaaggcgagctccgagggtggcacggctgcgggcgcgggcctagactcgctgcacaagaacagcgtcagccagatctcggtgctcagcggcggcaaggccaagtgctcgcagttctgcaccactggcatggatggcggcatgagtatctgggatgtgaagagcttggagtcagccttgaaggacctcaagatcaaatgacctgtgaggaatatgttgccttcatcctagctgctggggaagcggggagaggggtcagggaggctaatggttgctttgctgaatgtttctggggtaccaatacgagttcccataggggctgctccctcaaaaagggaggggacagatggggagcttttcttacctattcaaggaatacgtgcctttttcttaaatgctttcatttattgaaaaaaaaaaaaaatgcccccaaagcactatgctggtcatgaactgcttcaaaatgtggaggtaataaaatgcaactg

SEQ ID NO: 103917 - DNA, 581 bp, Homo sapiens
  Payload ID: 428
  Gene Symbol: ARPC1B
  Gene Name: actin related protein 2/3 complex, subunit 1B, 41kDa
  ENST ID: ENST00000431816
  CDS Start-End: 184-581
agagccggttcggcgcgtcgactgcccagagtccgcggccggggcgcgggagtgtcttgttctgttgcccaggctggagtgtggtgacactaccttgactcactgcagcatctgcctcccgggttccagtgattctcctgcctcagcctctcaggtagctgggattacaggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggt

SEQ ID NO: 103918 - DNA, 572 bp, Homo sapiens
  Payload ID: 428
  Gene Symbol: ARPC1B
  Gene Name: actin related protein 2/3 complex, subunit 1B, 41kDa
  ENST ID: ENST00000414376
  CDS Start-End: 267-572
acagttggcgcccaccggcatcagcgtgaagggagctcctcgctggctgccgacggggctgcagggctcgctagccgctcacctgcgtgtgagcgcggagcccgcagtacccgccgtccgggctcagaggacgtgactccccgaccctgcgcccggcagtccccgggggccgtgcgcccggcccaggctcggaggtccagcccagcggcggctcaggctgcgcgcctggctcccagcctcagtttccccattggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtg

SEQ ID NO: 103919 - DNA, 839 bp, Homo sapiens
  Payload ID: 428
  Gene Symbol: ARPC1B
  Gene Name: actin related protein 2/3 complex, subunit 1B, 41kDa
  ENST ID: ENST00000432343
  CDS Start-End: 16-408
aggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactgatggagtctcactctgtcacccaggctggagtgcagtggcacgatcttggctcacggcagcctctgcctgccgggttcgagcagttctctgcctcagcctcccaagtagctgggattacaggcacctgctaccatgcccggataatttttatatttttagtagagatggggtttcaccatcttggccaggtgggtttgcaagcacatcaagaagcccatccgctccaccgtcctcagcctggactggcaccccaacaatgtgctgctggctgccggctcctgtgacttcaagtgtcggatcttttcagcctacatcaaggaggtggaggaacggccggcacccaccccgtggggctccaagatgccctttggggaactgatgttcgaatccagcagtagctgcggctgggtacatggcgtctgtttctcagc

SEQ ID NO: 103920 - DNA, 545 bp, Homo sapiens
  Payload ID: 428
  Gene Symbol: ARPC1B
  Gene Name: actin related protein 2/3 complex, subunit 1B, 41kDa
  ENST ID: ENST00000427217
  CDS Start-End: 148-545
agagccggttcggcgcgtcgactgcccagagtccgcggccggggcgcgggaggctggagtgtggtgacactaccttgactcactgcagcatctgcctcccgggttccagtgattctcctgcctcagcctctcaggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggt

SEQ ID NO: 103921 - DNA, 559 bp, Homo sapiens
  Payload ID: 428
  Gene Symbol: ARPC1B
  Gene Name: actin related protein 2/3 complex, subunit 1B, 41kDa
  ENST ID: ENST00000417330
  CDS Start-End: 168-559
agagccggttcggcgcgtcgactgcccagagtccgcggccggggcgcgggagtgtcttgttctgttgcccaggctggagtgtggtgacactaccttgactcactgcagcatctgcctcccgggttccagtgattctcctgcctcagcctctcaggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactg

SEQ ID NO: 103922 - DNA, 727 bp, Homo sapiens
  Payload ID: 428
  Gene Symbol: ARPC1B
  Gene Name: actin related protein 2/3 complex, subunit 1B, 41kDa
  ENST ID: ENST00000445924
  CDS Start-End: 16-114
aggagccaagccgccatggcctaccacagcttcctggtggagcccatcagctgccacgcctggaacaaggaccgcacccgacagccagttccaggagaagacagggtggcctagcagggcctgaaggacttcagggggcccctgcaaggcagaagaggagagactgagtcatgaaagagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggtttgcaagcacatcaagaagcccatccgctccaccgtcctcagcctggactggcaccccaacaatgtgctgctggctgccggctcctgtgacttcaagtgtcggatcttttcagcctacatcaaggaggtggaggaacggccggcacccaccccgtggggctccaagatgccctttggggaactgatgttcgaatccagcagtagctgcggctgggt

SEQ ID NO: 103923 - DNA, 348 bp, Homo sapiens
  Payload ID: 428
  Gene Symbol: ARPC1B
  Gene Name: actin related protein 2/3 complex, subunit 1B, 41kDa
  ENST ID: ENST00000429246
  CDS Start-End: 285-348
agagccggttcggcgcgtcgactgcccagagtccgcggccggggcgcgggaggctggagtgtggtgacactaccttgactcactgcagcatctgcctcccgggttccagtgattctcctgcctcagcctctcaggtagctgggattacaggtccctgtgatgctgggaaactgagtcacggaggcggggagagatgtgtttgaggaattgggctgagaccgtgatctcacccccgtcaggcctggtgggctcctttgacactcagcggcaggagccaagccgccatggcctaccacagcttcctggtggagcccatcagctgccacgcctggaacaaggaccgcaccc

SEQ ID NO: 103924 - DNA, 580 bp, Homo sapiens
  Payload ID: 428
  Gene Symbol: ARPC1B
  Gene Name: actin related protein 2/3 complex, subunit 1B, 41kDa
  ENST ID: ENST00000455009
  CDS Start-End: 195-580
gctgctgctccggcgcggagcccagagccggttcggcgcgtcgactgcccagagtccgcggccggggcgcgggagacagtgtcttgttctgttgcccaggctggagtgtggtgacactaccttgactcactgcagcatctgcctcccgggttccagtgattctcctgcctcagcctctcaggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaa

SEQ ID NO: 103925 - DNA, 563 bp, Homo sapiens
  Payload ID: 428
  Gene Symbol: ARPC1B
  Gene Name: actin related protein 2/3 complex, subunit 1B, 41kDa
  ENST ID: ENST00000418347
  CDS Start-End: 316-563
cagagccggttcggcgcgtcgactgcccagagtccgcggccggggcgcgggaggtgaacctaacttcctggcctccaagatttggggtcagagtcccaagctgcgtcatttagtagaagccgagtgactttgaacaaatcgttgcttttgtctgagcctgggtttcctcctgtacaaactgaagtgtcttgttctgttgcccaggctggagtgtggtgacactaccttgactcactgcagcatctgcctcccgggttccagtgattctcctgcctcagcctctcaggtagctgggattacaggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaaggg

SEQ ID NO: 103926 - DNA, 669 bp, Homo sapiens
  Payload ID: 428
  Gene Symbol: ARPC1B
  Gene Name: actin related protein 2/3 complex, subunit 1B, 41kDa
  ENST ID: ENST00000443222
  CDS Start-End: 344-669
cagggcctgcacagttggcgcccaccggcatcagcgtgaagggagctcctcgctggctgccgacggggctgcagggctcgctagccgctcacctgcgtgtgagcgcggagcccgcagtacccgccgtccgggctcagaggacgtgactccccgaccctgcgcccggcagtccccgggggccgtgcgcccggcccaggctcggaggtccagcccagcggcggctcaggctgcgcgcctggctcccagcctcagtttccccattggtaaagcattgacggtggttgcggacggcttctgcggacagagccttgggctccgacgtctgcgcgggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaa

SEQ ID NO: 103927 - DNA, 1605 bp, Homo sapiens
  Payload ID: 429
  Gene Symbol: ARPC2
  Gene Name: actin related protein 2/3 complex, subunit 2, 34kDa
  Uniprot ID: O15144
  ENST ID: ENST00000295685
  CDS Start-End: 262-1164
gcggcggcggcggctcggcaggcgggttcaggcttcgggggccaggtcggttgggtgggtgggtgtctccacagtctgcgtgcgtgggccagcgcgttcgtcttacccttccctccaccccggcccctctccccttctcccctaacctcctaccccacccagccccactcagggggcagcagggccgctccctccgtccttgcctcccttacccaccctcaccggcccttgtttctccttcccctgggggcagccgccgccatgatcctgctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaaaaaagaattccacttgatcaacttaattccttttctttatcttccctccctcacttcccttttctcccaccctcttttccaagctgtttcgctttgcaatatattactggtaatgagttgcaggataatgcagtcataacttgttttctcctaagtatttgagttcaaaactcctgtatctaaagaaatacggttggggtcattaataaagaaaatctttctatcttacatgagaa

SEQ ID NO: 103928 - DNA, 1505 bp, Homo sapiens
  Payload ID: 429
  Gene Symbol: ARPC2
  Gene Name: actin related protein 2/3 complex, subunit 2, 34kDa
  Uniprot ID: O15144
  ENST ID: ENST00000315717
  CDS Start-End: 170-1072
ggcgccgcggggccgcgcgtccaggcggcgagcggaagtgggtgtgagagcggaagtggccggctagagccgggggctgggcggggaccgggcttgtcggtgaagcggcagtggcggcggcggcggcggctcggcaggcgggttcaggcttcgggggccagccgccgccatgatcctgctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaaaaaagaattccacttgatcaacttaattccttttctttatcttccctccctcacttcccttttctcccaccctcttttccaagctgtttcgctttgcaatatattactggtaatgagttgcaggataatgcagtcataacttgttttctcctaagtatttgagttcaaaactcctgtatctaaagaaatacggttggggtcattaataaagaaaatctttctatctta

SEQ ID NO: 103929 - DNA, 732 bp, Homo sapiens
  Payload ID: 429
  Gene Symbol: ARPC2
  Gene Name: actin related protein 2/3 complex, subunit 2, 34kDa
  ENST ID: ENST00000420201
  CDS Start-End: 83-358
ccgggcttgtcggtgaagcggcagtggcggcggcggcggcggctcggcaggcgggttcaggcttcgggggccagccgccgccatgatcctgctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcagtcttctaataggttgtctcaacattcatggccagaggaattgaaaggcaccgtgtcatccttgaatagaacagctatgttatactgctttaaaaaggaggtttaaagtggaaaaactgaacagcctttttaccctgtgattcagtggcatgtctcaaattctgaggcatttagcaggaccccaaagtgagaaccaggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagacca

SEQ ID NO: 103930 - DNA, 482 bp, Homo sapiens
  Payload ID: 429
  Gene Symbol: ARPC2
  Gene Name: actin related protein 2/3 complex, subunit 2, 34kDa
  ENST ID: ENST00000420104
  CDS Start-End: 214-482
gagcggaagtggccggctagagccgggggctgggcggggaccgggcttgtcggtgaagcggcagtggcggcggcggcggcggctcggcaggcgggttcaggcttcgggggccagccccactcagggggcagcagggccgctccctccgtccttgcctcccttacccaccctcaccggcccttgtttctccttcccctgggggcagccgccgccatgatcctgctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcagg

SEQ ID NO: 103931 - DNA, 644 bp, Homo sapiens
  Payload ID: 429
  Gene Symbol: ARPC2
  Gene Name: actin related protein 2/3 complex, subunit 2, 34kDa
  ENST ID: ENST00000456575
  CDS Start-End: 1-498
aaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcaccttctctttggcagagttgggccccagaaaggagaagcaggagacaaacagctgcatccaccctgaaaaccagattatgttactaatgggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaaaaa

SEQ ID NO: 103932 - DNA, 713 bp, Homo sapiens
  Payload ID: 429
  Gene Symbol: ARPC2
  Gene Name: actin related protein 2/3 complex, subunit 2, 34kDa
  ENST ID: ENST00000414983
  CDS Start-End: 62-178
cagtggcggcggcggcggcggctcggcaggcgggttcaggcttcgggggccagccgccgccatgatcctgctggaggtgaacaaccgcatcatcgaggagacgctcgcgctcaagttcgagaacgcggccgccggaaacaaaccggaagcagtagaagtaacatttgcaggtgaatgaactcagaggaatacaaccaccctttctacaacaagagtcctcgacaagatgatcttggaagacttttgcagctctgaagtgctgttacctggagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtatgttgagtctaaaaaggacagagtcacagtagtcttcagcacagtgtttaaggatgacgacgatgtggtcattggaaaggtgttcatgcagg

SEQ ID NO: 103933 - DNA, 1014 bp, Homo sapiens
  Payload ID: 430
  Gene Symbol: ARPC3
  Gene Name: actin related protein 2/3 complex, subunit 3, 21kDa
  Uniprot ID: O15145
  ENST ID: ENST00000228825
  CDS Start-End: 148-684
agaagcggaactgcaaggccggaagctccacgtccgcacccgccccttccgtttcgcttccgcctacctcgcccaggctgccagaccggaagcgctccgctgtacctggatcctgctcctctgggttgaaacccgggcgccgccaagatgccggcttaccactcttctctcatggatcctgataccaaactcatcggaaacatggcactgttgcctatcagaagtcaattcaaaggacctgcccccagagagacaaaagatacagatattgtggatgaagccatctattacttcaaggccaatgtcttcttcaaaaactatgaaattaagaatgaagctgataggaccttgatatatataactctctacatttctgaatgtctgaagaaactgcaaaagtgcaattccaaaagccaaggtgagaaagaaatgtatacgctgggaatcactaattttcccattcctggagagcctggttttccacttaacgcaatttatgccaaacctgcaaacaaacaggaagatgaagtgatgagagcctatttacaacagctaaggcaagagactggactgagactttgtgagaaagttttcgaccctcagaatgataaacccagcaagtggtggacttgctttgtgaagagacagttcatgaacaagagtctttcaggacctggacagtgaagggagcccgggcagccaccgtctccagagccctgggcagcattttccagcaagatgtacacaatcttttgcctttatttcgtaaagttttatacagaagagagaagagcatgtctttacttgaaaaactcttgatcaagaatttgggtgggagaaaagaaagtgggttatcaagggtgatttgaaattttctgcagcattaaagctggcgcttaataagaataagtaataataaagaaatttctaacattccatgtcagaaaaactttattgccagtctttgacattcacttacaatttgttttgagataaaattcacattccataatg

SEQ ID NO: 103934 - DNA, 349 bp, Homo sapiens
  Payload ID: 430
  Gene Symbol: ARPC3
  Gene Name: actin related protein 2/3 complex, subunit 3, 21kDa
  ENST ID: ENST00000426440
  CDS Start-End: 52-349
ccgctgtacctggatcctgctcctctgggttgaaacccgggcgccgccaagatgccggcttaccactcttctctcatggatcctgataccaaactcatcggaaacatggcactgttgcctatcagaagtcaattcaaaggacctgcccccagagagacaaaagatacagatattgtggatgaagccatctattacttcaaggccaatgtcttcttcaaaaactatgaaattaagaatgaagctgataggaccttgatatatataactctctacatttctgaatgtctgaagaaactgcaaaagtgcaattccaaaagccaagaagtgatgagagcctatttacaacagc

SEQ ID NO: 103935 - DNA, 308 bp, Homo sapiens
  Payload ID: 430
  Gene Symbol: ARPC3
  Gene Name: actin related protein 2/3 complex, subunit 3, 21kDa
  ENST ID: ENST00000547365
  CDS Start-End: 55-308
tctgcttctgtgttcttcctgggcttgccattacaggcttaccactcttctctcatggatcctgataccaaactcatcggaaacatggcactgttgcctatcagaagtcaattcaaaggacctgcccccagagagacaaaagatacagatattgtggatgaagccatctattacttcaaggccaatgtcttcttcaaaaactatgaaattaagaatgaagctgataggaccttgatatatataactctctacatttctgaatgtctgaagaaactgcaaaagtgcaattccaaaagccaaggtgagaa

SEQ ID NO: 103936 - DNA, 2582 bp, Homo sapiens
  Payload ID: 431
  Gene Symbol: ARPC4
  Gene Name: actin related protein 2/3 complex, subunit 4, 20kDa
  Uniprot ID: P59998
  ENST ID: ENST00000397261
  CDS Start-End: 565-1071
aaggtgggcctcgagcaaagccgctagaggtggggtgcgggtggtcggcctcaggcgagccccggggcacagcccggggcgggaggcggagcttggcggccgagatctccgcgctgcagttagccccgccgagcgccaggagctgcgggtaggaggggcgagagaaaggatgggggtacagaaccggaagaaacgaagggctcgtccgcttcggcttgtcctaatttggtgcccaatctgaagctgggctgtaccattgcatacctgggggaggctgtggcaaaggtgacaagaaggccgaaggcacaaagggaagctgcacccattcctggaggagcttaaatagtgactcgagtgcaagaatttaaaaataccgagacagccctaggtggaaaacttccggaaggcccaagcgttcgtaagggctctctaccccgctcggagcatagatggtaccgtccggaagtccgggcggagaccgtagctgcgcttctcgcgaaagggcaggcatcgcggggctggccacttccgtacttccgctttccggcccagccagcgcccgcgatgactgccactctccgcccctacctgagtgccgtgcgggccacattgcaggctgccctctgcctggagaacttctcctcccaggttgtggaacgacacaacaagccggaagtggaagtcaggagtagcaaagagctcctgttacaacctgtgaccatcagcaggaatgagaaggaaaaggttctgattgagggctccatcaactctgtccgggtcagcattgctgtgaaacaggctgatgagatcgagaagattttgtgccacaagttcatgcgcttcatgatgatgcgagcagagaacttctttatccttcgaaggaagcctgtggaggggtatgatatcagctttctgatcaccaacttccacacagagcagatgtacaaacacaagttggtggactttgtgatccacttcatggaggagattgacaaggagatcagtgagatgaagctgtcagtcaatgcccgtgcccgcattgtggctgaagagttccttaagaatttttaaaccatctggctggatctcgtggccttccccctcagactacccatgtctccacgaaggcgtcctggagtcactccccgagcagcgcggcggcggcagggagttgggttggggtgggcatttgatgcgggaggtgggtggtgtgcttgctagctgggcaagaaagcagcagtggacctgccccaaggccacacgtgcctggtcaggctggcttctgatgttcagtcccctgggccgggacagattttttttaacgtcttgaaacttaaactctgtgcttgtaggatactgtaacctttttgtctttttttttttttttttttttaaacctccacctccagtggctgtgactggtcccagtgattatacgttattggttgctgtgggtctgggcgggcctggagccagaaggcgacttattttttctctcctatgccaccccaggtggggagggagggaggtttcagactccagtttctcccttgcccttttattcccaagcctccttggccccagtataagtgttgggaactctctgccagcttcctgagttctgcctaaagatggccccccagcactggttggggacaagggccaaattggtgaccaccagtcatgcctaggacctggggcccaaaagccgggcaacctctggctacaggggccattgggtgccctcccagttgagaggggccgctgtttcgccttgtccgtcagtgccagtgcctgtgccagaggtggcgaggtgagtcctccagagcttcctggccgggccctcctcctgcctgttctggctcctctgctcccacgctagctgtcccttttctgattctggtggatcctccctcccctaattaaagtctctttttgcccctttggggctgcatgaggtctatgctgtgtgtgtgtgtgaaaggaggggaggtggggcttcttttccctgagaccagatggctggtaattgtgcctggagctccccactgggtgcagtctcatgattggtcctgccattattcctgccaggggtcccaacccagagactccattcattgcagtccaggcaccattaatttctgaaactgctctgtctgcctatacagagctttggtgcttttcacataaggaacttacttgggctaaaaagtaacctcagagaaacagtgctcccatttggtggataaggaaactgaggttccaaacatgagatgtaatagcttgccccaaatctagccagtgagcaagagagtagacttttgcctgtgccaaaacagtaatcaccatccacaagtggctatttaaattttaattattacaattaaataaagtttaaaatccagttccccagtcccactggcaacttaacagctaccagtgactgtaccatatataacagcatatatagacatacagcatatacaacacatacatagagattcccatcattgcagaaagttccattggatagtactagaccttagtaacaccttgaagtaaaaagacaaaagacccttgtg

SEQ ID NO: 103937 - DNA, 926 bp, Homo sapiens
  Payload ID: 431
  Gene Symbol: ARPC4
  Gene Name: actin related protein 2/3 complex, subunit 4, 20kDa
  Uniprot ID: P59998
  ENST ID: ENST00000433034
  CDS Start-End: 6-569
ccgcgatggtgagagagccgggcccccggccagggacccccggctgttcggcctcagggcagtggactgccactctccgcccctacctgagtgccgtgcgggccacattgcaggctgccctctgcctggagaacttctcctcccaggttgtggaacgacacaacaagccggaagtggaagtcaggagtagcaaagagctcctgttacaacctgtgaccatcagcaggaatgagaaggaaaaggttctgattgagggctccatcaactctgtccgggtcagcattgctgtgaaacaggctgatgagatcgagaagattttgtgccacaagttcatgcgcttcatgatgatgcgagcagagaacttctttatccttcgaaggaagcctgtggaggggtatgatatcagctttctgatcaccaacttccacacagagcagatgtacaaacacaagttggtggactttgtgatccacttcatggaggagattgacaaggagatcagtgagatgaagctgtcagtcaatgcccgtgcccgcattgtggctgaagagttccttaagaatttttaaaccatctggctggatctcgtggccttccccctcagactacccatgtctccacgaaggcgtcctggagtcactccccgagcagcgcggcggcggcagggagttgggttggggtgggcatttgatgcgggaggtgggtggtgtgcttgctagctgggcaagaaagcagcagtggacctgccccaaggccacacgtgcctggtcaggctggcttctgatgttcagtcccctgggccgggacagattttttttaacgtcttgaaacttaaactctgtgcttgtaggatactgtaacctttttgtctttttttttttttttttttttaaacctccacctccagtggctgtgactggtcccag

SEQ ID NO: 103938 - DNA, 910 bp, Homo sapiens
  Payload ID: 431
  Gene Symbol: ARPC4
  Gene Name: actin related protein 2/3 complex, subunit 4, 20kDa
  ENST ID: ENST00000440787
  CDS Start-End: 30-371
tccgctttccggcccagccagcgcccgcgatgactgccactctccgcccctacctgagtgccgtgcgggccacattgcaggctgccctctgcctggagaacttctcctcccaggttgtggaacgacacaacaagccggaagtggaagtcaggagtagcaaagagctcctgttacaacctgtgaccatcagcaggaatgagaaggaaaaggttctgattgagggctccatcaactctgtccgggtcagcattgctgtgaaacaggctgatgagatcgagaagattttgtgccacaagttcatgcgcttcatgatgatgcgagcagagaacttctttatccttcgaaggaagcctgtggagattattctgtaacaagacttcaagttccttgactcattctgaatgcagagctgttgtgccacagatagttttccagagatgtctgatacacacagaattctcaacggggttcagttgcttggatccaacctagacaccctcccccagagcagctgggctgctgactggaagggggtatgatatcagctttctgatcaccaacttccacacagagcagatgtacaaacacaagttggtggactttgtgatccacttcatggaggagattgacaaggagatcagtgagatgaagctgtcagtcaatgcccgtgcccgcattgtggctgaagagttccttaagaatttttaaaccatctggctggatctcgtggccttccccctcagactacccatgtctccacgaaggcgtcctggagtcactccccgagcagcgcggcggcggcagggagttgggttggggtgggcatttgatgcgggaggtgggtggtgtgcttgctagctgggcaagaaagcagcagtggacctgccccaaggccacacgtgcctggtca

SEQ ID NO: 103939 - DNA, 957 bp, Homo sapiens
  Payload ID: 431
  Gene Symbol: ARPC4
  Gene Name: actin related protein 2/3 complex, subunit 4, 20kDa
  ENST ID: ENST00000417500
  CDS Start-End: 41-175
acttccgtacttccgctttccggcccagccagcgcccgcgatgactgccactctccgcccctacctgagtgccgtgcgggccacattgcaggctgccctctgcctggagaacttctcctcccaggttgtggaacgacacaacaagccggaagtggaagtcagtcctcgccagtgaattaggaatcagagtcattttacagatgagaaaattgagattccaacagggtaacttgcccaaggaaagtaacagaggaggctggatttcaaaaccttttcgccctgacttcagagcctgtgctctttctgctgaagaacacactcactggcccccatcttggagcactcctgcttgagtagcaaagagctcctgttacaacctgtgaccatcagcaggaatgagaaggaaaaggttctgattgagggctccatcaactctgtccgggtcagcattgctgtgaaacaggctgatgagatcgagaagattttgtgccacaagttcatgcgcttcatgatgatgcgagcagagaacttctttatccttcgaaggaagcctgtggaggggtatgatatcagctttctgatcaccaacttccacacagagcagatgtacaaacacaagttggtggactttgtgatccacttcatggaggagattgacaaggagatcagtgagatgaagctgtcagtcaatgcccgtgcccgcattgtggctgaagagttccttaagaatttttaaaccatctggctggatctcgtggccttccccctcagactacccatgtctccacgaaggcgtcctggagtcactccccgagcagcgcggcggcggcagggagttgggttggggtgggcatttgatgcgggaggtgggtggtgtgcttgctagctgggcaagaaagcagcagtggacctgccccaaggccacacgtgcctggtcaggctggcttctgatgttca

SEQ ID NO: 103940 - DNA, 942 bp, Homo sapiens
  Payload ID: 431
  Gene Symbol: ARPC4
  Gene Name: actin related protein 2/3 complex, subunit 4, 20kDa
  Uniprot ID: P59998
  ENST ID: ENST00000498623
  CDS Start-End: 479-715
agttgacgcgggggcggggagtcagcgagggcgagcctactggagtttgccgggggtgggaagaaggtgggcctcgagcaaagccgctagaggtggggtgcgggtggtcggcctcaggcgagccccggggcacagcccggggcgggaggcggagcttggcggccgagatctccgcgctgcagttagccccgccgagcgccaggagctgcggactgccactctccgcccctacctgagtgccgtgcgggccacattgcaggctgccctctgcctggagaacttctcctcccaggttgtggaacgacacaacaagccggaagtggaagtcaggagtagcaaagagctcctgttacaacctgtgaccatcagcaggaatgagaaggaaaaggttctgattgagggctccatcaactctgtccgggtcagcattgctgtgaaacaggctgatgagatcgagaagattttgtgccacaagttcatgcgcttcatgatgatgcgagcagagaacttctttatccttcgaaggaagcctgtggaggggtatgatatcagctttctgatcaccaacttccacacagagcagatgtacaaacacaagttggtggactttgtgatccacttcatggaggagattgacaaggagatcagtgagatgaagctgtcagtcaatgcccgtgcccgcattgtggctgaagagttccttaagaatttttaaaccatctggctggatctcgtggccttccccctcagactacccatgtctccacgaaggcgtcctggagtcactccccgagcagcgcggcggcggcagggagttgggttggggtgggcatttgatgcgggaggtgggtggtgtgcttgctagctgggcaagaaagcagcagtggacctgccccaaggccacacgtgcctggtcaggctggcttctgatgttcagtcccc

SEQ ID NO: 103941 - DNA, 577 bp, Homo sapiens
  Payload ID: 431
  Gene Symbol: ARPC4
  Gene Name: actin related protein 2/3 complex, subunit 4, 20kDa
  ENST ID: ENST00000485273
  CDS Start-End: 347-577
gctttccggcccagccagcgcccgcgatggtgagagagccgggcccccggccagggacccccggctgttcggcctcaggactgccactctccgcccctacctgagtgccgtgcgggccacattgcaggctgccctctgcctggagaacttctcctcccaggttgtggaacgacacaacaagccggaagtggaagtcaggagtagcaaagagctcctgttacaacctgtgaccatcagcaggaatgagaaggaaaaggttctgattgagggctccatcaactctgtccgggtcagcattgctgtgaaacaggctgatgagatcgagaagattttgtgccacaagttcatgcgcttcatgatgatgcgagcagagaacttctttatccttcgaaggaagcctgtggaggggtatgatatcagctttctgatcaccaacttccacacagagcagatgtacaaacacaagttggtggactttgtgatccacttcatggaggagattgacaaggagatcagtgagatgaagctgtcagtcaatgcccgtgcccgcattgtggctgaagagttccttaagaat

SEQ ID NO: 103942 - DNA, 1637 bp, Homo sapiens
  Payload ID: 432
  Gene Symbol: ARPC5
  Gene Name: actin related protein 2/3 complex, subunit 5, 16kDa
  Uniprot ID: O15511
  ENST ID: ENST00000294742
  CDS Start-End: 99-563
gggaagtgaatcaggcgccgggtagtgggttgctgggctgggcttgctgaggtagaggcagcgccaagaagaggcctttgccgctggtcgggattgggatgtcgaagaacacagtgtcgtcggcccgcttccggaaggtggacgtggatgaatatgacgagaacaagttcgtggacgaagaagatgggggcgacggccaggccgggcccgacgagggcgaggtggactcctgcctgcggcattccatcacaggaaacatgacagctgccctacaggcagctctgaagaacccccctatcaacaccaagagtcaggcagtgaaggaccgggcaggcagcattgtcttgaaggtgctcatctcttttaaagctaatgatatagaaaaggcagttcaatctctggacaagaatggtgtggatctcctaatgaagtatatttataaaggatttgagagcccgtctgacaatagcagtgctatgttactgcaatggcatgaaaaggcacttgctgctggaggagtagggtccattgttcgtgtcttgactgcaagaaaaactgtgtagtctggcaggaagtggattatctgcctcgggagtgggaattgctggtacaaagaccaaaacaaccaaatgccaccgctgccctgtgggtagcatctgtttctctcagctttgccttcttgctttttcatatctgtaaagaaaaaaattacatatcagttgtcctttaatgaaaattgggataatatagaagaaattgtgttaaaatagaagtgtttcatcctttcaaaaccatttcagtgatgtttataccaatctgtatatagtataatttacattcaagtttaattgtgcaacttttaacccctgttggctggttttttgttctgttttgttttgtattatttttaactaatactgagagatttggtcagaatttgaggccagtttcctagctcattgctagtcaggaaatgatatttataaaaaatatgagagactggcagctattaacattgcaaaactggaccatatttcccttatttaataagcaaaatatgtttttggaataagtggtgggtgaataccactgctaagttatagctttgtttttgcttgcctcctgattatctgtactgtgggtttaagtatgctactttctctcagcatccaataatcatggcccctcaatttatttgtggtcacccagggttcagagcaagaagtcttgctttatacaaatgtatccataaaatatcagagcttgttgggcatgaacatcaaacttttgttccactaatatggctctgtttggaaaaaactgcaaatcagaaagaatgatttgcagaaagaaagaaaaactatggtgtaatttaaactctgggcagcctctgaatgaaatgctactttctttagaaatataatagctgccttagacattatgaggtatacaactagtatttaagataccatttaatatgccccgtaaatgtcttcagtgttcttcagggtagttgggatctcaaaagatttggttcagatccaaacaaatacacattctgtgttttagctcagtgttttctaaaaaaagaaactgccacacagcaaaaaattgtttactttgttggacaaaccaaa

SEQ ID NO: 103943 - DNA, 7209 bp, Homo sapiens
  Payload ID: 432
  Gene Symbol: ARPC5
  Gene Name: actin related protein 2/3 complex, subunit 5, 16kDa
  Uniprot ID: O15511
  ENST ID: ENST00000359856
  CDS Start-End: 68-523
gctgggctgggcttgctgaggtagaggcagcgccaagaagaggcctttgccgctggtcgggattgggatgtcgaagaacacagtgtcgtcggcccgcttccggaaggtggacgtggatgaatatgacgagaacaagttcgtggacgaagaagatgggggcgacggccaggccgggcccgacgagggcgaggtggactcctgcctgcggcaaggaaacatgacagctgccctacaggcagctctgaagaacccccctatcaacaccaagagtcaggcagtgaaggaccgggcaggcagcattgtcttgaaggtgctcatctcttttaaagctaatgatatagaaaaggcagttcaatctctggacaagaatggtgtggatctcctaatgaagtatatttataaaggatttgagagcccgtctgacaatagcagtgctatgttactgcaatggcatgaaaaggcacttgctgctggaggagtagggtccattgttcgtgtcttgactgcaagaaaaactgtgtagtctggcaggaagtggattatctgcctcgggagtgggaattgctggtacaaagaccaaaacaaccaaatgccaccgctgccctgtgggtagcatctgtttctctcagctttgccttcttgctttttcatatctgtaaagaaaaaaattacatatcagttgtcctttaatgaaaattgggataatatagaagaaattgtgttaaaatagaagtgtttcatcctttcaaaaccatttcagtgatgtttataccaatctgtatatagtataatttacattcaagtttaattgtgcaacttttaacccctgttggctggttttttgttctgttttgttttgtattatttttaactaatactgagagatttggtcagaatttgaggccagtttcctagctcattgctagtcaggaaatgatatttataaaaaatatgagagactggcagctattaacattgcaaaactggaccatatttcccttatttaataagcaaaatatgtttttggaataagtggtgggtgaataccactgctaagttatagctttgtttttgcttgcctcctgattatctgtactgtgggtttaagtatgctactttctctcagcatccaataatcatggcccctcaatttatttgtggtcacccagggttcagagcaagaagtcttgctttatacaaatgtatccataaaatatcagagcttgttgggcatgaacatcaaacttttgttccactaatatggctctgtttggaaaaaactgcaaatcagaaagaatgatttgcagaaagaaagaaaaactatggtgtaatttaaactctgggcagcctctgaatgaaatgctactttctttagaaatataatagctgccttagacattatgaggtatacaactagtatttaagataccatttaatatgccccgtaaatgtcttcagtgttcttcagggtagttgggatctcaaaagatttggttcagatccaaacaaatacacattctgtgttttagctcagtgttttctaaaaaaagaaactgccacacagcaaaaaattgtttactttgttggacaaaccaaatcagttctcaaaaaatgaccggtgcttataaaaagttataaatatcgagtagctctaaaacaaaccacctgaccaagagggaagtgagcttgtgcttagtatttacattggatgccagttttgtaatcactgacttatgtgcaaactggtgcagaaattctataaactctttgctgtttttgatacctgctttttgtttcattttgttttgttttgtaaaaatgataaaacttcagaaaataaaatgtcagtgttgaataatttatttttctctgactttaacaattatgaatgtatggttaattaagaggaaaggttttctgcttctaccaccaagtactgtactcttaacaagaacagtttggtagggtttttataagactatatagatataagatgatagagaagagagtcatgaatgatgtcagagcactactgaagcctttggagtgattccatagccttctggatggcagctgaatacctatatgtagtatcactgcccaaagacctagactagaaagtgcaaagtagcttagcagctgcagtcattcactcccagcctccaaaattctctttctttcacctcaaatctatttcttgtacttacctactcacagcgacttctgtttgctttcgatcttcacctgactagattcccactttaaaacacttccaggcaattcagggtcctatgggtgaagataagctaagcaataggtattattcttaaatattacttagagatggggacttgctatgctgcccaggctggagtgcagtggctgttcacaggtgtgatcatagtgcactgaggcctcaaactcctggcttcaagcagtcctgcctcagcctcccgaaaaggtggaactacaggcacatgccactgtgccttagccaataggtattagaggtagtcaagtaggtatagcataaccaattacaaactttaaaatcaaatgatactgaatgctttttcataaaatccttcttaacatcactttcataactgaagcgtttggaaaaattctggagttcatatttgttcacaagaatgggtgggtgtatttagaatctgccagtctatcagctttactgaggggagatactaaaaatatttaacaagtagtataatatagagaccgagtcaaaatggatactagctggaaacaactggttcaactgttgcctcctgactaaatgtcagcccagggtatagtaaccatgacacagtactatccttggtgaagagttgggaataggattaattgcggaaaaaatatatataaatgccataggacacttttagcacaaaagtagttgtttacctcccattctcctcctttaatctcagtgcttttactatttggtttcttttttggcattttacaaaagggaagaaatggaaaacataccccttcttggtcattgggtaacagcaccatttcggtaacagtcatacttgatgacaagtatgatgatattttaaggacatgaacatgggtgaaatcaatgtgtagatggtacaaattaaccgaattctttttaaagcatttcctgtggatcccaggatcatgaggacataacagaagaataaggtctgaatcttgttcaccagtttgctctcagcctaattgggaagtaaggttaagcacctgaaaattatgtcatacaaaaaaaaagagaattaacgtcatacaatttagcatttgactgtaaatgcagttagtcaatgttgggagaacaacaaaatcagggtggatcagagtatttaaagtgagacattaatttgaactaatcctttggaggggcagaaaggacaaacggtccaagtgaaatgaacagagtagaaagagaaagttaaaagtgggtttaatagtcactgttcttgcagttttaatgttttttgttttgttttgttttgttttgttttgttttgttttttttgagacagagtctcgctctgtggcccaggcgggagtgcagtggcgcgatctcggctcactgcaagctctgcctcctgggttcacgccattctcctgcctcagcctcccaagtagctgggactacaggcgcccgccaccacgcccggctaattttttgtatttttagtagagacggggtttcattcaccgtgttagccaggatggtctcgatctcctgacctcgtgatccgcccacctcggcctcccaaagtgctgggattacatgcgtgagccaccgcgcccagctgcagttttaatgtttttaacataagaattctagatggtgcaaattattaacaggatcagaaactatctccgtgatagattcaagaaagtaaaattataggaaatcataatgttttattagctgaaatagacattgatgatcacttagtttaaccccatgtataaaggtaaaaaagaaaattaattaattaattttttttttttgagatggagtcttgctctgttgctcaggctggagtgcaatggcacaatctcggctcactgcagcctccacctcccaggctcaagcgattctcctgcctcagcctcctgagtagctcggattacaggcacgcatcaccgtgcccagctaatttttgtatttttaggagagatggggtttcaccatgttgcccaggctggtcttgaactcctgacctcaggtgatccaccctcctccgcctcccaaagcactgggattacaggcgtgaccaccgcgcccagccagattgattaatttttagatacacaatttttcctttagatttacaactaacatccccttacagacaaaatatgttaaaagcaccaaaataattgaaaaacacacccaattaaggaacagaccaacggcctctgtagaaccaagtgcccttaaacaaggctgcttctgtccatattcctgccgcgggacctctgccccactccctctccccctcaccccaatgtcactagtacaatatgtgaaaaccccaatgtgaaaacgttctgtgcaggtgcctcttgtatgattccagatatggaggaggcccgggaagcccacagaggtacagcatgtcatctgcctcaaggtggtgctacttcaccacattgatgatccaaccacaagcaacatgggacacagcattcactttaacatttctattttcctttatcatttctgttacttgagtgtgtaagagtaatcaacataaataatctatgtttacatctcttatttctctctgaaacagttccctagaatccacaccacatgaaacacaaattgagtagtgtatgacccacctgaattccaaagcattctaaaactcccgtattttccagcctagcagttagctcctgctctgcaagacacaccctcttgaccttgctgctagactgtatgggccccctgaagtcatagtagctggctcttactcatccccacattcacttggcatagttgatgttcaacaaatatctcttggttgcataacattgaacgagccaagtcacctaagaaatccttaatttatacacaggttcttagggtacctgaatagggcaacacatcagaagtacaaattgagaactatacaaagagtaaaataattcttgggttcaaataccctagagccaatcaagtttagtcacaaagaatttcaattcacttcaatgtggacagttaagaagggaatttatcagccttaggtggaaatcagagccaccatgagtaccacgtgcagcccctatagtgtttagctttgccagaagtcaccagagaaagtggctgaggaacagaattccagctcatatctggctaacagtggcactatgggagtttatatgatctgttcattattctgtggcatcaccttctaagagcagagatgtgacccaataccccttgttttccttaaagataaccattaaattatatccatgaatttatatcaccgtccttgactttatacgtagatttttctaattctgtcaacccttagggtaatgaataacttaaatggccaatgcctctgaataacatcatacttccttttgtttctccaaaaattgaatcaagatgccagggcaactaagattttcttcaatttgctaagttaaaggtcagtgtattcattagccaatggttctgtattttattcattttagtttttattcgttttcaaataatttgttcatattgttcaatattcaaaaggtaagaaatatgtactgtggtaattttccattccaccctagttcctcttttgacaaccaactattgtcacttaattcttaggcatccttccagatacagtgtatgcatttacaggcaaatacctatataagattttacccctttgtgtacataaatactaacatactatatatagtgttctgttccttgcttttttcattaacagtatattttggtggtaatttcctatcaatacataaagaacttccttattcccttcagaggcatttgaaccagagcaattccttcttgaatagaagctgggtaaaataaggctgagacctactgggctgcattcccagatggttaaggcattctaagtcacaggatgagataggaggtcaacacaagataccggtcataaagaccttgctgataaaacagtttgcagtaaagaagctggccaaaacccaccaaatccaagatggcaatgaaagtgacctctgcctctggccatcctcaccgctacgctcccaccggcaccatgacagtttacaaatgccatggcaacatcaggaagttatcctatatggtctaaaaaggggaggcatgaataatacaccccttgtttagcatatcatcaagaaataaccgttaaaatgggcaaccagcagccctcggggctgctctgcctatggagtagccattctttattcctttactttcttaataaacttgctttaactttacagactggccttgaattctttcttgtgtgagatccaagaacgctcacttggggtctggattgggaccactttccgataacaattttatttttatgactgcataataattctattatataaataaatgtaccataatttacttaaccatttccctattgatttaggtggtttctgatcttttgcagttacaaacagtgctacagtgaatagcattatacacaagtcattttacatatgttcaagcctatttgtagatcaattcctaaaagtgaaagttaaggtcagttggagggcatttaagggagatattgctaaattgcctttcttaaaggttttatcaattatactttctccagccgtgtagaagaatgcatgttttcccacccctttacctattctatgtgtttgtcataaaacattttttaatcttttcaaatctgatgttttaaaaatggtatcatatatttgcatttctcttaatgtaaatgagattgcacatcttttcacatgcctaatagccagttgtattttcttttctatatttttgtatttctatattttctttgcccttttgatggtctttttcttactgatttgtaggagctcttttcaacaggaatgtcaaatatttcttgcattttgagtttcgctttataatagcttttactataaataaaaaggttatttttattttta

SEQ ID NO: 103944 - DNA, 622 bp, Homo sapiens
  Payload ID: 432
  Gene Symbol: ARPC5
  Gene Name: actin related protein 2/3 complex, subunit 5, 16kDa
  ENST ID: ENST00000367534
  CDS Start-End: 24-431
ctttgccgctggtcgggattgggatgtcgaagaacacagtgtcgtcggcccgcttccggaaggtggacgtggatgaatatgacgagaacaagttcgtggacgaagaagatgggggcgacggccaggccgggcccgacgagggcgaggtggactcctgcctgcggcaaggaaacatgacagctgccctacaggcagctctgaagaacccccctatcaacaccaagagtcaggcagtgaaggaccgggcaggcagcattgtcttgaaggtgctcatctcttttaaagctaatgatatagaaaaggcagttcaatctctggacaagaatggtgtggatctcctaatgaagtatatttataaaggatttgagagcccgtctgacaatagcagtgctatgttactgcaatggcatgaaaaggtgcctcttgtatgattccagatatggaggaggcccgggaagcccacagaggtacagcatgtcatctgcctcaaggtggtgctacttcaccacattgatgatccaaccacaagcaacatgggacacagcattcactttaacatttctattttcctttatcatttctgttacttgagtgtgtaagagtaatcaacataaataatcta

SEQ ID NO: 103945 - DNA, 1325 bp, Homo sapiens
  Payload ID: 433
  Gene Symbol: ARPC5L
  Gene Name: actin related protein 2/3 complex, subunit 5-like
  Uniprot ID: Q9BPX5
  ENST ID: ENST00000259477
  CDS Start-End: 87-548
gcccccgagcaggagccggtgcgagcggagcagagccgaggtcgggccgcgagcggagccggctgagcgggcgccgagctcccgccatggcccggaacacgctgtcctcgcgcttccgccgggtggacatcgacgaatttgacgagaacaaatttgtggacgagcaggaggaggcggcggcggcggcggcggagccaggcccggacccgagcgaggtggacgggctcctgcggcaaggggacatgcttcgggcattccatgcagccttgcggaactctcccgtcaacaccaagaatcaagctgtgaaggagcgagcccagggcgtggtgctgaaagtgctcacaaacttcaagagcagtgagattgagcaggctgtgcagtcactggacagaaacggcgttgacttgttaatgaagtacatttataaaggctttgagaagcccacagaaaatagcagcgcagtgttactccagtggcacgaaaaggccttagcagtaggaggactaggctccattataagagttcttacagcaagaaagactgtttaaaaaaaataaaaagactcatgttaccttgagaagaattctggatgcccaggctggtgaagaagggattgacaatggaccatcttcctaggaactcccaagtaaactatttcaggacatgtatctgctgaaatgtattttattttcaaggtggaggggaaaatcgtctgtttcctaaatcctgtttaggatctgatagtctatgcctttgtctccgagtactgcagaactgacattttgacggtctaccagcgtggcggctggtgttggtcagatgcacctgtgtgcactgggggagggatggtttgggcaggtgcagatccaagggctgtggtaaacgggagagcttgtgtttttgaagtggaaaaaaacccaagagtttgtacagacatcctgtcttcccagagaaggtggacactcttgggctcattgtaaagtgcctgctgcatcaataaagctcttggcttattagtctatacattgcggtgtgtttcgtgtatgtaaaaaaaaatggtaatgaatgggatggtaatgaatgagagttcagttgttgttccggaaacccgatgtggaaggagtagacctgtgtccctgttgagccacccctgggagcgagcatggcaatccacaggccctctgccacaggacgccagcctcggcctcagagctgccggctgctgcagagaggtgtttgctgaataaactatttattgtttcttattcctttgatttgtatgtaattaattttggagcttatttaattaatttaataaagtgcca

SEQ ID NO: 103946 - DNA, 2507 bp, Homo sapiens
  Payload ID: 433
  Gene Symbol: ARPC5L
  Gene Name: actin related protein 2/3 complex, subunit 5-like
  Uniprot ID: Q9BPX5
  ENST ID: ENST00000353214
  CDS Start-End: 1253-1714
attcacggcacccctgatagcgaggtcggcgtcacggtgtaggcgcgcagttggggaaaccgaggcccaacgtgggcggcagctaccagagatggcacacggaggactcaaattcgtccattcagtcattcgttcattcattccttcgggaaaccttgcagatctcccaatctgggcaactctgagctgggcgccagtagtctgggggtgctgacgggaggaggggccagagttttcaaagacgattaaccgaggctcacgtcgcggagccaacctagaagttctctggggacagaaccttggcggacaactgaattaattgttctagtctccaggcccagtacatggatgcttgttggatgaattaatgaaccttgacccacaccaagattctgagaatttggtttctgtcaagatgtgcctctccagccaggcctctcctgccaggacggtggccacagggccatctccctctcctggcgcccccaactgcctggccaaggtgactgctacacacgtggggtcgcagaatccctcgagtcacaacgtcttcaacgtcttgtcagtcccgtgatcgcactaaacgtatttaaagccccctactcctttaagagggtcacctctgtgtacaggcggcctcctcgtactaagtgtggtggcgttcaaggctccgagacacaggcgcctcccgcgccactccccgggcacaggaactcctactcatccctcagtcatcagctcgaaggtttcttctccaagaagcctgcccggcactcgagaagtagagccgcgagccttctcccgggggcccagccttccccagtaccggcagggatcaccccgggagcacgcgcccggccccgctgaggccaggggctcctcggaggcgcgggaaagccggggaaccagcgcagttacggcacacacgaggcggggcctgcacagatgccgggcgcccgatcctcagtgacaaaatagagactccgtggaagggacactgaggtgggggaggctgcggtgatcccataccgcactccaggtgccaggctccgccccgcccctgacggcgcttccggatccggcgggtgccggaagtgggcgggcggcggcggctgcgcgcggaggcggtggaggaggtgctgggagcagccgggcagccgcttcccgcccccgagcaggagccggtgcgagcggagcagagccgaggtcgggccgcgagcggagccggctgagcgggcgccgagctcccgccatggcccggaacacgctgtcctcgcgcttccgccgggtggacatcgacgaatttgacgagaacaaatttgtggacgagcaggaggaggcggcggcggcggcggcggagccaggcccggacccgagcgaggtggacgggctcctgcggcaaggggacatgcttcgggcattccatgcagccttgcggaactctcccgtcaacaccaagaatcaagctgtgaaggagcgagcccagggcgtggtgctgaaagtgctcacaaacttcaagagcagtgagattgagcaggctgtgcagtcactggacagaaacggcgttgacttgttaatgaagtacatttataaaggctttgagaagcccacagaaaatagcagcgcagtgttactccagtggcacgaaaaggccttagcagtaggaggactaggctccattataagagttcttacagcaagaaagactgtttaaaaaaaataaaaagactcatgttaccttgagaagaattctggatgcccaggctggtgaagaagggattgacaatggaccatcttcctaggaactcccaagtaaactatttcaggacatgtatctgctgaaatgtattttattttcaaggtggaggggaaaatcgtctgtttcctaaatcctgtttaggatctgatagtctatgcctttgtctccgagtactgcagaactgacattttgacggtctaccagcgtggcggctggtgttggtcagatgcacctgtgtgcactgggggagggatggtttgggcaggtgcagatccaagggctgtggtaaacgggagagcttgtgtttttgaagtggaaaaaaacccaagagtttgtacagacatcctgtcttcccagagaaggtggacactcttgggctcattgtaaagtgcctgctgcatcaataaagctcttggcttattagtctatacattgcggtgtgtttcgtgtatgtaaaaaaaaatggtaatgaatgggatggtaatgaatgagagttcagttgttgttccggaaacccgatgtggaaggagtagacctgtgtccctgttgagccacccctgggagcgagcatggcaatccacaggccctctgccacaggacgccagcctcggcctcagagctgccggctgctgcagagaggtgtttgctgaataaactatttattgtttcttattcctttgatttgtatgtaattaattttggagcttatttaattaatttaataaagtgccaaacatttaataattga

SEQ ID NO: 103947 - DNA, 1122 bp, Homo sapiens
  Payload ID: 434
  Gene Symbol: ACTA1
  Gene Name: actin, alpha 1, skeletal muscle
  ENST ID: ENST00000366683
  CDS Start-End: 108-872
ggccaccgcagcggacagcgccaagtgaagcctcgcttcccctccgcggcgaccagggcccgagccgagagtagcagttgtagctacccgcccagaaactagacacaatgtgcgacgaagacgagaccaccgccctcgtgtgcgacaatggctccggcctggtgaaagccggcttcgccggggatgacgcccctagggccgtgttcccgtccatcgtgggccgcccccgacaccagggcgtcatggtcggtatgggtcagaaagattcctacgtgggcgacgaggctcagagcaagagaggtatcctgaccctgaagtaccctatcgagcacggcatcatcaccaactgggatgacatggagaagatctggcaccacaccttctacaacgagcttcgcgtggctcccgaggagcaccccaccctgctcaccgaggcccccctcaatcccaaggccaaccgcgagaagatgacccagatcatgtttgagaccttcaacgtgcccgccatgtacgtggccatccaggccgtgctgtccctctacgcctccggcaggaccaccggcatcgtgctggactccggcgacggcatcatgaagtgtgacatcgacatcaggaaggacctgtatgccaacaacgtcatgtcggggggcaccacgatgtaccctgggatcgctgaccgcatgcagaaagagatcaccgcgctggcacccagcaccatgaagatcaagatcatcgccccgccggagcgcaaatactcggtgtggatcggcggctccatcctggcctcgctgtccaccttccagcagatgtggatcaccaagcaggagtacgacgaggccggcccttccatcgtccaccgcaaatgcttctagacacactccacctccagcacgcgacttctcaggacgacgaatcttctcaatgggggggcggctgagctccagccaccccgcagtcactttctttgtaacaacttccgttgctgccatcgtaaactgacacagtgtttataacgtgtacatacattaacttattacctcattttgttatttttcgaaacaaagccctgtggaagaaaatggaaaacttgaagaagcattaaagtcattctgttaagctgcg

SEQ ID NO: 103948 - DNA, 1491 bp, Homo sapiens
  Payload ID: 434
  Gene Symbol: ACTA1
  Gene Name: actin, alpha 1, skeletal muscle
  Uniprot ID: P68133
  ENST ID: ENST00000366684
  CDS Start-End: 104-1237
accgcagcggacagcgccaagtgaagcctcgcttcccctccgcggcgaccagggcccgagccgagagtagcagttgtagctacccgcccagaaactagacacaatgtgcgacgaagacgagaccaccgccctcgtgtgcgacaatggctccggcctggtgaaagccggcttcgccggggatgacgcccctagggccgtgttcccgtccatcgtgggccgcccccgacaccagggcgtcatggtcggtatgggtcagaaagattcctacgtgggcgacgaggctcagagcaagagaggtatcctgaccctgaagtaccctatcgagcacggcatcatcaccaactgggatgacatggagaagatctggcaccacaccttctacaacgagcttcgcgtggctcccgaggagcaccccaccctgctcaccgaggcccccctcaatcccaaggccaaccgcgagaagatgacccagatcatgtttgagaccttcaacgtgcccgccatgtacgtggccatccaggccgtgctgtccctctacgcctccggcaggaccaccggcatcgtgctggactccggcgacggcgtcacccacaacgtgcccatttatgagggctacgcgctgccgcacgccatcatgcgcctggacctggcgggccgcgatctcaccgactacctgatgaagatcctcactgagcgtggctactccttcgtgaccacagctgagcgcgagatcgtgcgcgacatcaaggagaagctgtgctacgtggccctggacttcgagaacgagatggcgacggccgcctcctcctcctccctggaaaagagctacgagctgccagacgggcaggtcatcaccatcggcaacgagcgcttccgctgcccggagacgctcttccagccctccttcatcggtatggagtcggcgggcattcacgagaccacctacaacagcatcatgaagtgtgacatcgacatcaggaaggacctgtatgccaacaacgtcatgtcggggggcaccacgatgtaccctgggatcgctgaccgcatgcagaaagagatcaccgcgctggcacccagcaccatgaagatcaagatcatcgccccgccggagcgcaaatactcggtgtggatcggcggctccatcctggcctcgctgtccaccttccagcagatgtggatcaccaagcaggagtacgacgaggccggcccttccatcgtccaccgcaaatgcttctagacacactccacctccagcacgcgacttctcaggacgacgaatcttctcaatgggggggcggctgagctccagccaccccgcagtcactttctttgtaacaacttccgttgctgccatcgtaaactgacacagtgtttataacgtgtacatacattaacttattacctcattttgttatttttcgaaacaaagccctgtggaagaaaatggaaaacttgaagaagcattaaagtcattctgttaagctgcgtaaa

SEQ ID NO: 103949 - DNA, 1349 bp, Homo sapiens
  Payload ID: 435
  Gene Symbol: ACTA2
  Gene Name: actin, alpha 2, smooth muscle, aorta
  Uniprot ID: P62736
  ENST ID: ENST00000224784
  CDS Start-End: 67-1200
gaacaccacccagtgtggagcagcccagccaagcactgtcaggaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcagggggtgatggtgggaatgggacaaaaagacagctacgtgggtgacgaagcacagagcaaaagaggaatcctgaccctgaagtacccgatagaacatggcatcatcaccaactgggacgacatggaaaagatctggcaccactctttctacaatgagcttcgtgttgcccctgaagagcatcccaccctgctcacggaggcacccctgaaccccaaggccaaccgggagaaaatgactcaaattatgtttgagactttcaatgtcccagccatgtatgtggctatccaggcggtgctgtctctctatgcctctggacgcacaactggcatcgtgctggactctggagatggtgtcacccacaatgtccccatctatgagggctatgccttgccccatgccatcatgcgtctggatctggctggccgagatctcactgactacctcatgaagatcctgactgagcgtggctattccttcgttactactgctgagcgtgagattgtccgggacatcaaggagaaactgtgttatgtagctctggactttgaaaatgagatggccactgccgcatcctcatcctcccttgagaagagttacgagttgcctgatgggcaagtgatcaccatcggaaatgaacgtttccgctgcccagagaccctgttccagccatccttcatcgggatggagtctgctggcatccatgaaaccacctacaacagcatcatgaagtgtgatattgacatcaggaaggacctctatgctaacaatgtcctatcagggggcaccactatgtaccctggcattgccgaccgaatgcagaaggagatcacggccctagcacccagcaccatgaagatcaagatcattgcccctccggagcgcaaatactctgtctggatcggtggctccatcctggcctctctgtccaccttccagcagatgtggatcagcaaacaggaatacgatgaagccgggccttccattgtccaccgcaaatgcttctaaaacactttcctgctcctctctgtctctagcacacaactgtgaatgtcctgtggaattatgccttcagttcttttccaaatcattcctagccaaagctctgactcgttacctatgtgttttttaataaatctgaaataggctactggtaa

SEQ ID NO: 103950 - DNA, 878 bp, Homo sapiens
  Payload ID: 435
  Gene Symbol: ACTA2
  Gene Name: actin, alpha 2, smooth muscle, aorta
  ENST ID: ENST00000415557
  CDS Start-End: 425-878
gacctttggcttggcttgtcagggcttgtccaggagttccgctcctctctccaaccggggtccccctccagcgaccctaaagcttcccagacttccgcttcaattcctgtccgcaccccacgcccacctcaacgtggagcgcagtggtctccgaggagcgccggagctgccccgcctgcccagcggggtcagcacttcgcatcaaggcccaagaaaagcaagtcctccagcgttctgagcacccgggcctgagggaaggtcctaacagcccccgggagccagtctccaacgcctcccgcagcagcccgccgctcccaggtgcccgcgtgcgccgctgccgccgcaatcccgcacgcgtcccgcgcccgccccactttgcctatccccgggactaagacgggaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcagggggtgatggtgggaatgggacaaaaagacagctacgtgggtgacgaagcacagagcaaaagaggaatcctgaccctgaagtacccgatagaacatggcatcatcaccaactgggacgacatggaaaagatctggcaccactctttctacaatgagcttcgtgttgcccctgaagagcatcccaccctgctcacggaggcacccctgaaccccaaggccaaccgggagaaaatgactcaaattatgtttgagactttcaatgtcccagccatgtatgtggctatccaggcggtgctgtctctctatgcctctggacgcacaactg

SEQ ID NO: 103951 - DNA, 744 bp, Homo sapiens
  Payload ID: 435
  Gene Symbol: ACTA2
  Gene Name: actin, alpha 2, smooth muscle, aorta
  ENST ID: ENST00000458159
  CDS Start-End: 291-744
caaccggggtccccctccagcgaccctaaagcttcccagacttccgcttcaattcctgtccgcaccccacgcccacctcaacgtggagcgcagtggtctccgaggagcgccggagctgccccgcctgcccagcggggtcagcacttcgcatcaaggcccaagaaaagcaagtcctccagcgttctgagcacccgggcctgagggaaggtcctaacagcccccgggagccagtctccaacgcctcccgcagcagcccgccgctcccagaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcagggggtgatggtgggaatgggacaaaaagacagctacgtgggtgacgaagcacagagcaaaagaggaatcctgaccctgaagtacccgatagaacatggcatcatcaccaactgggacgacatggaaaagatctggcaccactctttctacaatgagcttcgtgttgcccctgaagagcatcccaccctgctcacggaggcacccctgaaccccaaggccaaccgggagaaaatgactcaaattatgtttgagactttcaatgtcccagccatgtatgtggctatccaggcggtgctgtctctctatgcctctggacgcacaactg

SEQ ID NO: 103952 - DNA, 1756 bp, Homo sapiens
  Payload ID: 435
  Gene Symbol: ACTA2
  Gene Name: actin, alpha 2, smooth muscle, aorta
  Uniprot ID: P62736
  ENST ID: ENST00000458208
  CDS Start-End: 476-1609
ctctccccgcccccgcggggcggcgcgcactcacccacccgcgccggagcggacctttggcttggcttgtcagggcttgtccaggagttccgctcctctctccaaccggggtccccctccagcgaccctaaagcttcccagacttccgcttcaattcctgtccgcaccccacgcccacctcaacgtggagcgcagtggtctccgaggagcgccggagctgccccgcctgcccagcggggtcagcacttcgcatcaaggcccaagaaaagcaagtcctccagcgttctgagcacccgggcctgagggaaggtcctaacagcccccgggagccagtctccaacgcctcccgcagcagcccgccgctcccaggtgcccgcgtgcgccgctgccgccgcaatcccgcacgcgtcccgcgcccgccccactttgcctatccccgggactaagacgggaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcagggggtgatggtgggaatgggacaaaaagacagctacgtgggtgacgaagcacagagcaaaagaggaatcctgaccctgaagtacccgatagaacatggcatcatcaccaactgggacgacatggaaaagatctggcaccactctttctacaatgagcttcgtgttgcccctgaagagcatcccaccctgctcacggaggcacccctgaaccccaaggccaaccgggagaaaatgactcaaattatgtttgagactttcaatgtcccagccatgtatgtggctatccaggcggtgctgtctctctatgcctctggacgcacaactggcatcgtgctggactctggagatggtgtcacccacaatgtccccatctatgagggctatgccttgccccatgccatcatgcgtctggatctggctggccgagatctcactgactacctcatgaagatcctgactgagcgtggctattccttcgttactactgctgagcgtgagattgtccgggacatcaaggagaaactgtgttatgtagctctggactttgaaaatgagatggccactgccgcatcctcatcctcccttgagaagagttacgagttgcctgatgggcaagtgatcaccatcggaaatgaacgtttccgctgcccagagaccctgttccagccatccttcatcgggatggagtctgctggcatccatgaaaccacctacaacagcatcatgaagtgtgatattgacatcaggaaggacctctatgctaacaatgtcctatcagggggcaccactatgtaccctggcattgccgaccgaatgcagaaggagatcacggccctagcacccagcaccatgaagatcaagatcattgcccctccggagcgcaaatactctgtctggatcggtggctccatcctggcctctctgtccaccttccagcagatgtggatcagcaaacaggaatacgatgaagccgggccttccattgtccaccgcaaatgcttctaaaacactttcctgctcctctctgtctctagcacacaactgtgaatgtcctgtggaattatgccttcagttcttttccaaatcattcctagccaaagctctgactcgttacctatgtgttttttaataaatctgaaataggctactggt

SEQ ID NO: 103953 - DNA, 4106 bp, Homo sapiens
  Payload ID: 436
  Gene Symbol: ACTC1
  Gene Name: actin, alpha, cardiac muscle 1
  Uniprot ID: P68032
  ENST ID: ENST00000290378
  CDS Start-End: 657-1790
attcaggctggcggggactagaccagaagggtgccctgtcctgggtgccccttttgcagccactcagatgtgctgctgcggtgtcctttgtgctggtggcagccctggaagatgagaagccgctgttgctcccctgctgccctggcccagctgtcaggacccctcagcagagggcagggcgccaagccttcccactgcatgtggcttattgtccccaaggctggcagggctgcggaggaccgaatccacagaccatccagggagcacccacaccccagaaagggggaggggtgggctggcgtcacttagtcttcccctgccccctacccttcagcgcctgcccctccccagctccctatttggccatccccctgactgccccctccccttccttacatggtctgggggctccctggctgatcctctcccctgcccttggctccatgaatggcctcggcagtcctagcgggtgcgaaggggaccaaataaggcaaggtggcagaccgggccccccacccctgcccccggctgctccaactgaccctgtccatcagcgttctataaagcggccctcctggagccagccacccagagcccgctgccgccggagccgagccgacccgccccgccgacgaaccccctgaagctgtgccaagatgtgtgacgacgaggagaccaccgccctggtgtgcgacaacggctctgggctggtgaaggccggctttgcgggcgatgacgcgccccgcgctgtcttcccgtccatcgtgggccgcccgcggcaccagggagttatggtgggtatgggtcagaaggactcctacgtaggtgatgaagcccagagcaagagaggcatcctgaccctgaagtatcccatcgagcatggtatcatcaccaactgggacgacatggagaagatctggcaccacaccttctacaatgagctccgtgtggctcccgaggagcaccccaccctgctcacagaggccccgctgaaccccaaggccaaccgggagaagatgactcagatcatgtttgagaccttcaatgtccctgccatgtacgtggccatccaggcagtgctatccctgtatgcttctggccgtaccacaggcattgttctggactctggggatggtgtaactcacaatgtccccatctatgagggctacgctttgccccatgccatcatgcgtctggatctggctggtcgggacctcactgactacctcatgaagatcctcactgagcgtggctactcctttgtcaccactgctgaacgtgaaattgtccgtgacattaaagagaagctgtgctatgtcgccctggattttgagaatgagatggccacagctgcctcttcctcctccctggagaagagctatgaactgcctgatggccaagtcatcactattggcaatgagcgcttccgctgtcctgagacactcttccagccctccttcattggtatggaatctgctggcatccatgaaacaacttacaatagcatcatgaagtgtgacattgatatccgcaaggacctgtatgccaacaatgtcttatctggaggcaccactatgtaccctggtattgctgatcgtatgcagaaggaaatcactgctctggctcctagcaccatgaagattaagattattgctccccctgagcgtaaatactctgtctggattgggggctccatcctggcctctctgtccaccttccagcaaatgtggattagcaagcaagagtacgatgaggcaggcccatccattgtccaccgcaaatgcttctaagatgccttctctctccatctaccttccagtcaggatgacggtattatgcttcttggagtcttccaaaccaccttccctcatctttcatcaatcattgtacagtttgtttacacacgtgcaatttgtttgtgcttctaatatttattgctttataaataaaccagaccaggacttgcaacctataaaagcctctcgtttgtttttggggtaggcgtggggtggggcaggtgtttgctttgacaccctgagcattgtcaaagttcagtaccacaaggttcatccagatgaattaatatgacagttagctgggagttataatgctaacttttgatttcatattttgagacagaatcatgaatatatttcatacctgaaaagcagattaaggtttagttccatataagtaagaaatgaaattgaataagatagttctctagaattagttgctgcagatgacactgaagattattttaacatatgttccagttgtttttgtaaccttgcagaaaatacacatatattgataatgagaaagtcaaagattattttaaatgaattggcttaacttttcaattctttgaactcttcaattttcttcctgggggctatgaaagaaacatgaaggttagctgacagttgggccagccacatcccattgcaaataccctctaaacatatcaagaccattgtgtgtgtgcaaaacaaatgtgaggaagcaggagccaaacacttctgcctgatcagtgactaacttgcgagacagaagccttcaatctcttcgtttctttgaaatcttgagatcttgggttgagtgaactgaaggctgcgaggtcctgagggagcaaggggaggcgagagccacagtgtttgctttgctctgtgcagagctctctgcaaagtatggtgggaaggctgctaggggcagcgttgaaaagaattgaatgtgttccatcctcgaggagttcacacacctacacataatcccccagtgcgtgtggcctggaggctttaaggagatgtatgtgggtctgggtcttagagaatggtcaggaattagggaggtgagaagagcagagaggacatctcagcagaaggaagtgtggcagaagccaggatacaagacatggggcaggctggtaggtgctgatgaattttagaaaatccactgggaaaggtagatttcaactagattgcagaagccttacagatttttgttttcaaattaattgccagtgaactgttagcattcacagaagtgtttgaatagacttaattgaattttattgatgaggattcaagacacagagattaagcaactggtgcaatgttataaactttatttgtggaatgtgctagacaggaactcagattttctgacacctactctgatggtgtctctaaaataatctttctaactttatagtttatcaagggtaaccccattctatcacatgccttttgagaatttgggttcaatatttggagtactctggactcatcagacatctttaataaattgtaatacattgccactgtcattcaaggtcctatgtgtgtctttttgcctattcataccaaaaatatcttttgatccctgactctgggtcgggcatagtattaagggcaggggacacaaagatgtatgagagcacattttctgtgaataaaaagctcagagtttagagttctgtatgtagcatattcaaatggaaggccttctatgcaataaaggctaaataatacatcaacttggtggcattttatttagataaggtgcaaacattattgtacatatgccccccgcccccaccaccccattgtatcctatagcacagttgaactggtttaaaagccatgcatggggaggtatgatttcactagtttttgtgtctctttcttttcctctgtacaattgagtgcataaatattatgaattgtatcctctgaacacagtattaatgctttaactgtagatgattggctggggtatcacctctggttctttccatctgtgattagaaatggagaggacatttttatttctatgtaaaagtagaagctttaagaatcagcttctgatatttatatcagaagaggtaagcacccagattcttgttgaattctgaggtcttctcatctttgcttgattatagggtataaagtattagaacaattgaatcttaaaaattgtgcttaaggaaggtactaagacaaaaatgtttgcttaaggtaatcttcatatgtatacaataactgagacatggatagtgcctacgtctttggttaaagtgcaataaacaaagaactatataaatt

SEQ ID NO: 103954 - DNA, 1917 bp, Homo sapiens
  Payload ID: 437
  Gene Symbol: ACTB
  Gene Name: actin, beta
  Uniprot ID: P60709
  ENST ID: ENST00000331789
  CDS Start-End: 193-1320
gagtgagcggcgcggggccaatcagcgtgcgccgttccgaaagttgccttttatggctcgagcggccgcggcggcgccctataaaacccagcggcgcgacgcgccaccaccgccgagaccgcgtccgccccgcgagcacagagcctcgcctttgccgatccgccgcccgtccacacccgccgccagctcaccatggatgatgatatcgccgcgctcgtcgtcgacaacggctccggcatgtgcaaggccggcttcgcgggcgacgatgccccccgggccgtcttcccctccatcgtggggcgccccaggcaccagggcgtgatggtgggcatgggtcagaaggattcctatgtgggcgacgaggcccagagcaagagaggcatcctcaccctgaagtaccccatcgagcacggcatcgtcaccaactgggacgacatggagaaaatctggcaccacaccttctacaatgagctgcgtgtggctcccgaggagcaccccgtgctgctgaccgaggcccccctgaaccccaaggccaaccgcgagaagatgacccagatcatgtttgagaccttcaacaccccagccatgtacgttgctatccaggctgtgctatccctgtacgcctctggccgtaccactggcatcgtgatggactccggtgacggggtcacccacactgtgcccatctacgaggggtatgccctcccccatgccatcctgcgtctggacctggctggccgggacctgactgactacctcatgaagatcctcaccgagcgcggctacagcttcaccaccacggccgagcgggaaatcgtgcgtgacattaaggagaagctgtgctacgtcgccctggacttcgagcaagagatggccacggctgcttccagctcctccctggagaagagctacgagctgcctgacggccaggtcatcaccattggcaatgagcggttccgctgccctgaggcactcttccagccttccttcctgggcatggagtcctgtggcatccacgaaactaccttcaactccatcatgaagtgtgacgtggacatccgcaaagacctgtacgccaacacagtgctgtctggcggcaccaccatgtaccctggcattgccgacaggatgcagaaggagatcactgccctggcacccagcacaatgaagatcaagatcattgctcctcctgagcgcaagtactccgtgtggatcggcggctccatcctggcctcgctgtccaccttccagcagatgtggatcagcaagcaggagtatgacgagtccggcccctccatcgtccaccgcaaatgcttctaggcggactatgacttagttgcgttacaccctttcttgacaaaacctaacttgcgcagaaaacaagatgagattggcatggctttatttgttttttttgttttgttttggttttttttttttttttggcttgactcaggatttaaaaactggaacggtgaaggtgacagcagtcggttggagcgagcatcccccaaagttcacaatgtggccgaggactttgattgcacattgttgtttttttaatagtcattccaaatatgagatgcgttgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacaccttaaaaa

SEQ ID NO: 103955 - DNA, 569 bp, Homo sapiens
  Payload ID: 437
  Gene Symbol: ACTB
  Gene Name: actin, beta
  ENST ID: ENST00000443528
  CDS Start-End: 262-569
gtctggagtaagcctcgcccccaccccaactcccaggaattctgctgagtcacttcggaggccacagctgcaaccttgggaacaatacgagtcattcaattcactaggcagcgtcccagcgctcacctgggggacttggccacggtctcttgttagaagcctcttcatggacaacgtggccaaccccacctcacccctatcgtctcccccggccacaccctgggccaatcgggctcccacgtcagggtctttgcactcaccatggatgatgatatcgccgcgctcgtcgtcgacaacggctccggcatgtgcaaggccggcttcgcgggcgacgatgccccccgggccgtcttcccctccatcgtggggcgccccaggcaccagggcgtgatggtgggcatgggtcagaaggattcctatgtgggcgacgaggcccagagcaagagaggcatcctcaccctgaagtaccccatcgagcacggcatcgtcaccaactgggacgacatggagaaaatctggcaccacaccttctacaatgagctgcgtgtggctcccgaggagcaccccgt

SEQ ID NO: 103956 - DNA, 472 bp, Homo sapiens
  Payload ID: 437
  Gene Symbol: ACTB
  Gene Name: actin, beta
  ENST ID: ENST00000417101
  CDS Start-End: 175-472
gcacttcctgcccgagccgctggccgcccgagggtgtggccgctgcgtgcgcgcgcgccgacccggcgctgtttgaaccgggcggaggcggggctggcgcccggttgggagggggttggggcctggcttcctgccgcgcgccgcggggacgcctccgaccagtgtttgccttttatgctcaccatggatgatgatatcgccgcgctcgtcgtcgacaacggctccggcatgtgcaaggccggcttcgcgggcgacgatgccccccgggccgtcttcccctccatcgtggggcgccccaggcaccagggcgtgatggtgggcatgggtcagaaggattcctatgtgggcgacgaggcccagagcaagagaggcatcctcaccctgaagtaccccatcgagcacggcatcgtcaccaactgggacgacatggagaaaatctggcaccacaccttctacaatgagctgcgtgtgg

SEQ ID NO: 103957 - DNA, 561 bp, Homo sapiens
  Payload ID: 437
  Gene Symbol: ACTB
  Gene Name: actin, beta
  ENST ID: ENST00000414620
  CDS Start-End: 320-561
attctgctgagtcacttcggaggccacagctgcaaccttgggaacaatacgagtcattcaattcactaggcagcgtcccagcgctcacctgggggacttggccacggtctcttgttagaagcctcttcatggacaacgtggccaaccccacctcacccctatcgtctcccccggccacaccctgggccaatcgggctcccacgtcagggtctttgcatagagatggagtttcaacatgttgtccaggctggtcttgaactcgtgaccacaagtgatccacccaccatggcctcccaaagtgctgggattacagctcaccatggatgatgatatcgccgcgctcgtcgtcgacaacggctccggcatgtgcaaggccggcttcgcgggcgacgatgccccccgggccgtcttcccctccatcgtggggcgccccaggcaccagggcgtgatggtgggcatgggtcagaaggattcctatgtgggcgacgaggcccagagcaagagaggcatcctcaccctgaagtaccccatcgagcacggcatcgtcaccaactgggacga

SEQ ID NO: 103958 - DNA, 568 bp, Homo sapiens
  Payload ID: 437
  Gene Symbol: ACTB
  Gene Name: actin, beta
  ENST ID: ENST00000432588
  CDS Start-End: 78-568
agcttggcgcggcaggcgcgtcggttgcgccacctggcggtcgcctggaaccccacaacccaaccaaccagctcaccatggatgatgatatcgccgcgctcgtcgtcgacaacggctccggcatgtgcaaggccggcttcgcgggcgacgatgccccccgggccgtcttcccctccatcgtggggcgccccaggcaccagggcgtgatggtgggcatgggtcagaaggattcctatgtgggcgacgaggcccagagcaagagaggcatcctcaccctgaagtaccccatcgagcacggcatcgtcaccaactgggacgacatggagaaaatctggcaccacaccttctacaatgagctgcgtgtggctcccgaggagcaccccgtgctgctgaccgaggcccccctgaaccccaaggccaaccgcgagaagatgacccagatcatgtttgagaccttcaacaccccagccatgtacgttgctatccaggctgtgctatccctgtacgcctctggccgtaccactggcatcgtgatggactccggtgacggggtcacccacactgtgcc

SEQ ID NO: 103959 - DNA, 1845 bp, Homo sapiens
  Payload ID: 437
  Gene Symbol: ACTB
  Gene Name: actin, beta
  ENST ID: ENST00000425660
  CDS Start-End: 85-462
accgccgagaccgcgtccgccccgcgagcacagagcctcgcctttgccgatccgccgcccgtccacacccgccgccagctcaccatggatgatgatatcgccgcgctcgtcgtcgacaacggctccggcatgtgcaaggccggcttcgcgggcgacgatgccccccgggccgtcttcccctccatcgtggggcgccccaggcaccagggcgtgatggtgggcatgggtcagaaggattcctatgtgggcgacgaggcccagagcaagagaggcatcctcaccctgaagtaccccatcgagcacggcatcgtcaccaactgggacgacatggagaaaatctggcaccacaccttctacaatgagctgcgtgtggctcccgaggagcaccccgtgctgctgaccgaggcccccctgaaccccaaggccaaccgcgagaagatgacccaggactctcttctctgacctgagtctcctttggaactctgcagatcatgtttgagaccttcaacaccccagccatgtacgttgctatccaggctgtgctatccctgtacgcctctggccgtaccactggcatcgtgatggactccggtgacggggtcacccacactgtgcccatctacgaggggtatgccctcccccatgccatcctgcgtctggacctggctggccgggacctgactgactacctcatgaagatcctcaccgagcgcggctacagcttcaccaccacggccgagcgggaaatcgtgcgtgacattaaggagaagctgtgctacgtcgccctggacttcgagcaagagatggccacggctgcttccagctcctccctggagaagagctacgagctgcctgacggccaggtcatcaccattggcaatgagcggttccgctgccctgaggcactcttccagccttccttcctgggcatggagtcctgtggcatccacgaaactaccttcaactccatcatgaagtgtgacgtggacatccgcaaagacctgtacgccaacacagtgctgtctggcggcaccaccatgtaccctggcattgccgacaggatgcagaaggagatcactgccctggcacccagcacaatgaagatcaagatcattgctcctcctgagcgcaagtactccgtgtggatcggcggctccatcctggcctcgctgtccaccttccagcagatgtggatcagcaagcaggagtatgacgagtccggcccctccatcgtccaccgcaaatgcttctaggcggactatgacttagttgcgttacaccctttcttgacaaaacctaacttgcgcagaaaacaagatgagattggcatggctttatttgttttttttgttttgttttggttttttttttttttttggcttgactcaggatttaaaaactggaacggtgaaggtgacagcagtcggttggagcgagcatcccccaaagttcacaatgtggccgaggactttgattgcacattgttgtttttttaatagtcattccaaatatgagatgcgttgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacacctt

SEQ ID NO: 103960 - DNA, 2794 bp, Homo sapiens
  Payload ID: 438
  Gene Symbol: ACTBL2
  Gene Name: actin, beta-like 2
  Uniprot ID: Q562R1
  ENST ID: ENST00000423391
  CDS Start-End: 103-1233
gtctgaaagcatttctggagtgttttaggcctgttcactttctcttactcactgtctattcacttgtcctgttcactcgtctggaagatctcagccagcaccatgactgacaatgagctgtctgccttggtagtggataatgggtcagggatgtgcaaggcaggctttggtggtgacgatgccccccgggctgtgttcccctccatgatagggcgtcctcgacaccagggcgttatggtaggcatgggccagaaggactgctacgtgggagatgaggctcagagcaagagaggcgtcctgaccctgaagtatcctatcgagcatggagtggtcaccaactgggacgatatggaaaagatctggtaccacacattctacaatgagctccgtgtggcaccagatgagcatcccatcctcctcaccgaggcacccctgaaccccaagatcaaccgggaaaagatgactcagatcatgttcgaggctttcaacacaccagccatgtatgtcgccatccaggctgtgctgtccctctatgcctcaggacggaccacaggcatcgtgatggattctggggatggggtcactcacatcgtgcccatctatgaaggttatgccctgcctcatgccattctacgcctggatctggcagggagagacctgactgattacctcatgaagatcctgacagagcgaggctataacttcaccaccactgctgagcgggagattgtgcgagatgtcaaagagaagctgtgctacgtagccctggactttgagcaggagatggtcagggcagccgcatcctcctcaccggaacggagctatgaacttcctgatgggcaggtgatcaccattgggaatgaacgcttccgatgccctgaagccattttccagccttcctttctgggcattgagtccagtgggatccatgagacaaccttcaactctatcatgaagtgcgatgtggatattcgcaaggatctctatgccaacaccgtgttatctggagggagcaccatgtacccaggcattgctgacaggatgcagaaagaaatcataaccctggcacccagcaccatgaaaatcaagatcatagctcccccagagcggaagtattctgtttggattgggggctccatccttgccagcctgtccacattccagcagatgtggatcagtaagcaggaatatgatgaggctggtcctcctatcgttcacagaaaatgtttctgaatgggcttccatattagtgggcttacattttcccttttcctaggtcacagtgatggtactgcttttatccgctttcagtagaatcgaggtaaatacgtcactcttcctagtgtaaaccagcaaacccatctctccatccaagtaacctgggctcttacccagataaccacatccggttctccatcaagtgaaggtgaattctaataccatattcctttttctttgcctatactgttcaaagataggtaggccagcttaaatacatataagtgacaaggagtaaaatcacgagaaatgtcatttcagaatggataactataattatcaagctttaaaacttagttctcgctaaaatatttaacaagaacaggctgtataaacttgtttaaaaaaaaaaggtgcgtatgcatttagcagccgtgtcttactagttaagtatctttgttttgtttacttctttgtatggagataatgaattataaagttcaataatatccatatatacataagcaccagggaaataaaatatattgtgaaatatgctgatgtatctagctatctgaacagctaatgtgaatttctttactcccaaaagtcatcgttgtactaggtacatattttaattgtttcccttactaaataagcataatgagacagccaccattccattaatgtttataaatcatctaaattttcagctcatagtggagttctgctggtcaaattatattttaatatctttcttactgaaccttctcataccaaaactacagacaatgtctaattcttaagagagatagatattataatatcaaattaatgtcattatggtacaatttgacagaggtaattttatttctatttcttagtgtaatagcacatcttaaataatttctgtagaccaggattacagatacttctcttgtgcaaggatttcactgtgggaaaatatagctgcagcatctttattaattatacattttactaccagtatactaacacagttttatccttggaaagcttttagaataattctactttattatgtccagtaactagcaatacttatttatgcaaagtgtctctgagatactaacatctttgaaaatatcaatgtatgttcctataatgtctaaaatattttagttactccagtgatgatttattaaccaattttaagtaccagtatgtttattccaatctatgcagtgatttctgaatatttggatatcagcattatttgtatttttcagggtaatttctgaaaatttaaaatatttatttggattgcttattcaggcattataaggtactctggaggaaggaatcacttctctttttttcttagttgggaaacttgtacttatgttataaatctttaaaatggaatcagtaagaattttttgtttaaggtaatacttttcaaataatttgattattccttattggctttatctgacaacataatctttaaaatgcatgtaaccaaaattaatctccaaaaacactttattttatataacttgctttcagtacattaaaattgcttcatacttgtata

SEQ ID NO: 103961 - DNA, 1530 bp, Homo sapiens
  Payload ID: 439
  Gene Symbol: ACTG2
  Gene Name: actin, gamma 2, smooth muscle, enteric
  Uniprot ID: P63267
  ENST ID: ENST00000345517
  CDS Start-End: 110-1240
tatattgctctggtattcatgccaaagacacaccagccctcagtcactgggagaagaacctctcataccctcggtgctccagtccccagctcactcagccacacacaccatgtgtgaagaggagaccaccgcgctcgtgtgtgacaatggctctggcctgtgcaaggcaggcttcgcaggagatgatgccccccgggctgtcttcccctccattgtgggccgccctcgccaccagggtgtgatggtgggaatgggccagaaagacagctatgtgggggatgaggctcagagcaagcgagggatcctaactctcaaataccccattgaacacggcatcatcaccaactgggatgacatggagaagatctggcaccactccttctacaatgagctgcgtgtagcacctgaagagcaccccaccctgctcacagaggctcccctaaatcccaaggccaacagggaaaagatgacccagatcatgtttgaaaccttcaatgtccctgccatgtacgtcgccattcaagctgtgctctccctctatgcctctggccgcacgacaggcatcgtcctggattcaggtgatggcgtcacccacaatgtccccatctatgaaggctatgccctgccccatgccatcatgcgcctggacttggctggccgtgacctcacggactacctcatgaagatcctcacagagagaggctattcctttgtgaccacagctgagagagaaattgtgcgagacatcaaggagaagctgtgctatgtggccctggattttgagaatgagatggccacagcagcttcctcttcctccctggagaagagctatgagctgccagatgggcaggttatcaccattggcaatgagcgcttccgctgccctgagaccctcttccagccttcctttattggcatggagtccgctggaattcatgagacaacctacaattccatcatgaagtgtgacattgacatccgtaaggacttatatgccaacaatgtcctctctgggggcaccaccatgtaccctggcattgctgacaggatgcagaaggagatcacagccctggcccccagcaccatgaagatcaagattattgctcccccagagcggaagtactcagtctggatcgggggctctatcctggcctctctctccaccttccagcagatgtggatcagcaagcctgagtatgatgaggcagggccctccattgtccacaggaagtgcttctaaagtcagaacaggttctccaaggatcccctcgagactactctgttaccagtcatgaaacattaaaacctacaagccttacttctctgtgtggggctcttttttcctgggctatgtctcatacacagtgctaaggacttttcacacattacttttaatccatgcaatagtgctgtaaggtaggtgctatcattatacccatattacagatgaggaaattgaggctcagagaagtcaaggacttgcgaagatcacacagattccagattaaaattcaagtatctgactgcaaa

SEQ ID NO: 103962 - DNA, 2064 bp, Homo sapiens
  Payload ID: 439
  Gene Symbol: ACTG2
  Gene Name: actin, gamma 2, smooth muscle, enteric
  Uniprot ID: P63267
  ENST ID: ENST00000409624
  CDS Start-End: 644-1774
acaccagccctcagtcactgggagaagaacctctcataccctcggggaataaaagcttcattcctgagtcagtgagagcttcaatgaagcccagatgtcattcgtgctgaaagaaccagaacaactctctgctccctgccaagcatgaagcggttgtgaccccaggaaaccacagtgactttgactctggttcagctgacatgctcgagtctagccacaaattaccagaaagcagctgaggaaagtttagaatttctcctggcagagatggtccacgagtctggctccagggtgaaccccttcttcccagagcagcacggggccctttggaggctcgactccgccagccctcccactgccttccccctgccttccccaccctcacttcggttgagttttgccttcaaaatagcagactccaagccacctgaagggctgcagaacagcgttgttgacagcttcaagtcgccttgtggcttctctgagctgctgctgtgctttggaaacaaaattccaggctctccctctttctgtgtgtgggaaacaccggagagagtttggggagggagacaaaagggcccattgaaaacccagacaggcttgaactgtgctccagtccccagctcactcagccacacacaccatgtgtgaagaggagaccaccgcgctcgtgtgtgacaatggctctggcctgtgcaaggcaggcttcgcaggagatgatgccccccgggctgtcttcccctccattgtgggccgccctcgccaccagggtgtgatggtgggaatgggccagaaagacagctatgtgggggatgaggctcagagcaagcgagggatcctaactctcaaataccccattgaacacggcatcatcaccaactgggatgacatggagaagatctggcaccactccttctacaatgagctgcgtgtagcacctgaagagcaccccaccctgctcacagaggctcccctaaatcccaaggccaacagggaaaagatgacccagatcatgtttgaaaccttcaatgtccctgccatgtacgtcgccattcaagctgtgctctccctctatgcctctggccgcacgacaggcatcgtcctggattcaggtgatggcgtcacccacaatgtccccatctatgaaggctatgccctgccccatgccatcatgcgcctggacttggctggccgtgacctcacggactacctcatgaagatcctcacagagagaggctattcctttgtgaccacagctgagagagaaattgtgcgagacatcaaggagaagctgtgctatgtggccctggattttgagaatgagatggccacagcagcttcctcttcctccctggagaagagctatgagctgccagatgggcaggttatcaccattggcaatgagcgcttccgctgccctgagaccctcttccagccttcctttattggcatggagtccgctggaattcatgagacaacctacaattccatcatgaagtgtgacattgacatccgtaaggacttatatgccaacaatgtcctctctgggggcaccaccatgtaccctggcattgctgacaggatgcagaaggagatcacagccctggcccccagcaccatgaagatcaagattattgctcccccagagcggaagtactcagtctggatcgggggctctatcctggcctctctctccaccttccagcagatgtggatcagcaagcctgagtatgatgaggcagggccctccattgtccacaggaagtgcttctaaagtcagaacaggttctccaaggatcccctcgagactactctgttaccagtcatgaaacattaaaacctacaagccttacttctctgtgtggggctcttttttcctgggctatgtctcatacacagtgctaaggacttttcacacattacttttaatccatgcaatagtgctgtaaggtaggtgctatcattatacccatattacagatgaggaaattgaggctcagagaagtcaaggacttgcgaagatcacacagattccagattaaaattcaagtatctgactgcaaa

SEQ ID NO: 103963 - DNA, 1413 bp, Homo sapiens
  Payload ID: 439
  Gene Symbol: ACTG2
  Gene Name: actin, gamma 2, smooth muscle, enteric
  Uniprot ID: P63267
  ENST ID: ENST00000409731
  CDS Start-End: 122-1123
cctctggggttttatattgctctggtattcatgccaaagacacaccagccctcagtcactgggagaagaacctctcataccctcggtgctccagtccccagctcactcagccacacacaccatgtgtgaagaggagaccaccgcgctcgtgtgtgacaatggctctggcctgtgcaaggcaggcttcgcaggagatgatgccccccgggctgtcttcccctccattgtgggccgccctcgccaccagatctggcaccactccttctacaatgagctgcgtgtagcacctgaagagcaccccaccctgctcacagaggctcccctaaatcccaaggccaacagggaaaagatgacccagatcatgtttgaaaccttcaatgtccctgccatgtacgtcgccattcaagctgtgctctccctctatgcctctggccgcacgacaggcatcgtcctggattcaggtgatggcgtcacccacaatgtccccatctatgaaggctatgccctgccccatgccatcatgcgcctggacttggctggccgtgacctcacggactacctcatgaagatcctcacagagagaggctattcctttgtgaccacagctgagagagaaattgtgcgagacatcaaggagaagctgtgctatgtggccctggattttgagaatgagatggccacagcagcttcctcttcctccctggagaagagctatgagctgccagatgggcaggttatcaccattggcaatgagcgcttccgctgccctgagaccctcttccagccttcctttattggcatggagtccgctggaattcatgagacaacctacaattccatcatgaagtgtgacattgacatccgtaaggacttatatgccaacaatgtcctctctgggggcaccaccatgtaccctggcattgctgacaggatgcagaaggagatcacagccctggcccccagcaccatgaagatcaagattattgctcccccagagcggaagtactcagtctggatcgggggctctatcctggcctctctctccaccttccagcagatgtggatcagcaagcctgagtatgatgaggcagggccctccattgtccacaggaagtgcttctaaagtcagaacaggttctccaaggatcccctcgagactactctgttaccagtcatgaaacattaaaacctacaagccttacttctctgtgtggggctcttttttcctgggctatgtctcatacacagtgctaaggacttttcacacattacttttaatccatgcaatagtgctgtaaggtaggtgctatcattatacccatattacagatgaggaaattgaggctcagagaagtcaaggacttgcgaagatcacacagattccagattaaaattcaagtatctgactgcaaa

SEQ ID NO: 103964 - DNA, 927 bp, Homo sapiens
  Payload ID: 439
  Gene Symbol: ACTG2
  Gene Name: actin, gamma 2, smooth muscle, enteric
  ENST ID: ENST00000409918
  CDS Start-End: 107-466
attgctctggtattcatgccaaagacacaccagccctcagtcactgggagaagaacctctcataccctcggtgctccagtccccagctcactcagccacacacaccatgtgtgaagaggagaccaccgcgctcgtgtgtgacaatggctctggcctgtgcaaggcaggcttcgcaggagatgatgccccccgggctgtcttcccctccattgtgggccgccctcgccaccagggtgtgatggtgggaatgggccagaaagacagctatgtgggggatgaggctcagagcaagcgagggatcctaactctcaaataccccattgaacacggcatcatcaccaactgggatgacatggagaagccccacgaccatttctccaacctaggctgccaacatctctccctggactattgcaatggcttcctggctgatttcttggtctcttgccctcattcaccgaattaattctctacactgctgcaaaactgatctttctaaacacaggtcagctcatgtcactcacctcctcagaaatcttcagtagctcttcattaaccaacagggggttcctaactccccgtcttggcattggaggacctttccctgcctgatccccgcgatcatcttttcctgcaatatttactcaggccagtgctcaccccttctttaaaatgctggtgctggctcaagagaggcaaacagccatctctctcattcttatcttccctgtcaagacttcacataggtggactgatgctagactatgatgatgagtctccagtgaaagtttctaagtagaactctctcagggtttctagaagcatttttgtttaagaaaatattgtggggggagcgggatttttaaatggtggagctcatggtaaacaaaattatgtgtgcaaaatgttaatagagcctttctaata

SEQ ID NO: 103965 - DNA, 594 bp, Homo sapiens
  Payload ID: 439
  Gene Symbol: ACTG2
  Gene Name: actin, gamma 2, smooth muscle, enteric
  ENST ID: ENST00000429756
  CDS Start-End: 122-280
cctctggggttttatattgctctggtattcatgccaaagacacaccagccctcagtcactgggagaagaacctctcataccctcggtgctccagtccccagctcactcagccacacacaccatgtgtgaagaggagaccaccgcgctcgtgtgtgacaatggctctggcctgtgcaaggcaggcttcgcaggagatgatgccccccgggctgtcttcccctccattgtgggccgccctcgccaccaggtgcgtgctcatctggataccaccaggctttgagccactaggaatctggcaccactccttctacaatgagctgcgtgtagcacctgaagagcaccccaccctgctcacagaggctcccctaaatcccaaggccaacagggaaaagatgacccagatcatgtttgaaaccttcaatgtccctgccatgtacgtcgccattcaagctgtgctctccctctatgcctctggccgcacgacaggcatcgtcctggattcaggtgatggcgtcacccacaatgtccccatctatgaaggctatgccctgccccatgccatcatgcgcctggacttggctggccgtgacctca

SEQ ID NO: 103966 - DNA, 540 bp, Homo sapiens
  Payload ID: 439
  Gene Symbol: ACTG2
  Gene Name: actin, gamma 2, smooth muscle, enteric
  ENST ID: ENST00000442912
  CDS Start-End: 107-540
attgctctggtattcatgccaaagacacaccagccctcagtcactgggagaagaacctctcataccctcggtgctccagtccccagctcactcagccacacacaccatgtgtgaagaggagaccaccgcgctcgtgtgtgacaatggctctggcctgtgcaaggcaggcttcgcaggagatgatgccccccgggctgtcttcccctccattgtgggccgccctcgccaccagggtgtgatggtgggaatgggccagaaagacagctatgtgggggatgaggctcagagcaagcgagggatcctaactctcaaataccccattgaacacggcatcatcaccaactgggatgacatggagaagatctggcaccactccttctacaatgagctgcgtgtagcacctgaagagcaccccaccctgctcacagaggctcccctaaatcccaaggccaacagggaaaagatgacccaggtaagaagccaggaagacttgaacactggcataagaatgcaacatggatgcttggccagatactttct

SEQ ID NO: 103967 - DNA, 1921 bp, Homo sapiens
  Payload ID: 439
  Gene Symbol: ACTG2
  Gene Name: actin, gamma 2, smooth muscle, enteric
  ENST ID: ENST00000438902
  CDS Start-End: 308-625
gttaggtgtgcctcaaccctgaagcaggtccctcagtctgcagatatttagagatatttaaaggaaaaccaggaaggagccaagagagaatgaagcctaaggtgtcctgagaccctcagagaactcagcccaagggttaggagcttgtgtcaaggtgcagcagggactttgtttaaagaagatccgcctctggggttttatattgctctggtattcatgccaaagacacaccagccctcagtcactgggagaagaacctctcataccctcggtgctccagtccccagctcactcagccacacacaccatgtgtgaagaggagaccaccgcgctcgtgtgtgacaatggctctggcctgtgcaaggcaggcttcgcaggagatgatgccccccgggctgtcttcccctccattgtgggccgccctcgccaccagggtgtgatggtgggaatgggccagaaagacagctatgtgggggatgaggctcagagcaagcgagggatcctaactctcaaataccccattgaacacggcatcatcaccaactgggatgacatggagaagcctcttgcaggaatcttctatcagccaaatatagccagaagccagaaagcaatgaacacttgagtgatacaatgtgccttgcatcactcagtgcacaaaggcaggggagagactgtaggagagtgaagaggagggaaggtcaaatggaaataatgaacacatagaaaatactggttccaggtctgagtcctacctggggccctgttgagaaggagtataccctttaaatgtcaatcagaaatttccagggctgaccattctcctctccagatccatcccatcctgtgtaacatggtgccacactctcccagcatgggaatgtcaatgagaattttccagccattgggagtctgccaggctcatatggcttttgtctccactagatctggcaccactccttctacaatgagctgcgtgtagcacctgaagagcaccccaccctgctcacagaggctcccctaaatcccaaggccaacagggaaaagatgacccagatcatgtttgaaaccttcaatgtccctgccatgtacgtcgccattcaagctgtgctctccctctatgcctctggccgcacgacaggcatcgtcctggattcaggtgatggcgtcacccacaatgtccccatctatgaaggctatgccctgccccatgccatcatgcgcctggacttggctggccgtgacctcacggactacctcatgaagatcctcacagagagaggctattcctttgtgaccacagctgagagagaaattgtgcgagacatcaaggagaagctgtgctatgtggccctggattttgagaatgagatggccacagcagcttcctcttcctccctggagaagagctatgagctgccagatgggcaggttatcaccattggcaatgagcgcttccgctgccctgagaccctcttccagccttcctttattggcatggagtccgctggaattcatgagacaacctacaattccatcatgaagtgtgacattgacatccgtaaggacttatatgccaacaatgtcctctctgggggcaccaccatgtaccctggcattgctgacaggatgcagaaggagatcacagccctggcccccagcaccatgaagatcaagattattgctcccccagagcggaagtactcagtctggatcgggggctctatcctggcctctctctccaccttccagcagatgtggatcagcaagcctgagtatgatgaggcagggccctccattgtccacaggaagtgcttctaaagtcagaacaggttctccaaggatcccctcgagactactctgttaccagtcatgaaacattaaaacctacaagccttacttctctgtgtggggctctttt

SEQ ID NO: 103968 - DNA, 3779 bp, Homo sapiens
  Payload ID: 440
  Gene Symbol: ACTN1
  Gene Name: actinin, alpha 1
  Uniprot ID: P12814
  ENST ID: ENST00000193403
  CDS Start-End: 385-3063
aggaattcccaatgagaggcgatggggggaagtttgggcaactcggcctggccaatggagagcctcgggagggctctgccccttccccccgcccccgcccgcctcggctcccgcagcgctagtgtgtccgcctagttcagtgtgcgtggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggatcactccggcacactgggtcccgaggagttcaaagcctgcctcatcagcttgggttatgatattggcaacgacccccagggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaaaaaaagaggaaagattaactatttgcaccgaaatgtcttgttttgttgcgacataggaaaataaccaagcacaaagttatattccatcctttttactgatttttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattttatgatattaaagaaaatcttttgaaatggctgttttttaaggaagagaatttatgtggcttctcatttttaaatcccctcagaggtgtgactagtctctttatcagcacacacttaaaaaatttttaatattgtctattaaaaataggacaaacttggagagtatggacaactttgatattgcttggcacagatggtattaaa

SEQ ID NO: 103969 - DNA, 2824 bp, Homo sapiens
  Payload ID: 440
  Gene Symbol: ACTN1
  Gene Name: actinin, alpha 1
  ENST ID: ENST00000376839
  CDS Start-End: 280-2748
aaaacacacacaatgggcttcctcaaagcaggatgacctgggccgcggtgcccaaggcctatgcagggctgggccctatacagcgacatcggtcatctacatcggacatgggaaggtcccctgacttcgaactgacttctttgtaatgtgccagttgcttaaactccccctcttcctgtcatcttcctaacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccggaagaagacaggcatgatggacacggatgatttccgcgcctgcctgatctccatgggttacaacatgggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctg

SEQ ID NO: 103970 - DNA, 3464 bp, Homo sapiens
  Payload ID: 440
  Gene Symbol: ACTN1
  Gene Name: actinin, alpha 1
  Uniprot ID: P12814
  ENST ID: ENST00000394419
  CDS Start-End: 184-2928
cgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggatcactccggcacactgggtcccgaggagttcaaagcctgcctcatcagcttgggttatgatattggcaacgacccccagaagaagacaggcatgatggacacggatgatttccgcgcctgcctgatctccatgggttacaacatgggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaaaaaaagaggaaagattaactatttgcaccgaaatgtcttgttttgttgcgacataggaaaataaccaagcacaaagttatattccatcctttttactgatttttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattttatgatattaaagaaaatcttttg

SEQ ID NO: 103971 - DNA, 3043 bp, Homo sapiens
  Payload ID: 440
  Gene Symbol: ACTN1
  Gene Name: actinin, alpha 1
  Uniprot ID: P12814
  ENST ID: ENST00000438964
  CDS Start-End: 207-2870
aggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccggaagaagacaggcatgatggacacggatgatttccgcgcctgcctgatctccatgggttacaacatgggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattatttt

SEQ ID NO: 103972 - DNA, 2813 bp, Homo sapiens
  Payload ID: 440
  Gene Symbol: ACTN1
  Gene Name: actinin, alpha 1
  Uniprot ID: P12814
  ENST ID: ENST00000538545
  CDS Start-End: 21-2813
cctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccggaagaagacaggcatgatggacacggatgatttccgcgcctgcctgatctccatgggttacaacatgggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagttacaggagggaggcaaaatgcaaacggcacatgctgccttcacgccgccaggctttgcggctgtgtcgggccgcgccgctttacggctgctggactttgcggccttcctgaccactctctcctcgcagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaa

SEQ ID NO: 103973 - DNA, 891 bp, Homo sapiens
  Payload ID: 440
  Gene Symbol: ACTN1
  Gene Name: actinin, alpha 1
  ENST ID: ENST00000544964
  CDS Start-End: 1-891
gacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggatcactccggcacactgggtccc

SEQ ID NO: 103974 - DNA, 530 bp, Homo sapiens
  Payload ID: 440
  Gene Symbol: ACTN1
  Gene Name: actinin, alpha 1
  ENST ID: ENST00000553779
  CDS Start-End: 276-530
gctttggagccagcagcactggtgtggaggcaagctctgctgtctgacttgctgtgtccttgagctggtccttattctgagcctcagtttcttcctctgtaaaaagacaatctgtcttgcagagttgttgccgagactaaatgagatgatggatgtaaaccacccaagctggcatcccatacctgacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctg

SEQ ID NO: 103975 - DNA, 619 bp, Homo sapiens
  Payload ID: 440
  Gene Symbol: ACTN1
  Gene Name: actinin, alpha 1
  ENST ID: ENST00000553290
  CDS Start-End: 1-619
cgagaaactgctggagaccattgaccagctgtacttggagtatgccaagcgggctgcacccttcaacaactggatggagggggccatggaggacctgcaggacaccttcattgtgcacaccattgaggagatccaggtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggatcactccggcacactgggt

SEQ ID NO: 103976 - DNA, 1259 bp, Homo sapiens
  Payload ID: 440
  Gene Symbol: ACTN1
  Gene Name: actinin, alpha 1
  ENST ID: ENST00000556433
  CDS Start-End: 478-1259
ggagcgcggggaggtggcgccgctggcgggcaggtctccttgggggtccgtggtccaggccaccctgcggctgttgcaaccatccccgcgtgggctgtgctcgggggcggtggtcttcaggctggggctgagaccccggctcggggctgcttgctccggatcgattttcccttttcttccgcccctggccacctctccatatggcgtgcggtggcagcgccgcttcctgggccgccctgggttcaacctgagcggcgggcctcccgggaccctgctgccccttaggcggaggggagagcgccggagagatcggcggccgcctccggatctgcctggagaaggaccagctggagtgcggctggggacgagaaaactggggggcgtacgcgggctcccccgcgggccctgtgggggcggggtcaggacagcagaccgttttattgcttaactcagtgggttggaagctgtaaccccgacatgggcttgcgctacgtcctgcccctccgacccccgggaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagct

SEQ ID NO: 103977 - DNA, 919 bp, Homo sapiens
  Payload ID: 440
  Gene Symbol: ACTN1
  Gene Name: actinin, alpha 1
  ENST ID: ENST00000555616
  CDS Start-End: 204-919
aactcagtgggttggaagctgtaaccccgacatgggcttgcgctacgtcctgcccctccgacccccgggaaaggtgggcagctcggttcgagttgaggggctgcagaacgaggacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaa

SEQ ID NO: 103978 - DNA, 605 bp, Homo sapiens
  Payload ID: 440
  Gene Symbol: ACTN1
  Gene Name: actinin, alpha 1
  ENST ID: ENST00000553370
  CDS Start-End: 172-605
aaaggcatcctgtattagctcactcaggaatcctaggccctgaaacggagcccttttactcacttcatcagacaggcagagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttga

SEQ ID NO: 103979 - DNA, 434 bp, Homo sapiens
  Payload ID: 440
  Gene Symbol: ACTN1
  Gene Name: actinin, alpha 1
  ENST ID: ENST00000553659
  CDS Start-End: 219-434
gtaaccccgacatgggcttgcgctacgtcctgcccctccgacccccgggaaaggtgggcagctcggttcgagttgaggggctgcagaacgagggtcagtcttaggggatatttggggccagtcactggggatccctacttagccacggagctgcatcccaggcaggcgcggtgtgccgggtgcgcgccccgccacgggagctgggctcggagctggcgatgggacccgggcacagtggccagtggcaggaagaggtcagaaaccactcgtggtggtggggggagggcgcctcaaccctaccgctgcttcctgcctgcgcgacattcacggcatggtgtaactcccacctccggaaggcggggacacagatcgagaacatcgaagaggacttccgggatggcctgaagctcatgctgctgctggaggtcatctca

SEQ ID NO: 103980 - DNA, 828 bp, Homo sapiens
  Payload ID: 440
  Gene Symbol: ACTN1
  Gene Name: actinin, alpha 1
  ENST ID: ENST00000555075
  CDS Start-End: 1-755
accaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccggggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgc

SEQ ID NO: 103981 - DNA, 568 bp, Homo sapiens
  Payload ID: 440
  Gene Symbol: ACTN1
  Gene Name: actinin, alpha 1
  ENST ID: ENST00000556571
  CDS Start-End: 190-568
ctgcccctccgacccccgggaaaggtgggcagctcggttcgagttgaggggctgcagaacgagggtcagtcttaggggatatttggggccagtcactggggatccctacttagccacggagctgcatcccaggcaggcgcggtgtgccgggtgcgcgccccgccacgggagctgggctcggagctggcgatgggacccgggcacagtggccagtggcaggaagagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggc

SEQ ID NO: 103982 - DNA, 4863 bp, Homo sapiens
  Payload ID: 441
  Gene Symbol: ACTN2
  Gene Name: actinin, alpha 2
  Uniprot ID: P35609
  ENST ID: ENST00000366578
  CDS Start-End: 167-2851
gcttcgcccgagacccagcgcccaggcgtgtcgccccgagaggagccgcgcgaaggtcaccccgcgcccgccgcccgccgcccgccgcctccgtgggtccgtttgccagtcagcccgtgcgtccgagcccctcgcgccccgccgcagccccggccaaccgagcgccatgaaccagatagagcccggcgtgcagtacaactacgtgtacgacgaggatgagtacatgatccaggaggaggagtgggaccgcgacctgctcctggacccagcctgggagaagcagcagaggaagaccttcactgcctggtgtaactcccacctaaggaaagccggcacccagattgagaacatcgaggaagacttcaggaatggccttaagctcatgctgcttttggaagtcatctcaggggaaaggctgcccaaacctgaccggggaaaaatgcggttccacaaaattgctaatgtcaacaaagctttggattacatagccagcaaaggggtgaaactggtgtccattggcgctgaagaaattgttgatggcaacgtgaaaatgaccctgggtatgatctggaccatcatccttcgctttgctattcaggatatttcggttgaagaaacatctgccaaagaaggtctgctgctttggtgtcagaggaaaactgctccttatagaaatgtgaacattcagaacttccatactagctggaaagatggccttggactctgtgccctcatccaccgacaccggcctgacctcattgactactcaaagcttaacaaggatgaccccataggaaatattaacctggccatggaaatcgctgagaagcacctggatattcctaaaatgttggatgctgaagacatcgtgaacacccctaaacccgatgaaagagccatcatgacgtacgtctcttgcttctaccacgcttttgcgggcgcggagcaggccgagacagcggctaacaggatatgtaaggttcttgctgtgaatcaagagaatgagaggctgatggaagaatatgagaggctagcgagtgagcttttggaatggattcgtcgcacgatcccctggctggagaaccggactcccgagaagaccatgcaagccatgcagaagaagctggaggacttccgggattaccgccggaagcacaagccacccaaggtgcaggagaaatgccagctggagatcaacttcaacacgctgcagaccaagctgcggatcagcaaccgtcctgccttcatgccctccgagggcaagatggtgtcggatattgctggtgcctggcagaggctggagcaggctgagaagggttacgaggagtggttgctcaatgagattcggagactggagcgcttggaacacctggctgagaagttcaggcagaaggcctcaacgcacgagacttgggcttatggcaaagagcagatcttgctgcagaaggattacgagtcggcgtcgctgacagaggtgcgggctctgctgcggaagcacgaggcgttcgagagcgacctggcagcgcaccaggaccgcgtggagcagatcgcagccatcgcgcaggagctcaatgaactggactatcacgacgctgtgaatgtcaatgatcggtgccagaaaatttgtgaccagtgggaccgactgggaacgcttactcagaagaggagagaagccctagagagaatggagaaattgctagaaaccattgatcagcttcacctggagtttgccaagagggctgctcctttcaacaattggatggagggcgctatggaggatctgcaagatatgttcattgtccacagcattgaggagatccagagtctgatcactgcgcatgagcagttcaaggccacgctgcccgaggcggacggagagcggcagtccatcatggccatccagaacgaggtggagaaggtgattcagagctacaacatcagaatcagctcaagcaacccgtacagcactgtcaccatggatgagctccggaccaagtgggacaaggtgaagcaactcgtgcccatccgcgatcaatccctgcaggaggagctggctcgccagcatgctaacgagcgtctgaggcgccagtttgctgcccaagccaatgccattgggccctggatccagaacaagatggaggagattgcccggagctccatccagatcacaggagccctggaagaccagatgaaccagctgaagcagtatgagcacaacatcatcaactataagaacaacatcgacaagctggagggagaccatcagctcatccaggaggcccttgtctttgacaacaagcacacgaactacacgatggagcacattcgtgttggatgggagctgctgctgacaaccatcgccagaaccatcaatgaggtggagactcagatcctgacgagagatgcgaagggcatcacccaggagcagatgaatgagttcagagcctccttcaaccactttgacaggaggaagaatggcctgatggatcatgaggatttcagagcctgcctgatttccatgggttatgacctgggtgaagccgaatttgcccgcattatgaccctggtagatcccaacgggcaaggcaccgtcaccttccaatccttcatcgacttcatgactagagagacggctgacaccgacactgccgagcaggtcatcgcctccttccggatcctggcttctgataagccatacatcctggcggaggagctgcgtcgggagctgcccccggatcaggcccagtactgcatcaagaggatgcccgcctactcgggcccaggcagtgtgcctggtgcactggattacgctgcgttctcttccgcactctacggggagagcgatctgtgatgctgagcttctgtaatcactcatcccatcagaatgcaataaaagcggaagtcacagtttgtttcctggaaactttgacaagctttattaagttgagagagagagaggggaaaaaaaaaagcctttcgtagttcagtaattgccagcaatataacacggctaaaatgaagtttttacagtatatgacatagtgcgcttcataaataggtttatttctgagtttttagcaaaatgtaatgaaatatcaggttgatttctttgattaaacagaacaaattacttgagtaataggaaattaggaggatctagggacagaaggaaagtgaaaaatgtgaaaatacaaaatacccaagatttaagaccggggggaaaaaaccacaaattggtaaataaaggtttgctatttgtaaaaaatttcatttatctctaatatgcttatgtgattgcccctaggggagtatatttgggattctaatgttttattttcatgcttatccaaagattactattgtatcttcaaatgaatttaatattgtgagatggaactgccggggattaaaaagactacccaaaagatttttggcacttacaatttttaaaatagtttatgtcatctcttcattatttagggctggatggtcaactcagtcagtgattttttgatgcttctcttatcctccagaatagagacctaaggacacgtggaagtcagtttaattgccagagagaaggatgcaatcactaggtaaaatgaggtttttaggattatttattgattccaggttcccatgctttttgttagagcttattagtacaggttctcaagagatgaccacataaaagtgctctgtttataaataagcaggtttctgtagtactgactggttcatcacaaggcaagtcagaaaccagtatccttctagctctccagtcaggacttccttatgcctctagttttatgaccggttaaggagaagccagagttagagtaggagaggactaattctcagcagcagtggaggtgagttctttcttttgcggaagctttacatatgttttgtgtagtaggaataactagatattttagctagtgtgcggtgtgtgttcacccctgggattggacagtgtatcctaacaagtcccatgtctggttctgtgtctaaaggcctgctccatgacacaggatgctacatgcactcctgctagcacatcttgatctgttgaatgttcattctttctttttgctcatactgctgtaggctataattcccccctgtttttccatcttgttgacagcttgtagagaataaagcaggaattctttttatatctgagtccttaatgatcaggaaatggattacaaacaaacaaaaacagttgcaaacagcaattaaagcattactagagaagcagtaacatgtctgttacctacagtctgtttgctcagatttttatagatttccaccaacagctggaaatgtaatatttccattccaagctgtctgacagcttgactcttcttcctacactgggccatttagaaccttcaacctttatgaatttcacttaatttgcttcattattaagtaattggtagtttccagattcctgaaatatttgaatccttgagtttaatgccaaacacttttggggtggtttagatgaactctgactctattttatttcaagtaggtgctatatcccggccataaacccctatagaaaagccagaaagttgtgcttcctttgaggctattagggggctctgtggtgttttaggatgggtgtgggtaactcatctacctaaacttttaatttctttacaacattcagcaagagagggggtcagtagtctctatctgctaataaatgaagaaaggaagtaaactctgaaaaataataaacatgtttatactctcattttaggtattatttttatttctgaagctggatgctcaaaaattaaaacgtttataagtttctaaattaaacttaatttataaaagaaaaaa

SEQ ID NO: 103983 - DNA, 5103 bp, Homo sapiens
  Payload ID: 441
  Gene Symbol: ACTN2
  Gene Name: actinin, alpha 2
  ENST ID: ENST00000546208
  CDS Start-End: 1042-3102
gacgggcggcgcggctattaagccgcgcggcagctgctcgcagccggagctggtgcttcgcccgagacccagcgcccaggcgtgtcgccccgagaggagccgcgcgaaggtcaccccgcgcccgccgcccgccgcccgccgcctccgtgggtccgtttgccagtcagcccgtgcgtccgagcccctcgcgccccgccgcagccccggccaaccgagcgccatgaaccagatagagcccggcgtgcagtacaactacgtgtacgacgaggatgagtacatgatccaggaggaggagtgggaccgcgacctgctcctggacccagcctgggagaagcagcagaggaagaccttcactgcctggtgtaactcccacctaaggaaagccggcacccagattgagaacatcgaggaagacttcaggaatggccttaagctcatgctgcttttggaagtcatctcaggggaaaggctgcccaaacctgaccggggaaaaatgcggttccacaaaattgctaatgtcaacaaagctttggattacatagccagcaaaggggtgaaactggtgtccattggcgctgaagaaattgttgatggcaacgtgaaaatgaccctgggtatgatctggaccatcatccttcgctttgctattcaggatatttcggttgaagaaacatctgccaaagaaggtctgctgctttggtgtcagaggaaaactgctccttatagaaatgtgaacattcagaacttccatactagctggaaagatggccttggactctgtgccctcatccaccgacaccggcctgacctcattgactactcaaagcttaacaaggatgaccccataggaaatattaacctggccatggaaatcgctgagaagcacctggatattcctaaaatgttggatgctgaagatttagtatacactgccagacccgatgaaagagccataatgacttatgtttcctgttactatcatgcttttgctggtgcacagaagacatcgtgaacacccctaaacccgatgaaagagccatcatgacgtacgtctcttgcttctaccacgcttttgcgggcgcggagcaggttagacaaagtcttaaagcacactcagctctgtggaaggatccccctccagaaagttctacatgttcatatcaggagatgaggaggtcttcagtgaattcaagtgcaatggccgagacagcggctaacaggatatgtaaggttcttgctgtgaatcaagagaatgagaggctgatggaagaatatgagaggctagcgagtgagcttttggaatggattcgtcgcacgatcccctggctggagaaccggactcccgagaagaccatgcaagccatgcagaagaagctggaggacttccgggattaccgccggaagcacaagccacccaaggtgcaggagaaatgccagctggagatcaacttcaacacgctgcagaccaagctgcggatcagcaaccgtcctgccttcatgccctccgagggcaagatggtgtcggatattgctggtgcctggcagaggctggagcaggctgagaagggttacgaggagtggttgctcaatgagattcggagactggagcgcttggaacacctggctgagaagttcaggcagaaggcctcaacgcacgagacttgggcttatggcaaagagcagatcttgctgcagaaggattacgagtcggcgtcgctgacagaggtgcgggctctgctgcggaagcacgaggcgttcgagagcgacctggcagcgcaccaggaccgcgtggagcagatcgcagccatcgcgcaggagctcaatgaactggactatcacgacgctgtgaatgtcaatgatcggtgccagaaaatttgtgaccagtgggaccgactgggaacgcttactcagaagaggagagaagccctagagagaatggagaaattgctagaaaccattgatcagcttcacctggagtttgccaagagggctgctcctttcaacaattggatggagggcgctatggaggatctgcaagatatgttcattgtccacagcattgaggagatccagagtctgatcactgcgcatgagcagttcaaggccacgctgcccgaggcggacggagagcggcagtccatcatggccatccagaacgaggtggagaaggtgattcagagctacaacatcagaatcagctcaagcaacccgtacagcactgtcaccatggatgagctccggaccaagtgggacaaggtgaagcaactcgtgcccatccgcgatcaatccctgcaggaggagctggctcgccagcatgctaacgagcgtctgaggcgccagtttgctgcccaagccaatgccattgggccctggatccagaacaagatggaggagattgcccggagctccatccagatcacaggagccctggaagaccagatgaaccagctgaagcagtatgagcacaacatcatcaactataagaacaacatcgacaagctggagggagaccatcagctcatccaggaggcccttgtctttgacaacaagcacacgaactacacgatggagcacattcgtgttggatgggagctgctgctgacaaccatcgccagaaccatcaatgaggtggagactcagatcctgacgagagatgcgaagggcatcacccaggagcagatgaatgagttcagagcctccttcaaccactttgacaggaggaagaatggcctgatggatcatgaggatttcagagcctgcctgatttccatgggttatgacctgggtgaagccgaatttgcccgcattatgaccctggtagatcccaacgggcaaggcaccgtcaccttccaatccttcatcgacttcatgactagagagacggctgacaccgacactgccgagcaggtcatcgcctccttccggatcctggcttctgataagccatacatcctggcggaggagctgcgtcgggagctgcccccggatcaggcccagtactgcatcaagaggatgcccgcctactcgggcccaggcagtgtgcctggtgcactggattacgctgcgttctcttccgcactctacggggagagcgatctgtgatgctgagcttctgtaatcactcatcccatcagaatgcaataaaagcggaagtcacagtttgtttcctggaaactttgacaagctttattaagttgagagagagagaggggaaaaaaaaaagcctttcgtagttcagtaattgccagcaatataacacggctaaaatgaagtttttacagtatatgacatagtgcgcttcataaataggtttatttctgagtttttagcaaaatgtaatgaaatatcaggttgatttctttgattaaacagaacaaattacttgagtaataggaaattaggaggatctagggacagaaggaaagtgaaaaatgtgaaaatacaaaatacccaagatttaagaccggggggaaaaaaccacaaattggtaaataaaggtttgctatttgtaaaaaatttcatttatctctaatatgcttatgtgattgcccctaggggagtatatttgggattctaatgttttattttcatgcttatccaaagattactattgtatcttcaaatgaatttaatattgtgagatggaactgccggggattaaaaagactacccaaaagatttttggcacttacaatttttaaaatagtttatgtcatctcttcattatttagggctggatggtcaactcagtcagtgattttttgatgcttctcttatcctccagaatagagacctaaggacacgtggaagtcagtttaattgccagagagaaggatgcaatcactaggtaaaatgaggtttttaggattatttattgattccaggttcccatgctttttgttagagcttattagtacaggttctcaagagatgaccacataaaagtgctctgtttataaataagcaggtttctgtagtactgactggttcatcacaaggcaagtcagaaaccagtatccttctagctctccagtcaggacttccttatgcctctagttttatgaccggttaaggagaagccagagttagagtaggagaggactaattctcagcagcagtggaggtgagttctttcttttgcggaagctttacatatgttttgtgtagtaggaataactagatattttagctagtgtgcggtgtgtgttcacccctgggattggacagtgtatcctaacaagtcccatgtctggttctgtgtctaaaggcctgctccatgacacaggatgctacatgcactcctgctagcacatcttgatctgttgaatgttcattctttctttttgctcatactgctgtaggctataattcccccctgtttttccatcttgttgacagcttgtagagaataaagcaggaattctttttatatctgagtccttaatgatcaggaaatggattacaaacaaacaaaaacagttgcaaacagcaattaaagcattactagagaagcagtaacatgtctgttacctacagtctgtttgctcagatttttatagatttccaccaacagctggaaatgtaatatttccattccaagctgtctgacagcttgactcttcttcctacactgggccatttagaaccttcaacctttatgaatttcacttaatttgcttcattattaagtaattggtagtttccagattcctgaaatatttgaatccttgagtttaatgccaaacacttttggggtggtttagatgaactctgactctattttatttcaagtaggtgctatatcccggccataaacccctatagaaaagccagaaagttgtgcttcctttgaggctattagggggctctgtggtgttttaggatgggtgtgggtaactcatctacctaaacttttaatttctttacaacattcagcaagagagggggtcagtagtctctatctgctaataaatgaagaaaggaagtaaactctgaaaaataataaacatgtttatactctcattttaggtattatttttatttctgaagctggatgctcaaaaattaaaacgtttataagtttctaaattaaacttaatttat

SEQ ID NO: 103984 - DNA, 4906 bp, Homo sapiens
  Payload ID: 441
  Gene Symbol: ACTN2
  Gene Name: actinin, alpha 2
  Uniprot ID: P35609
  ENST ID: ENST00000542672
  CDS Start-End: 221-2905
gacgggcggcgcggctattaagccgcgcggcagctgctcgcagccggagctggtgcttcgcccgagacccagcgcccaggcgtgtcgccccgagaggagccgcgcgaaggtcaccccgcgcccgccgcccgccgcccgccgcctccgtgggtccgtttgccagtcagcccgtgcgtccgagcccctcgcgccccgccgcagccccggccaaccgagcgccatgaaccagatagagcccggcgtgcagtacaactacgtgtacgacgaggatgagtacatgatccaggaggaggagtgggaccgcgacctgctcctggacccagcctgggagaagcagcagaggaagaccttcactgcctggtgtaactcccacctaaggaaagccggcacccagattgagaacatcgaggaagacttcaggaatggccttaagctcatgctgcttttggaagtcatctcaggggaaaggctgcccaaacctgaccggggaaaaatgcggttccacaaaattgctaatgtcaacaaagctttggattacatagccagcaaaggggtgaaactggtgtccattggcgctgaagaaattgttgatggcaacgtgaaaatgaccctgggtatgatctggaccatcatccttcgctttgctattcaggatatttcggttgaagaaacatctgccaaagaaggtctgctgctttggtgtcagaggaaaactgctccttatagaaatgtgaacattcagaacttccatactagctggaaagatggccttggactctgtgccctcatccaccgacaccggcctgacctcattgactactcaaagcttaacaaggatgaccccataggaaatattaacctggccatggaaatcgctgagaagcacctggatattcctaaaatgttggatgctgaagatttagtatacactgccagacccgatgaaagagccataatgacttatgtttcctgttactatcatgcttttgctggtgcacagaaggccgagacagcggctaacaggatatgtaaggttcttgctgtgaatcaagagaatgagaggctgatggaagaatatgagaggctagcgagtgagcttttggaatggattcgtcgcacgatcccctggctggagaaccggactcccgagaagaccatgcaagccatgcagaagaagctggaggacttccgggattaccgccggaagcacaagccacccaaggtgcaggagaaatgccagctggagatcaacttcaacacgctgcagaccaagctgcggatcagcaaccgtcctgccttcatgccctccgagggcaagatggtgtcggatattgctggtgcctggcagaggctggagcaggctgagaagggttacgaggagtggttgctcaatgagattcggagactggagcgcttggaacacctggctgagaagttcaggcagaaggcctcaacgcacgagacttgggcttatggcaaagagcagatcttgctgcagaaggattacgagtcggcgtcgctgacagaggtgcgggctctgctgcggaagcacgaggcgttcgagagcgacctggcagcgcaccaggaccgcgtggagcagatcgcagccatcgcgcaggagctcaatgaactggactatcacgacgctgtgaatgtcaatgatcggtgccagaaaatttgtgaccagtgggaccgactgggaacgcttactcagaagaggagagaagccctagagagaatggagaaattgctagaaaccattgatcagcttcacctggagtttgccaagagggctgctcctttcaacaattggatggagggcgctatggaggatctgcaagatatgttcattgtccacagcattgaggagatccagagtctgatcactgcgcatgagcagttcaaggccacgctgcccgaggcggacggagagcggcagtccatcatggccatccagaacgaggtggagaaggtgattcagagctacaacatcagaatcagctcaagcaacccgtacagcactgtcaccatggatgagctccggaccaagtgggacaaggtgaagcaactcgtgcccatccgcgatcaatccctgcaggaggagctggctcgccagcatgctaacgagcgtctgaggcgccagtttgctgcccaagccaatgccattgggccctggatccagaacaagatggaggagattgcccggagctccatccagatcacaggagccctggaagaccagatgaaccagctgaagcagtatgagcacaacatcatcaactataagaacaacatcgacaagctggagggagaccatcagctcatccaggaggcccttgtctttgacaacaagcacacgaactacacgatggagcacattcgtgttggatgggagctgctgctgacaaccatcgccagaaccatcaatgaggtggagactcagatcctgacgagagatgcgaagggcatcacccaggagcagatgaatgagttcagagcctccttcaaccactttgacaggaggaagaatggcctgatggatcatgaggatttcagagcctgcctgatttccatgggttatgacctgggtgaagccgaatttgcccgcattatgaccctggtagatcccaacgggcaaggcaccgtcaccttccaatccttcatcgacttcatgactagagagacggctgacaccgacactgccgagcaggtcatcgcctccttccggatcctggcttctgataagccatacatcctggcggaggagctgcgtcgggagctgcccccggatcaggcccagtactgcatcaagaggatgcccgcctactcgggcccaggcagtgtgcctggtgcactggattacgctgcgttctcttccgcactctacggggagagcgatctgtgatgctgagcttctgtaatcactcatcccatcagaatgcaataaaagcggaagtcacagtttgtttcctggaaactttgacaagctttattaagttgagagagagagaggggaaaaaaaaaagcctttcgtagttcagtaattgccagcaatataacacggctaaaatgaagtttttacagtatatgacatagtgcgcttcataaataggtttatttctgagtttttagcaaaatgtaatgaaatatcaggttgatttctttgattaaacagaacaaattacttgagtaataggaaattaggaggatctagggacagaaggaaagtgaaaaatgtgaaaatacaaaatacccaagatttaagaccggggggaaaaaaccacaaattggtaaataaaggtttgctatttgtaaaaaatttcatttatctctaatatgcttatgtgattgcccctaggggagtatatttgggattctaatgttttattttcatgcttatccaaagattactattgtatcttcaaatgaatttaatattgtgagatggaactgccggggattaaaaagactacccaaaagatttttggcacttacaatttttaaaatagtttatgtcatctcttcattatttagggctggatggtcaactcagtcagtgattttttgatgcttctcttatcctccagaatagagacctaaggacacgtggaagtcagtttaattgccagagagaaggatgcaatcactaggtaaaatgaggtttttaggattatttattgattccaggttcccatgctttttgttagagcttattagtacaggttctcaagagatgaccacataaaagtgctctgtttataaataagcaggtttctgtagtactgactggttcatcacaaggcaagtcagaaaccagtatccttctagctctccagtcaggacttccttatgcctctagttttatgaccggttaaggagaagccagagttagagtaggagaggactaattctcagcagcagtggaggtgagttctttcttttgcggaagctttacatatgttttgtgtagtaggaataactagatattttagctagtgtgcggtgtgtgttcacccctgggattggacagtgtatcctaacaagtcccatgtctggttctgtgtctaaaggcctgctccatgacacaggatgctacatgcactcctgctagcacatcttgatctgttgaatgttcattctttctttttgctcatactgctgtaggctataattcccccctgtttttccatcttgttgacagcttgtagagaataaagcaggaattctttttatatctgagtccttaatgatcaggaaatggattacaaacaaacaaaaacagttgcaaacagcaattaaagcattactagagaagcagtaacatgtctgttacctacagtctgtttgctcagatttttatagatttccaccaacagctggaaatgtaatatttccattccaagctgtctgacagcttgactcttcttcctacactgggccatttagaaccttcaacctttatgaatttcacttaatttgcttcattattaagtaattggtagtttccagattcctgaaatatttgaatccttgagtttaatgccaaacacttttggggtggtttagatgaactctgactctattttatttcaagtaggtgctatatcccggccataaacccctatagaaaagccagaaagttgtgcttcctttgaggctattagggggctctgtggtgttttaggatgggtgtgggtaactcatctacctaaacttttaatttctttacaacattcagcaagagagggggtcagtagtctctatctgctaataaatgaagaaaggaagtaaactctgaaaaataataaacatgtttatactctcattttaggtattatttttatttctgaagctggatgctcaaaaattaaaacgtttataagtttctaaattaaacttaatttat

SEQ ID NO: 103985 - DNA, 3084 bp, Homo sapiens
  Payload ID: 442
  Gene Symbol: ACTN3
  Gene Name: actinin, alpha 3 (gene/pseudogene)
  ENST ID: ENST00000502692
  CDS Start-End: 117-2951
aatagccctgccgcagcccatccagctggctcagagccgttccccatgcccgggtgtctccatcaccccagaaaacatgcaaaacagctcggcgcctctgtgttcctgactgtgaaatggggatagggctctgtgtcccaccagcgaggtgctggaagaggctcacgaggagctccagagggcagcctctagagcggcccgcggccactattattatcggcctttctattgtggagaggagtaaacagactcagagaggtcccgtggatttctcaaggtcacacagcgccccagcagcggagcaggaatgcaaacccaggatctccgccgcgagatccaccccggcgcccccgagtcccgcagttcccggcttcaggacaaccccttgccagaccttcactgcctggtgcaactcacacctgcgcaaggcaggcacccagatcgagaacatcgaggaagatttccgcaatggcctcaaactcatgctgctcctggaggtcatttcaggtgagaggctgcctaggccagataaaggcaagatgcgcttccacaaaatcgccaacgttaacaaggccctggacttcattgccagcaagggggttaaactggtgtccattggtgctgaagagattgttgacgggaacctgaagatgaccctgggcatgatctggaccatcatccttcgcttcgccatccaggacatctctgtggaagaaacctcagccaaggaaggcttgcttctgtggtgccagaggaagacagcaccgtaccgcaacgtcaacgtgcagaacttccacaccagctggaaggatggcctggccctctgtgccctcatccaccgacaccgccctgacctcatcgactacgccaaactgcgaaaggatgaccccatcggaaacctgaacactgcctttgaggtggcagagaaatacctggacatccccaagatgttggatgcagaagacattgtgaacaccccaaagccggatgagaaggccatcatgacctatgtgtcctgcttctaccatgcctttgccggggctgagcaggcagagacagctgccaacaggatctgcaaggtgctggcagtgaaccaggaaaacgagaagctgatggaggagtatgagaagcttgccagtgagctgctggagtggatccgccgcactgtcccatggctggagaaccgtgtgggtgagcccagcatgagtgccatgcagcgcaaactagaggactttcgggactaccggcgtctgcacaagccgccccgcattcaggaaaagtgccagctggagatcaacttcaacacactgcagaccaagttgcggctcagccaccggcctgccttcatgccctccgagggcaagctggtctcggacatcgccaacgcctggcgggggctggagcaggtggaaaagggctatgaggactggctgctctcggagatccggcgcctgcagcgactccagcacctggctgagaagttccggcagaaggcctccctgcacgaagcctggacccggggaaaggaggagatgctgagccagcgcgactacgattcggctttgctacaggaggtgcgggcgttgctgcggcgccacgaggcctttgagagcgacctggcggcgcaccaggaccgcgtggagcacattgccgcgctggcccaggagctcaatgagctggactaccacgaggcagcctcagtgaatagccgctgccaggccatctgcgatcagtgggacaacctgggcaccctgacccagaagaggcgggatgcgctagagcggatggagaagctcctggagaccattgaccggctgcaactggagtttgcccggcgggccgcgcccttcaacaactggctggatggtgccgtggaggacctgcaggacgtgtggctggtacactctgtggaggagacccagagcctgctgacagcgcacgatcagttcaaggcaacactgcccgaggctgaccgagagcgaggtgccatcatgggcatccagggtgagatccagaagatctgccagacgtatgggctgcggccctgctccaccaatccctacatcaccctcagcccgcaggacatcaacaccaagtgggatatggtccgaaagctggtgcccagctgtgaccagacactgcaggaggagctggcacggcagcaggtaaacgagaggctccggcgacagtttgcggcccaggccaatgccattggaccctggatccaggcgaaggtggaggaagtggggcggctggcagcagggctagctggctctctggaggagcagatggctgggctacggcagcaggagcagaacattatcaactacaagactaacattgaccggctggagggtgaccaccagctgctgcaggagagcctggtgttcgacaataagcacaccgtctacagcatggagcacatccgcgtgggctgggagcagctgctcacctccattgcccgcaccatcaatgaagtggagaaccaggtactgacccgagacgccaagggactgagccaggagcagctcaacgagttccgagcatccttcaaccactttgacaggaagcagaatgggatgatggagcctgatgacttccgagcttgcctcatctccatgggctatgacctgggggaagtggagtttgctcgcatcatgaccatggtggaccccaacgcagctggggtggtgaccttccaggccttcatagacttcatgacccgagagacagccgagactgacacgactgagcaagttgtagcttccttcaagatcttggcaggagacaagaactacatcacccccgaggagctgcggcgcgagctccctgccaagcaggccgagtactgcatccgccgtatggtgccctacaagggatccggggccccggctggagccctggactacgtggccttctccagtgccctctatggggagagcgacctttgaccccaaccactgaggttctctatgcaagatggagagaggatgcaccctgtggctgatcccatccgtccctcggagcaagggcctaagagaaaagccagccaagtgcttctgaataaagatccctctctgggtc

SEQ ID NO: 103986 - DNA, 704 bp, Homo sapiens
  Payload ID: 442
  Gene Symbol: ACTN3
  Gene Name: actinin, alpha 3 (gene/pseudogene)
  ENST ID: ENST00000511191
  CDS Start-End: 24-242
gcgaagccaggagcccgatcgagatgatgatggttatgcagcccgagggtctgggggccggggaggggcgctttgcgggcggcggcgggggcggcgagtacatggaacaggaggaggactgggaccgcgacctgctgctggacccggcctgggagaagcagcagcggaaagaaaacgaaagctcagagagggaaagggactggcccaggatgcacagcaagtcagtggctgagctgagctgagacttgaatccagaaatacaaggctctgagacctaccctgactgaggagacaggactgtgccctacatcccccagagccagtcgtagggtttgagtgctgtcctctgcccctagaccttcactgcctggtgcaactcacacctgcgcaaggcaggcacccagatcgagaacatcgaggaagatttccgcaatggcctcaaactcatgctgctcctggaggtcatttcaggtgagaggctgcctaggccagataaaggcaagatgcgcttccacaaaatcgccaacgttaacaaggccctggacttcattgccagcaagggggttaaactggtgtccattggtgctgaagagattgttgacgggaacctgaagatgaccctgggcatgatctggaccatcatccttcgcttcgccatccaggacatctctgtggaagaaacctcagccaaggaaggcttgctt

SEQ ID NO: 103987 - DNA, 2939 bp, Homo sapiens
  Payload ID: 442
  Gene Symbol: ACTN3
  Gene Name: actinin, alpha 3 (gene/pseudogene)
  Uniprot ID: Q08043
  ENST ID: ENST00000513398
  CDS Start-End: 98-2803
agtgcgaattcgatctggggctgggctgggccctacttaatggggcccgggtgtccgagagcgtgccgagcggagcgaagccaggagcccgatcgagatgatgatggttatgcagcccgagggtctgggggccggggaggggcgctttgcgggcggcggcgggggcggcgagtacatggaacaggaggaggactgggaccgcgacctgctgctggacccggcctgggagaagcagcagcggaaaaccttcactgcctggtgcaactcacacctgcgcaaggcaggcacccagatcgagaacatcgaggaagatttccgcaatggcctcaaactcatgctgctcctggaggtcatttcaggtgagaggctgcctaggccagataaaggcaagatgcgcttccacaaaatcgccaacgttaacaaggccctggacttcattgccagcaagggggttaaactggtgtccattggtgctgaagagattgttgacgggaacctgaagatgaccctgggcatgatctggaccatcatccttcgcttcgccatccaggacatctctgtggaagaaacctcagccaaggaaggcttgcttctgtggtgccagaggaagacagcaccgtaccgcaacgtcaacgtgcagaacttccacaccagctggaaggatggcctggccctctgtgccctcatccaccgacaccgccctgacctcatcgactacgccaaactgcgaaaggatgaccccatcggaaacctgaacactgcctttgaggtggcagagaaatacctggacatccccaagatgttggatgcagaagacattgtgaacaccccaaagccggatgagaaggccatcatgacctatgtgtcctgcttctaccatgcctttgccggggctgagcaggcagagacagctgccaacaggatctgcaaggtgctggcagtgaaccaggaaaacgagaagctgatggaggagtatgagaagcttgccagtgagctgctggagtggatccgccgcactgtcccatggctggagaaccgtgtgggtgagcccagcatgagtgccatgcagcgcaaactagaggactttcgggactaccggcgtctgcacaagccgccccgcattcaggaaaagtgccagctggagatcaacttcaacacactgcagaccaagttgcggctcagccaccggcctgccttcatgccctccgagggcaagctggtctcggacatcgccaacgcctggcgggggctggagcaggtggaaaagggctatgaggactggctgctctcggagatccggcgcctgcagcgactccagcacctggctgagaagttccggcagaaggcctccctgcacgaagcctggacccggggaaaggaggagatgctgagccagcgcgactacgattcggctttgctacaggaggtgcgggcgttgctgcggcgccacgaggcctttgagagcgacctggcggcgcaccaggaccgcgtggagcacattgccgcgctggcccaggagctcaatgagctggactaccacgaggcagcctcagtgaatagccgctgccaggccatctgcgatcagtgggacaacctgggcaccctgacccagaagaggcgggatgcgctagagcggatggagaagctcctggagaccattgaccggctgcaactggagtttgcccggcgggccgcgcccttcaacaactggctggatggtgccgtggaggacctgcaggacgtgtggctggtacactctgtggaggagacccagagcctgctgacagcgcacgatcagttcaaggcaacactgcccgaggctgaccgagagcgaggtgccatcatgggcatccagggtgagatccagaagatctgccagacgtatgggctgcggccctgctccaccaatccctacatcaccctcagcccgcaggacatcaacaccaagtgggatatggtccgaaagctggtgcccagctgtgaccagacactgcaggaggagctggcacggcagcaggtaaacgagaggctccggcgacagtttgcggcccaggccaatgccattggaccctggatccaggcgaaggtggaggaagtggggcggctggcagcagggctagctggctctctggaggagcagatggctgggctacggcagcaggagcagaacattatcaactacaagactaacattgaccggctggagggtgaccaccagctgctgcaggagagcctggtgttcgacaataagcacaccgtctacagcatggagcacatccgcgtgggctgggagcagctgctcacctccattgcccgcaccatcaatgaagtggagaaccaggtactgacccgagacgccaagggactgagccaggagcagctcaacgagttccgagcatccttcaaccactttgacaggaagcagaatgggatgatggagcctgatgacttccgagcttgcctcatctccatgggctatgacctgggggaagtggagtttgctcgcatcatgaccatggtggaccccaacgcagctggggtggtgaccttccaggccttcatagacttcatgacccgagagacagccgagactgacacgactgagcaagttgtagcttccttcaagatcttggcaggagacaagaactacatcacccccgaggagctgcggcgcgagctccctgccaagcaggccgagtactgcatccgccgtatggtgccctacaagggatccggggccccggctggagccctggactacgtggccttctccagtgccctctatggggagagcgacctttgaccccaaccactgaggttctctatgcaagatggagagaggatgcaccctgtggctgatcccatccgtccctcggagcaagggcctaagagaaaagccagccaagtgcttctgaataaagatccctctctgggtctct

SEQ ID NO: 103988 - DNA, 4963 bp, Homo sapiens
  Payload ID: 443
  Gene Symbol: ACTN4
  Gene Name: actinin, alpha 4
  Uniprot ID: O43707
  ENST ID: ENST00000252699
  CDS Start-End: 77-2812
gcggcggcggctcgggcagaggggcgggagctgaggcgggagcggacaggctggtgggcgagcgagaggcggcggaatggtggactaccacgcggcgaaccagtcgtaccagtacggccccagcagcgcgggcaatggcgctggcggcgggggcagcatgggcgactacatggcccaggaggacgactgggaccgggacctgctgctggacccggcctgggagaagcagcagcgcaagaccttcacggcatggtgcaactcccacctgcggaaggcaggcacacagatcgagaacattgatgaggacttccgagacgggctcaagctcatgctgctcctggaggtcatatcaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtgaggccccagagacctgacccaacacccccgacggcctccaggaggggcctgggcagccccacagtcccattcctccactctgtatctatgcaaagcactctctgcagtcctccggggtgggtgggtgggcagggaggggctggggcaggctctctcctctctctctttgtgggttggccaggaggttcccccgaccaggttggggagacttggggccagcgcttctggtctggtaaatatgtatgatgtgttgtgcttttttaaccaaggaggggccagtggattcccacagcacaaccggtcccttccatgccctgggatgcctcaccacacccaggtctcttcctttgctctgaggtcccttcaaggcctccccaatccaggccaaagccccatgtgccttgtccaggaactgcctgggccatgcgaggggccagcagagggcgccaccaccacctgacggctggggacccacccagcccctctcccctctctgctccagactcacttgccattgccaggagatggccccaacaagcaccccgcttttgcagcagaggagctgagttggcagaccgggcccccctgaaccgcaccccatcccaccagccccggccttgctttgtctggcctcacgtgtctcagattttctaagaaccaaaaaaaaaaaaggaaaaaaaacacaaaacaacaaaaaccaaaaaaaaaaaaaatcacaaaaacaaaaaaactataaaaaagaaagaattaaaaactttcagagaattactatttactttattaacttacggatttattatataaatatatattcacctagcaacatatctctgccgtctctcctgctctcataatgaagacatagccgattctctgcccgggccccttgctgatgctcctccgggtctgcgtcgggcgtgggtctctggggaccctccagaggtggaggtgggctgatggcctggctgcctggtggttgatggttttgctccccctaccttttttttttgagtttattctgattgattttttttcttggtttctggataaaccaccctctggggacaggataataaaacatgtaatatttttaagaaggattcctgcagcatcatctttttttatttctcctgtgtctgtcctccaccttctaggagagccagggcagagctagcactgtcttaagctgtcaacgtggactagctcgtgtcatctgctcgagaagggctgtcgctgttcttgtttctgagtgaggagtacgcaggccagagtggtcacccggccgtgagcagtgagggccagagactagccccagacaggtggatgccagagagagtggcacccatgccaggcaaggcctagggaggtggtcttgctcagcaaccctgccctgagcagcaggtgcgcccatccggagatcctaggagaaggtggccacctccatccactaaggaagagaaggaagacagtggcttgaggcagggagctcgcaggacagagcctgagccaccctgtccctcccacctggctcacctgtctgtgggtcaggcagatgaccccctcacccccatccaggtgctggctgcagtggcctgtgcagagaggggcagggtgagtgcccaccagtccccgtaccccttccccccatgccccaccatgccggggtggtactcacagaagatgcaggtgaggtgggccacacaggacacgaaccgctcgaagtccacacgcagacggctatcccggtagcggctggtgagggtctgggtcagctggttgttcaggtggaagcctagggggaggctgcttctgagcccagtggcccacagggaacccaccttggcattgcatccccaccccacctcctcagggaggacatgaatgccacagggtgtcacaccccaactctgccccatcccggcagggtgagtacaggctgatcccttcaatcctctgggcctgtttcctcatccatcaaacggactaagacagccccgaccccatagggtgtgtgaagacagaacgctcaggacagcgtctgacacgtgactcgatgtgtgggtactgttactccttaaatcctgtggggctttctccttgccagtgggcactggaggatatttctgtgcagcaaaaaatatagtcaatccca

SEQ ID NO: 103989 - DNA, 3180 bp, Homo sapiens
  Payload ID: 443
  Gene Symbol: ACTN4
  Gene Name: actinin, alpha 4
  ENST ID: ENST00000440400
  CDS Start-End: 1-1029
ggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaagaagcagacaggcagcatggactccgatgacttcagggctctgcttatctccacaggatacagcctgggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtgaggccccagagacctgacccaacacccccgacggcctccaggaggggcctgggcagccccacagtcccattcctccactctgtatctatgcaaagcactctctgcagtcctccggggtgggtgggtgggcagggaggggctggggcaggctctctcctctctctctttgtgggttggccaggaggttcccccgaccaggttggggagacttggggccagcgcttctggtctggtaaatatgtatgatgtgttgtgcttttttaaccaaggaggggccagtggattcccacagcacaaccggtcccttccatgccctgggatgcctcaccacacccaggtctcttcctttgctctgaggtcccttcaaggcctccccaatccaggccaaagccccatgtgccttgtccaggaactgcctgggccatgcgaggggccagcagagggcgccaccaccacctgacggctggggacccacccagcccctctcccctctctgctccagactcacttgccattgccaggagatggccccaacaagcaccccgcttttgcagcagaggagctgagttggcagaccgggcccccctgaaccgcaccccatcccaccagccccggccttgctttgtctggcctcacgtgtctcagattttctaagaaccaaaaaaaaaaaaggaaaaaaaacacaaaacaacaaaaaccaaaaaaaaaaaaaatcacaaaaacaaaaaaactataaaaaagaaagaattaaaaactttcagagaattactatttactttattaacttacggatttattatataaatatatattcacctagcaacatatctctgccgtctctcctgctctcataatgaagacatagccgattctctgcccgggccccttgctgatgctcctccgggtctgcgtcgggcgtgggtctctggggaccctccagaggtggaggtgggctgatggcctggctgcctggtggttgatggttttgctccccctaccttttttttttgagtttattctgattgattttttttcttggtttctggataaaccaccctctggggacaggataataaaacatgtaatatttttaagaaggattcctgcagcatcatctttttttatttctcctgtgtctgtcctccaccttctaggagagccagggcagagctagcactgtcttaagctgtcaacgtggactagctcgtgtcatctgctcgagaagggctgtcgctgttcttgtttctgagtgaggagtacgcaggccagagtggtcacccggccgtgagcagtgagggccagagactagccccagacaggtggatgccagagagagtggcacccatgccaggcaaggcctagggaggtggtcttgctcagcaaccctgccctgagcagcaggtgcgcccatccggagatcctaggagaaggtggccacctccatccactaaggaagagaaggaagacagtggcttgaggcagggagctcgcaggacagagcctgagccaccctgtccctcccacctggctcacctgtctgtgggtcaggcagatgaccccctcacccccatccaggtgctggctgcagtggcctgtgcagagaggggcagggtgagtgcccaccagtccccgtaccccttccccccatgccccaccatgccggggtggtactcacagaagatgcaggtgaggtgggccacacaggacacgaaccgctcgaagtccacacgcagacggctatcccggtagcggctggtgagggtctgggtcagctggttgttcaggtggaagcctagggggaggctgcttctgagcccagtggcccacagggaacccaccttggcattgcatccccaccccacctcctcagggaggacatgaatgccacagggtgtcacaccccaactctgccccatcccggcagggtgagtacaggctgatcccttcaatcctctgggcctgtttcctcatccatcaaacggactaagacagccccgaccccatagggtgtgtgaagacagaacgctcaggacagcgtctgacacgtgactcgatgtgtgggtactgttactccttaaatcctgtggggctttctccttgccagtgggcactggaggatatttctgtgcagcaaaaaatatagtcaatccca

SEQ ID NO: 103990 - DNA, 1566 bp, Homo sapiens
  Payload ID: 443
  Gene Symbol: ACTN4
  Gene Name: actinin, alpha 4
  ENST ID: ENST00000424234
  CDS Start-End: 1-1566
atggtggactaccacgcggcgaaccagtcgtaccagtacggccccagcagcgcgggcaatggcgctggcggcgggggcagcatgggcgactacatggcccaggaggacgactgggaccgggacctgctgctggacccggcctgggagaagcagcagcgcaagaccttcacggcatggtgcaactcccacctgcggaaggcaggcacacagatcgagaacattgatgaggacttccgagacgggctcaagctcatgctgctcctggaggtcatcgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtga

SEQ ID NO: 103991 - DNA, 2102 bp, Homo sapiens
  Payload ID: 443
  Gene Symbol: ACTN4
  Gene Name: actinin, alpha 4
  Uniprot ID: O43707
  ENST ID: ENST00000390009
  CDS Start-End: 9-2087
gcggcggaatggtggactaccacgcggcgaaccagtcgtaccagtacggccccagcagcgcgggcaatggcgctggcggcgggggcagcatgggcgactacatggcccaggaggacgactgggaccgggacctgctgctggacccggcctgggagaagcagcagcgcaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtgaggccccagagacctg

SEQ ID NO: 103992 - DNA, 546 bp, Homo sapiens
  Payload ID: 443
  Gene Symbol: ACTN4
  Gene Name: actinin, alpha 4
  ENST ID: ENST00000586538
  CDS Start-End: 1-546
gccctgatccaccggcacagaccagagctgattgagtatgacaagctgaggaaggacgaccctgtcaccaacctgaacaatgccttcgaagtggctgagaaatacctcgacatccccaagatgctggatgcagaggatattgtgggcactctgaggccagatgagaaggccatcatgacttacgtgtcctgcttctaccacgctttctcgggggctcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcg

SEQ ID NO: 103993 - DNA, 441 bp, Homo sapiens
  Payload ID: 443
  Gene Symbol: ACTN4
  Gene Name: actinin, alpha 4
  ENST ID: ENST00000589528
  CDS Start-End: 1-317
gcggcggaatggtggactaccacgcggcgaaccagtcgtaccagtacggccccagcagcgcgggcaatggcgctggcggcgggggcagcatgggcgactacatggcccaggaggacgactgggaccgggacctgctgctggacccggcctgggagaagcagcagcgcaagaccttcacggcatggtgcaactcccacctgcggaaggcaggcacacagatcgagaacattgatgaggacttccgagacgggctcaagctcatgctgctcctggaggtcatatcagaggagctgagttggcagaccgggcccccctgaaccgcaccccatcccaccagccccggccttgctttgtctggcctcacgtgtctcagattttctaagaaccaaaaaaaaaaaaggaaaaaaaacacaaaacaacaaaaaccaaaaaaaaaaaaaa

SEQ ID NO: 103994 - DNA, 2102 bp, Homo sapiens; identical to SEQ ID NO: 103991
  Payload ID: 443
  Gene Symbol: ACTN4
  Gene Name: actinin, alpha 4
  ENST ID: ENST00000634692
  CDS Start-End: 9-2087

SEQ ID NO: 103995 - DNA, 441 bp, Homo sapiens; identical to SEQ ID NO: 103993
  Payload ID: 443
  Gene Symbol: ACTN4
  Gene Name: actinin, alpha 4
  ENST ID: ENST00000634682
  CDS Start-End: 1-317

SEQ ID NO: 103996 - DNA, 4963 bp, Homo sapiens; identical to SEQ ID NO: 103988
  Payload ID: 443
  Gene Symbol: ACTN4
  Gene Name: actinin, alpha 4
  ENST ID: ENST00000634960
  CDS Start-End: 77-2812

SEQ ID NO: 103997 - DNA, 3180 bp, Homo sapiens; identical to SEQ ID NO: 103989
  Payload ID: 443
  Gene Symbol: ACTN4
  Gene Name: actinin, alpha 4
  ENST ID: ENST00000635719
  CDS Start-End: 1-1029

SEQ ID NO: 103998 - DNA, 1566 bp, Homo sapiens; identical to SEQ ID NO: 103990
  Payload ID: 443
  Gene Symbol: ACTN4
  Gene Name: actinin, alpha 4
  ENST ID: ENST00000634514
  CDS Start-End: 1-1566

SEQ ID NO: 103999 - DNA, 546 bp, Homo sapiens; identical to SEQ ID NO: 103992
  Payload ID: 443
  Gene Symbol: ACTN4
  Gene Name: actinin, alpha 4
  ENST ID: ENST00000635153
  CDS Start-End: 1-546

SEQ ID NO: 104000 - DNA, 2028 bp, Homo sapiens
  Payload ID: 444
  Gene Symbol: ACTL10
  Gene Name: actin-like 10
  Uniprot ID: Q5JWF8
  ENST ID: ENST00000330271
  CDS Start-End: 1001-1738
caggaacttccgtcaagcccaggtgagaggtgccaggaggctgcctgggtcctcaagggggatatatgtccaaatggccttaccacaaggccccttcgccctcaaagttctgctcctcccgggggcttcttaggatctaaaaggatcagtcctagccatctcgtcagccatctcagcaagggctgacggggcggaacagcaaagcagaggcgggtcctgagagcgtggagcctgaagcccggcgccagagggagaccaagagggtgagatgcggctggaacccagccagagcggagactgaagcctgaactaggggccgggcctcaggcctaggaactagccacgagctgaaaaggaggcggatggcccggacagaagaggcggggctttcagaccagagggcggagccaagagctgaaaagggtggtgatttggtccagaagaggaagaacttaggctccggaggcagagccaaaggctgaaggggactactccctaggacagaggccgggaggtatcgggccgacgaagccgagtggcgcggaggagcggagccttcagccccgcggctgggccgagcccgaaggtggcgtcggtgtcggggagccgccgcgtgcaccggccgtcctccctgggccgcatcgcggtggtggtggaccagggctcgggcttcaccaaggcgggcttcgcgggcgagaaccagccgcgcatagtgctgaagagctctagcttggtgcccagctgggaccggccggtgctgcccggagcgccgggctgcgagctggcgggcggcgtggcgcgggcgcaccccatcaagcacggcgtggtggcggactgggaggcgctggaagggctgtgggagcgcctgctggtgggcggcctgcgggtgtgcccagagcagtggcccgtgctggtgagcgactcgccgttggcgccgcccgcgggccgcgaaagggtggcggagctgctgttcgagaccctggcagtgcccgcgtgccacatggctagcaccgcgttgctggcgctctgctccaccggcgcgttcagcgggctggccgtggaggcgggcgcgggcgtgtgccacgccacgcccatctacgcgggtcactcgtggcaccaggccaccttccgactgaacgtggcaggcagcaccctgtcgcgctacctgcgggatctgctggtggcggcgaaccctgacctcttgcagcaggccctgccccgcaaggccatcacacatctcaagaagcgcagctgctacgtgtccctggacttcgagggcgacctccgcgaccccgcccgccaccatccggccagtttcagcgtgggtaacgggtgctgcgtctgcctcagcagtgagcgcttccgctgccccgaacccatcttccagccgggcctgctgggccaggctgagcaggggctgcccgcgctggccttccgggcgctgcagaagatgcccaaaacgctgcggacacgcctggcagacaccgtggtgctagccggcggctccacactgtttcctggcttcgccgagcgcctggacaaggagctggaggcgcagtgccggcggcacggctacgcggccctgcggccccacctggtggccaagcatgggcgtggcatggctgtgtggaccggcggctccatggtggcctccctgcactccttccagcgccgctggataactcgggccatgtaccaggagtgtggctccaggctgctgtacgatgtgttcaactgagtcaggctggactggggggggtggcactgcgttgggggacagctctctatctaaagagtcaagtgtttggagctggcagggtcctcctggaggttggagctgactggatgggtcacccccataccctttctgggccaggagaaggtatttgggacccatgggaccctcattttgaactgcagtttgaatctccccaaccactgccagttcagagaatgccagtccagctgcctacccacagggccctactttatggcaataaaggtgatgccccacttgtgtccatgcca

SEQ ID NO: 104001 - DNA, 1899 bp, Homo sapiens
  Payload ID: 445
  Gene Symbol: ACTL6A
  Gene Name: actin-like 6A
  Uniprot ID: O96019
  ENST ID: ENST00000392662
  CDS Start-End: 348-1511
gccagcaagtgtggctgagctccggggtgtgtggacgccgctttgttgcctgaggtgggtggcggtggaagttaagggagtcaggggctatcgctcctcgagactcgcagtcgcggccactgcagtcacttcgccagttagcccttagggtaggagtcgcgccggcagcagccatgagcggcggcgtgtacgggggaggtgagtgagtgcggccggacgagagagcgcgccttttcggcgtgtgggatgaagttggagcccttgtttttgacattggatcctatactgtgagagctggttatgctggtgaggactgccccaaggtggattttcctacagctattggtatggtggtagaaagagatgacggaagcacattaatggaaatagatggcgataaaggcaaacaaggcggtcccacctactacatagatactaatgctctgcgtgttccgagggagaatatggaggccatttcacctctaaaaaatgggatggttgaagactgggatagtttccaagctattttggatcatacctacaaaatgcatgtcaaatcagaagccagtctccatcctgttctcatgtcagaggcaccgtggaatactagagcaaagagagagaaactgacagagttaatgtttgaacactacaacatccctgccttcttcctttgcaaaactgcagttttgacagcatttgctaatggtcgttctactgggctgattttggacagtggagccactcataccactgcaattccagtccacgatggctatgtccttcaacaaggcattgtgaaatcccctcttgctggagactttattactatgcagtgcagagaactcttccaagaaatgaatattgaattggttcctccatatatgattgcatcaaaagaagctgttcgtgaaggatctccagcaaactggaaaagaaaagagaagttgcctcaggttacgaggtcttggcacaattatatgtgtaattgtgttatccaggattttcaagcttcggtacttcaagtgtcagattcaacttatgatgaacaagtggctgcacagatgccaactgttcattatgaattccccaatggctacaattgtgattttggtgcagagcggctaaagattccagaaggattatttgacccttccaatgtaaaggggttatcaggaaacacaatgttaggagtcagtcatgttgtcaccacaagtgttgggatgtgtgatattgacatcagaccaggtctctatggcagtgtaatagtggcaggaggaaacacactaatacagagttttactgacaggttgaatagagagctgtctcagaaaactcctccaagtatgcggttgaaattgattgcaaataatacaacagtggaacggaggtttagctcatggattggcggctccattctagcctctttgggtacctttcaacagatgtggatttccaagcaagaatatgaagaaggagggaagcagtgtgtagaaagaaaatgcccttgagaaagagttcccaagcttctaccttccttttgtcaccttacgtttcatagctttagtatactcaggaaaagaatgaccatcttttgtagaatgtttatacatttttgcatatttcaatttccacttaaattttttaaagctttaactggctctataaattaagtttgtgctttccttgaaatgcacttattcttattacaagcattttataattttgtataaatgtctattttctctaaatattttgctttcagtaaaatgctttccaactctgtttagtgtattaattaccagtggattggtagaactgctttttattgactagtaaaagttactgcctatgctttttaccttaggcttacagaattaaataaaaattagccattcc

SEQ ID NO: 104002 - DNA, 1750 bp, Homo sapiens
  Payload ID: 445
  Gene Symbol: ACTL6A
  Gene Name: actin-like 6A
  Uniprot ID: O96019
  ENST ID: ENST00000450518
  CDS Start-End: 190-1353
aggcctggaccctagtgattggctgataggaggagccagcaagtgtggctgagctccggggtgtgtggacgccgctttgttgcctgagatgaagttggagcccttgtttttgacattggatcctatactgtgagagctggttatgctggtgaggactgccccaaggtggattttcctacagctattggtatggtggtagaaagagatgacggaagcacattaatggaaatagatggcgataaaggcaaacaaggcggtcccacctactacatagatactaatgctctgcgtgttccgagggagaatatggaggccatttcacctctaaaaaatgggatggttgaagactgggatagtttccaagctattttggatcatacctacaaaatgcatgtcaaatcagaagccagtctccatcctgttctcatgtcagaggcaccgtggaatactagagcaaagagagagaaactgacagagttaatgtttgaacactacaacatccctgccttcttcctttgcaaaactgcagttttgacagcatttgctaatggtcgttctactgggctgattttggacagtggagccactcataccactgcaattccagtccacgatggctatgtccttcaacaaggcattgtgaaatcccctcttgctggagactttattactatgcagtgcagagaactcttccaagaaatgaatattgaattggttcctccatatatgattgcatcaaaagaagctgttcgtgaaggatctccagcaaactggaaaagaaaagagaagttgcctcaggttacgaggtcttggcacaattatatgtgtaattgtgttatccaggattttcaagcttcggtacttcaagtgtcagattcaacttatgatgaacaagtggctgcacagatgccaactgttcattatgaattccccaatggctacaattgtgattttggtgcagagcggctaaagattccagaaggattatttgacccttccaatgtaaaggggttatcaggaaacacaatgttaggagtcagtcatgttgtcaccacaagtgttgggatgtgtgatattgacatcagaccaggtctctatggcagtgtaatagtggcaggaggaaacacactaatacagagttttactgacaggttgaatagagagctgtctcagaaaactcctccaagtatgcggttgaaattgattgcaaataatacaacagtggaacggaggtttagctcatggattggcggctccattctagcctctttgggtacctttcaacagatgtggatttccaagcaagaatatgaagaaggagggaagcagtgtgtagaaagaaaatgcccttgagaaagagttcccaagcttctaccttccttttgtcaccttacgtttcatagctttagtatactcaggaaaagaatgaccatcttttgtagaatgtttatacatttttgcatatttcaatttccacttaaattttttaaagctttaactggctctataaattaagtttgtgctttccttgaaatgcacttattcttattacaagcattttataattttgtataaatgtctattttctctaaatattttgctttcagtaaaatgctttccaactctgtttagtgtattaattaccagtggattggtagaactgctttttattgactagtaaaagttactgcctatgctttttaccttaggcttacagaattaaataaaaattagccattccagaaatata

SEQ ID NO: 104003 - DNA, 1901 bp, Homo sapiens
  Payload ID: 445
  Gene Symbol: ACTL6A
  Gene Name: actin-like 6A
  Uniprot ID: O96019
  ENST ID: ENST00000429709
  CDS Start-End: 214-1503
agacttaggcctggaccctagtgattggctgataggaggagccagcaagtgtggctgagctccggggtgtgtggacgccgctttgttgcctgaggtgggtggcggtggaagttaagggagtcaggggctatcgctcctcgagactcgcagtcgcggccactgcagtcacttcgccagttagcccttagggtaggagtcgcgccggcagcagccatgagcggcggcgtgtacgggggagatgaagttggagcccttgtttttgacattggatcctatactgtgagagctggttatgctggtgaggactgccccaaggtggattttcctacagctattggtatggtggtagaaagagatgacggaagcacattaatggaaatagatggcgataaaggcaaacaaggcggtcccacctactacatagatactaatgctctgcgtgttccgagggagaatatggaggccatttcacctctaaaaaatgggatggttgaagactgggatagtttccaagctattttggatcatacctacaaaatgcatgtcaaatcagaagccagtctccatcctgttctcatgtcagaggcaccgtggaatactagagcaaagagagagaaactgacagagttaatgtttgaacactacaacatccctgccttcttcctttgcaaaactgcagttttgacagcatttgctaatggtcgttctactgggctgattttggacagtggagccactcataccactgcaattccagtccacgatggctatgtccttcaacaaggcattgtgaaatcccctcttgctggagactttattactatgcagtgcagagaactcttccaagaaatgaatattgaattggttcctccatatatgattgcatcaaaagaagctgttcgtgaaggatctccagcaaactggaaaagaaaagagaagttgcctcaggttacgaggtcttggcacaattatatgtgtaattgtgttatccaggattttcaagcttcggtacttcaagtgtcagattcaacttatgatgaacaagtggctgcacagatgccaactgttcattatgaattccccaatggctacaattgtgattttggtgcagagcggctaaagattccagaaggattatttgacccttccaatgtaaaggggttatcaggaaacacaatgttaggagtcagtcatgttgtcaccacaagtgttgggatgtgtgatattgacatcagaccaggtctctatggcagtgtaatagtggcaggaggaaacacactaatacagagttttactgacaggttgaatagagagctgtctcagaaaactcctccaagtatgcggttgaaattgattgcaaataatacaacagtggaacggaggtttagctcatggattggcggctccattctagcctctttgggtacctttcaacagatgtggatttccaagcaagaatatgaagaaggagggaagcagtgtgtagaaagaaaatgcccttgagaaagagttcccaagcttctaccttccttttgtcaccttacgtttcatagctttagtatactcaggaaaagaatgaccatcttttgtagaatgtttatacatttttgcatatttcaatttccacttaaattttttaaagctttaactggctctataaattaagtttgtgctttccttgaaatgcacttattcttattacaagcattttataattttgtataaatgtctattttctctaaatattttgctttcagtaaaatgctttccaactctgtttagtgtattaattaccagtggattggtagaactgctttttattgactagtaaaagttactgcctatgctttttaccttaggcttacagaattaaataaaaattagccattccagaaatatat

SEQ ID NO: 104004 - DNA, 459 bp, Homo sapiens
  Payload ID: 445
  Gene Symbol: ACTL6A
  Gene Name: actin-like 6A
  ENST ID: ENST00000490364
  CDS Start-End: 309-459
gctttgttgcctgaggtgggtggcggtggaagttaagggagtcaggggctatcgctcctcgagactcgcagtcgcggccactgcagtcacttcgccagttagcccttagggtaggagtcgcgccggcagcagccatgagcggcggcgtgtacgggggaggtgagtgagtgcggccggacgagagagcgcgccttttcggcgtgtgggatgaagttggagcccttgtttttgacattggatcctatactgtgagagctggttatgctggtgaggactgccccaaggtggattttcctacagctattggtatggtggtagaaagagatgacggaagcacattaatggaaatagatggcgataaaggcaaacaaggcggtcccacctactacatagatactaatgctctgcgtgttccgagggagaatatggaggccatttcacctctaaaaaatgggatgg

SEQ ID NO: 104005 - DNA, 916 bp, Homo sapiens
  Payload ID: 445
  Gene Symbol: ACTL6A
  Gene Name: actin-like 6A
  ENST ID: ENST00000487978
  CDS Start-End: 1-485
tcttttcagatgaagttggagcccttgtttttgacattggatcctatactgtgagagctggttatgctggtgaggactgccccaaggtggattttcctacagctattggtatggtggtagaaagagatgacggaagcacattaatggaaatagatggcgataaaggcaaacaaggcggtcccacctactacatagatactaatgctctgcgtgttccgagggagaatatggaggccatttcacctctaaaaaatgggatggttgaagactgggatagtttccaagctattttggatcatacctacaaaatgcatgtcaaatcagaagccagtctccatcctgttctcatgtcagaggcaccgtggaatactagagcaaagagagagaaactgacagagttaatgtttgaacactacaacatccctgccttcttcctttgcaaaactgcagttttgacagcctttattcatcatctacttcactaaacaggataaccttcagggaaaaggcagttttggtgcaccattgtgtgtctactgtgttaaaggaattttagtgccagatttgctaatggtcgttctactgggctgattttggacagtggagccactcataccactgcaattccagtccacgatggctatgtccttcaacaaggcattgtgaaatcccctcttgctggagactttattactatgcagtgcagagaactcttccaagaaatgaatattgaattggttcctccatatatgattgcatcaaaagaagctgttcgtgaaggatctccagcaaactggaaaagaaaagagaagttgcctcaggttacgaggtcttggcacaattatatgtgtaattgtgttatccaggattttcaagcttcggtacttcaagtgtcagattcaacttatgatgaaca

SEQ ID NO: 104006 - DNA, 1537 bp, Homo sapiens
  Payload ID: 446
  Gene Symbol: ACTL6B
  Gene Name: actin-like 6B
  Uniprot ID: O94805
  ENST ID: ENST00000160382
  CDS Start-End: 108-1388
aattggccgctgagagtcccgccccgccagggatcccgggagctgtccggccgcctcggtgctgatcccgccaccgcccacgggccgctagcagcgcagcgggcactatgagcgggggcgtctacggcggagatgaggtgggggcgctggtctttgacattggctccttctcagtccgcgctgggtacgctggggaggactgtcccaaggctgacttccccaccacagtggggctgctggccgcggaggaggggggcgggctggagctggagggggacaaagagaagaaagggaagatcttccacatcgacaccaatgccctgcacgtgcctcgggatggagcggaggtcatgtcgcccctcaagaatggcatgatcgaggactgggagtgcttccgagccatcctggatcacacctacagcaaacacgtcaagtctgagccaaacctgcacccagtgctcatgtccgaggctccgtggaacacacgggccaagcgggagaagctgacagagctgatgttcgagcagtacaacattcctgccttcttcttatgcaagacggctgtgctcaccgcctttgcaaacgggcggtccactggcctcgtgctggacagtggagccacccacaccacggccattccagtacatgacggctacgttctgcagcaaggcatcgtcaagtcccctctggcaggggacttcatctccatgcagtgccgggagctgttccaggagatggccattgacatcatcccaccttacatgatcgcagccaaggagcctgtccgggagggtgcccccccaaactggaagaagaaggagaagctaccccaggtctccaagtcctggcataactacatgtgtaatgaggtgatccaggacttccaggcctccgtgctgcaggtctcagactccccctacgatgaacaggtggctgcacaaatgcccacagtgcactacgagatgcccaatggctacaatacagactacggcgccgagcgactccgcatccctgagggcctgtttgatccctcgaacgtcaagggcctgtcggggaacaccatgttgggtgtgggccacgtggtgaccaccagcatcggcatgtgtgacattgatattcgcccgggcctgtacgggagtgtcattgtcaccggcgggaacacactgctgcagggcttcactgacaggctcaatcgagagctttcccagaagaccccaccgagcatgcgactgaaactcattgccagcaacagcaccatggagcgcaagttcagcccctggatcgggggttccatcctggcctcactgggcactttccagcagatgtggatctccaagcaggaatatgaggagggcgggaagcagtgcgtggagcgaaagtgcccctgatggcactcctccccacacacctgctcccaagctcagatggaagtcccttaacccccatgccacattgcccccctcctcctttccctcttgtcctcattaatggtgatgtttctgggttgaaagaagtaaaaatgttttaagaaaaaaaa

SEQ ID NO: 104007 - DNA, 444 bp, Homo sapiens
  Payload ID: 446
  Gene Symbol: ACTL6B
  Gene Name: actin-like 6B
  ENST ID: ENST00000461605
  CDS Start-End: 246-444
agggatcccgggagctgtccggccgcctcggtgctgatcccgccaccgcccacgggccgctagcagcgcagcgggcactatgagcgggggcgtctacggcggaggctgacttccccaccacagtggggctgctggccgcggaggaggggggcgggctggagctggagggggacaaagagaagaaagggaagatcttccacatcgacaccaatgccctgcacgtgcctcgggatggagcggaggtcatgtcgcccctcaagaatggcatgatcgaggactgggagtgcttccgagccatcctggatcacacctacagcaaacacgtcaagtctgagccaaacctgcacccagtgctcatgtccgaggctccgtggaacacacgggccaagcgggagaagctgacagagctgatgttcgagcagtacaacattcctgccttcttct

SEQ ID NO: 104008 - DNA, 1494 bp, Homo sapiens
  Payload ID: 447
  Gene Symbol: ACTL7A
  Gene Name: actin-like 7A
  Uniprot ID: Q9Y615
  ENST ID: ENST00000333999
  CDS Start-End: 58-1365
aggccttgaatccagtgggattgagaactttctaagagtggtgcggctcttgacaacatgtgggctccaccagcagcaatcatgggggatgggcccaccaagaaggtgggcaaccaggcccccctgcagacacaggccctccagactgcctctttaagggatggcccggcgaagcgggccgtgtgggtccgccatacgagttcagagccacaagaacctactgaatcaaaggcagccaaggagaggcccaagcaggaggtgaccaaagcagtggtcgtggacctgggcactggctactgtaaatgtggctttgccggcctgccaagacccacccacaagatctcaacaacggtgggcaagccctacatggagaccgccaagactggggataatcgcaaggagacattcgtggggcaggaactcaacaacacaaacgttcatctcaagctggttaaccctctgcgacatggcatcatcgtggactgggatacagtgcaggatatctgggaatatctcttccgacaagagatgaagatcgccccggaggagcatgcggtcttggtttcagacccgccactgagcccacacaccaacagagagaaatatgctgaaatgctgtttgaagccttcaacacccctgcaatgcacatcgcctaccagtcgcgcctgtccatgtactcctatggaaggacctccggcctggtggtggaggtgggccatggcgtgtcctacgtggtccccatctacgagggttatcctttgcccagcatcaccggaaggctggactacgcgggctctgacctgacagcctacctgctgggcctgctgaacagtgcggggaacgaattcacccaggaccagatgggcatcgtggaggacatcaagaagaaatgctgctttgtggccctggatcccattgaggagaagaaagtccctctcagtgagcatacgatccgctacgtgctgccggatgggaaggagattcagctgtgccaggaacggttcctctgctcggagatgttcttcaagccatctctcatcaagtccatgcagctgggcctccacacccaaaccgtgtcctgccttaacaagtgtgacatcgccctcaaacgggacctcatggggaacatcctgctctgcgggggcagcacgatgctcagtggcttccctaaccgtctgcagaaggagctaagcagcatgtgtcccaatgacaccccgcaggtaaacgtgctgcctgaaagagacagtgccgtgtggaccggtggctccatcctggcctcacttcagggtttccaaccattgtgggtccaccgctttgagtacgaggaacacgggcctttcttcctctacagaaggtgcttctgaacagcgacgaggatggacactgcactggcagtgcctaccctcgacagggtgagcgcactcctacacacagggggtggagccggcgcttattcctgtagcattaaacacccctcatatgcccctccacag

SEQ ID NO: 104009 - DNA, 2379 bp, Homo sapiens
  Payload ID: 448
  Gene Symbol: ACTL7B
  Gene Name: actin-like 7B
  Uniprot ID: Q9Y614
  ENST ID: ENST00000374667
  CDS Start-End: 1038-2285
atttttctagagggcaaatctgatcattcccctgcttaaagtcttcatagcttccctggctctcctcagtttagtctaaacctactcctgccatttgatgccctttctatttggctctgtgacttctctagcttcatctgtttttccaaacactttgactgtgggaagttcttcaccgtgcctccatttgagcctttgctcaagctgtgctctctgcctgggatgtcttcccctcctcttaactacttgacaaatacctacacctcttccaggattcaacttaagcatcacctcctctctagagcaccttctgactgcctgtctcaaatgagttctccaagtagacttcttcctgcaaacccatcggcacccattccattttcttgtctagactgggcactgctggtggcctgggtttttaatcatctatcactggcaggctgcactgggcgggacctactatatactccagtaaatgtggagtgaagggaggaaagaactcttggggcggttaaggaggcctggtgcattggagtttgatgaatttgggttaaggtacaaacaccccaagtgctgtttgctcttgggcaagtccttagaattctgagcctcatttcctcagctctgcctacctgcagaacaacataagtgaagtaactagtacagtgcctgccttactggaggggctcaaataggccctctccaccaagaagcagaagaggaaaggtgtccagtagtgaacaggttaggcatggaaatgcaagggggctgagcagaaacctctgagaccctagtgtgcttggatttctaaaactgccggccacctgctctgtccgggagcaaacttgagttagagaggtgggggtgacacaccaagaaccgaccaaagccaggccctcccctgctgcctgaatggaccagccccgagtgacatcacaatcccgggtggttgtcatggcactgctggaggtgggggatctcatttctccccagggggctctaggctgtggatgtgagaaggggagcaagggaggcagatggcgacaaggaacagccccatgcccctgggcacggctcagggtgaccctggagaggcaggaacacggcccggccctgacgccagcctccgggacacaggtgcggccactcagctcaagatgaagcccaggaaggtgcacaagatcaaggcggtcatcatcgacctgggctcccagtactgcaagtgcggctacgcgggagagccgaggcccacctacttcatctcctccaccgtgggcaaacgctgccccgaggcggccgacgctggcgacacccgcaagtggactttagtgggccatgagctgctcaacacggaggcgcctctcaagctggtgaacccgctgaagcacggcatcgtggtggactgggactgcgtgcaggacatctgggagtacatcttccgcaccgccatgaagatcctccccgaggagcacgctgtgctggtctccgaccctccgctcagccccagcagcaaccgggagaagtacgcggagctcatgtttgagaccttcggcatcccagccatgcacgtgacgtcccagtcgttgctgtccatctactcctacggcaagacctcggggctggtggtggagagcgggcacggcgtctcgcacgtggtgcccatatccgagggcgacgtgctgccgggcctgaccagccgcgccgactacgctgggggtgacctcaccaactacctgatgcagctgctcaatgaggcgggccacgcattcacggacgaccacctgcacatcatagagcacatcaagaagaagtgctgctatgcggccttcctgcccgaggaggagctgggcctggtcccggaggagctgcgcgtggactacgagctcccggacggcaaactcatcactattggccaggagcgcttccgttgctctgagatgctcttccagccctccctggcaggcagcacccagccgggcctcccggagctcacagctgcctgcctgggccgctgccaggacacgggcttcaaggaggagatggccgccaacgtgctactgtgtggcggctgcactatgctggatggcttccccgagcgcttccagagggagctgagcctcctctgccccggggacagccctgcagtggctgccgctcctgagaggaagacctccgtgtggaccggcggttccatcctggcctccctgcaggccttccaacagctctgggtcagcaaggaagagtttgaggagcggggcagcgtggccatctacagcaagtgctgagcctcggcatttccacagacaaggcctccagcacagatggccacaggcctctctatacacatttacagaatttcacataaaggtttactctgaa

SEQ ID NO: 104010 - DNA, 1861 bp, Homo sapiens
  Payload ID: 449
  Gene Symbol: ACTL8
  Gene Name: actin-like 8
  Uniprot ID: Q9H568
  ENST ID: ENST00000375406
  CDS Start-End: 217-1317
ttcctgcttgccacgtgctcacagagtaggctgcggcaccacgtgcagccgctctcgtgcaggcgtttgcagtgtgcagctgagttcggcagctcacacagcacccctttcaagttgttttgcagtgggtgcctcttgtgagacactgtttctgagagcagcttttgtggcatcttacagggcagatttctggtcccacccacctctgcctccgccatggctgcaagaaccgttatcattgaccacgggtctggctttttgaaggctggcacggccggctggaatgagcctcagatggtcttcccgaacatcgtgaactacctaccgtgcaaggagaaccctggccccagctatgcccgtaggcgtgtgagcctgggcatcgacatttgccatcctgacacctttagctaccccatcgagcggggccgcatcctcaactgggagggtgtgcagtacctctggtcatttgtgttggagaaccacagacgggagcaagaggtcccccctgtgatcatcacggagacacccttgagggagcctgcggaccgaaagaagatgctggagatcctgtttgagttgctgcatgtcccatcggtcctcctggccgaccagctgcagatgtccctgtatgcctctggcctcctgaccggagtggtggttgattctggctatggcctgacccgcgtgcagcctttccaccagggccgccccttgcccgccagcggcaagacgctggagttcgccggccaggatctctccgcctatctcctcaagagtctctttaaggaagattgcgatagacgctgcctgtttcagctggagacagtcgccgtgactcagatgaacaagtgctacgtgccgcagaatctgggggaggccctggactttcgtgagaggcagcagagtgccttggatgagagcaacacctatcagctcccagacggctcccgcgtggagctgacccccatgcagcgggtggctcctgagatgttctttagcccgcaggtgttcgagcagccggggcccagcatcccacgggccattgtggaatccgtggagtcctgcgagatctccctgcgccccctgctggtctcccacgtgatggcctgcgggggcaacaccctctatcccgggttcacaaagcgcctgttcagggagctgatgggggatcacgtctcctccaccaaggccacagtctgggagggttccaatagaaactttagtgtctggctaggagcgtccgtggtggctcacctttctacctaccagtctgagtggatgtcccgagaggagtatggtgagcatatgaggatgtgaccctactggctcactcctgagaatgggctcctgttagatgggcacgggcggattaattttagcaaaatgttctgggtgggggtagaatgaggtggggtggggtgagctggctttggaattctaggggcatgagggtattttttaggttctaaggttttatcttgttgcaagagtgggacctacccaagggggaagacaagatgtcatccttggaaaccctgcaggggacagtttttccagggtggcctatcattggggtatgagtggctgactgccatctccatgcctgagagccactgatttttcattggcatttcccctggtttgtctcattcttcttggttgagtaggttttaactggggtagcactcctgctaggagtcccaattatttttgactaggggatgggggacagttgacatttctggtcctacaggccctttctggccagggaggcattgctgcaggtgagcctgggatgcccttgccacccgtggttggatcttgttttatatctgcaaataaatagcttgtttggaagcaa

SEQ ID NO: 104011 - DNA, 1670 bp, Homo sapiens
  Payload ID: 449
  Gene Symbol: ACTL8
  Gene Name: actin-like 8
  Uniprot ID: Q9H568
  ENST ID: ENST00000617065
  CDS Start-End: 28-1128
caggtcccacccacctctgcctccgccatggctgcaagaaccgttatcattgaccacgggtctggctttttgaaggctggcacggccggctggaatgagcctcagatggtcttcccgaacatcgtgaactacctaccgtgcaaggagaaccctggccccagctatgcccgtaggcgtgtgagcctgggcatcgacatttgccatcctgacacctttagctaccccatcgagcggggccgcatcctcaactgggagggtgtgcagtacctctggtcatttgtgttggagaaccacagacgggagcaagaggtcccccctgtgatcatcacggagacacccttgagggagcctgcggaccgaaagaagatgctggagatcctgtttgagttgctgcatgtcccatcggtcctcctggccgaccagctgcagatgtccctgtatgcctctggcctcctgaccggagtggtggttgattctggctatggcctgacccgcgtgcagcctttccaccagggccgccccttgcccgccagcggcaagacgctggagttcgccggccaggatctctccgcctatctcctcaagagtctctttaaggaagattgcgatagacgctgcctgtttcagctggagacagtcgccgtgactcagatgaacaagtgctacgtgccgcagaatctgggggaggccctggactttcgtgagaggcagcagagtgccttggatgagagcaacacctatcagctcccagacggctcccgcgtggagctgacccccatgcagcgggtggctcctgagatgttctttagcccgcaggtgttcgagcagccggggcccagcatcccacgggccattgtggaatccgtggagtcctgcgagatctccctgcgccccctgctggtctcccacgtgatggcctgcgggggcaacaccctctatcccgggttcacaaagcgcctgttcagggagctgatgggggatcacgtctcctccaccaaggccacagtctgggagggttccaatagaaactttagtgtctggctaggagcgtccgtggtggctcacctttctacctaccagtctgagtggatgtcccgagaggagtatggtgagcatatgaggatgtgaccctactggctcactcctgagaatgggctcctgttagatgggcacgggcggattaattttagcaaaatgttctgggtgggggtagaatgaggtggggtggggtgagctggctttggaattctaggggcatgagggtattttttaggttctaaggttttatcttgttgcaagagtgggacctacccaagggggaagacaagatgtcatccttggaaaccctgcaggggacagtttttccagggtggcctatcattggggtatgagtggctgactgccatctccatgcctgagagccactgatttttcattggcatttcccctggtttgtctcattcttcttggttgagtaggttttaactggggtagcactcctgctaggagtcccaattatttttgactaggggatgggggacagttgacatttctggtcctacaggccctttctggccagggaggcattgctgcaggtgagcctgggatgcccttgccacccgtggttggatcttgttttatatctgcaaataaatagcttgtttggaagc

SEQ ID NO: 104012 - DNA, 1426 bp, Homo sapiens
  Payload ID: 450
  Gene Symbol: ACTL9
  Gene Name: actin-like 9
  Uniprot ID: Q8TC94
  ENST ID: ENST00000324436
  CDS Start-End: 122-1372
atagattgcgggcccacccctccccctgtctgcctgccctccccactggccgggcctcaacctcttctccccgcaaccccaaccccagaggaaaagccccctcacctggcgtcccgcaaccatggatgcaagtcgccccaagtcctcggaatcccagtcctccctggaggcccccaggcccggcccaaaccccagtcccaacgtggtgaacaagcccctgcagcgggactcccccggcatggtggccgacaggctgccaccaaagaccggcgcggtggttattgacatgggcacaggcacctgtaaggtaggttttgctgggcaggccagccccacctacaccgtggccaccatcctgggctgccagcccaagaaacccgccacctcggggcagtccgggctgcagacgttcatcggcgaggcagcccgcgtgctcccagagctgacgctggtgcaacccctgcgcagcggcatcgtcgtggactgggatgccgccgagctcatctggcgccacctgctggagcacgacctccgagtggccacccacgaccacccgctgctgttctccgacccacccttcagcccggccaccaaccgcgagaagctagtggaggtggccttcgagtcgctgcgctccccagccatgtacgtggcatcgcagtcggtgctgtctgtctacgcccacggtcgtgtcagcgggctggtggtggacacgggacacggggtcacctacacagtgcccgtcttccagggctacaacctgctccacgccacggagcgtctggacctggcgggcaacaacctgaccgccttcctggcggagatgctgctccaggccggcctgcccctgggacagcaggacctggacctagtggagaacattaagcaccactattgctacgtggcctccgacttccagaaggagcaggcccggccggagcaggagtacaagcggactctgaagctgcccgatgggcgcacggtcaccctgggcaaggagctgttccagtgtccggagctgctgttcaaccccccagaggtcccggggctgtcacccgtcggcctctccaccatggccaagcagagtctccgcaagttgtcactggagatgcgcgcggacttggcccaaaacgtgcttctctgcggtgggtcctcgctcttcaccggcttcgagggtcgcttccgggcagagctgctgcgcgctctgccagccgagacccacgtggtggtggctgcccagcccaccaggaatttctccgtatggatcgggggctccatcctggcctccctgcgcgccttccagtcctgctgggtcctgcgggagcagtacgaggaacagggtccctatatcgtgtaccgcaaatgctactgaccagggcagagctggggagggcgtgggggcagtaaagcctctgctacagccggc

SEQ ID NO: 104013 - DNA, 1252 bp, Homo sapiens
  Payload ID: 450
  Gene Symbol: ACTL9
  Gene Name: actin-like 9
  Uniprot ID: Q8TC94
  ENST ID: ENST00000612068
  CDS Start-End: 5-1252
aaccatggatgcaagtcgccccaagtcctcggaatcccagtcctccctggaggcccccaggcccggcccaaaccccagtcccaacgtggtgaacaagcccctgcagcgggactcccccggcatggtggccgacaggctgccaccaaagaccggcgcggtggttattgacatgggcacaggcacctgtaaggtaggttttgctgggcaggccagccccacctacaccgtggccaccatcctgggctgccagcccaagaaacccgccacctcggggcagtccgggctgcagacgttcatcggcgaggcagcccgcgtgctcccagagctgacgctggtgcaacccctgcgcagcggcatcgtcgtggactgggatgccgccgagctcatctggcgccacctgctggagcacgacctccgagtggccacccacgaccacccgctgctgttctccgacccacccttcagcccggccaccaaccgcgagaagctagtggaggtggccttcgagtcgctgcgctccccagccatgtacgtggcatcgcagtcggtgctgtctgtctacgcccacggtcgtgtcagcgggctggtggtggacacgggacacggggtcacctacacagtgcccgtcttccagggctacaacctgctccacgccacggagcgtctggacctggcgggcaacaacctgaccgccttcctggcggagatgctgctccaggccggcctgcccctgggacagcaggacctggacctagtggagaacattaagcaccactattgctacgtggcctccgacttccagaaggagcaggcccggccggagcaggagtacaagcggactctgaagctgcccgatgggcgcacggtcaccctgggcaaggagctgttccagtgtccggagctgctgttcaaccccccagaggtcccggggctgtcacccgtcggcctctccaccatggccaagcagagtctccgcaagttgtcactggagatgcgcgcggacttggcccaaaacgtgcttctctgcggtgggtcctcgctcttcaccggcttcgagggtcgcttccgggcagagctgctgcgcgctctgccagccgagacccacgtggtggtggctgcccagcccaccaggaatttctccgtatggatcgggggctccatcctggcctccctgcgcgccttccagtcctgctgggtcctgcgggagcagtacgaggaacagggtccctatatcgtgtaccgcaaatgctac

SEQ ID NO: 104014 - DNA, 2419 bp, Homo sapiens
  Payload ID: 451
  Gene Symbol: ACTR10
  Gene Name: actin-related protein 10 homolog (S. cerevisiae)
  Uniprot ID: Q9NZ32
  ENST ID: ENST00000254286
  CDS Start-End: 81-1334
gccccggccccgccccgcgagcgccgagacttgttggccgcggagactgcgaccctcttctctcagtctgccttactaccatgccgctctacgagggcctggggagcggcggggagaagacggcggtcgtgatcgacctgggagaggcctttaccaagtgtggatttgctggagaaactggtccaagatgtataattcctagtgtgataaaaagagctgggatgcctaagcctgtcagagttgttcagtataatatcaatacagaagaattatattcctacctaaaggaattcatccacatactatatttcaggcatctattggtgaatcccagagaccgccgagttgtgattatcgaatcggtattatgtccttctcacttcagagagacactcactcgtgttcttttcaaatattttgaggttccatctgtcttgcttgctccaagtcatctaatggctcttctgacgcttggaattaattctgccatggtcctagattgtggatatagggaaagcctggtgttacccatatatgaaggaatcccagttctaaattgttggggagcactacccctaggaggaaaagctcttcacaaagagttggaaactcaactattggaacaatgtactgttgacacaagtgttgctaaagaacagagccttccctcagtgatgggttcagttccggaaggtgtcttagaggacattaaagcgcgtacttgctttgtaagtgatctgaagcgaggactaaaaatccaagcagcaaaatttaatattgatgggaataatgagcgtccctccccacccccaaatgttgactatccattagatggagagaagattttacatatccttggatcaatcagagattcagttgtggaaattctttttgaacaagataatgaagagcaatcagttgccactttaatattggattcccttatacagtgtccgatagacaccaggaagcaactagcagagaatttggtagtcataggtggcacttctatgttgccaggatttctccacagattgcttgcagaaataaggtatttggtagaaaaaccaaaatataaaaaagcacttggcactaagacatttcgaattcatactccacctgcaaaagctaattgtgtggcctggttgggaggggctatttttggagcattacaagatatacttgggagccgttctgtttcaaaggaatattataatcagacgggccgtatacctgattggtgttctctcaataacccacctttggaaatgatgtttgatgtcgggaaaactcaaccacctctgatgaagagagcattttccactgagaaatagaagtttgattaaaaatcaaccttgcttcatatcaaatatttaaccaattataagcaaattgtacaaagtatgtaggatgttttgttatagaggactatagtggaagtgaaagcattctgtgtttactctttgcattaatatataattcttttgactttgtttctcttgtgtagtggtaaaatggtagctggtgcttattgagatttgctgtatttatatcaataaagtatagtaaagcagtttgattttggaagtttgttatgtggctttttttttttttttttttttgagacggagtctcgctctgtcacttaggctggagtgcagtggcacaatctctactcattgcaagctccgcctcccgggtttacgccattctgtctcagcctcctgagtagctgggactataggcatacgccaccccgcccggctaattttttgtatatttagtagagacggggtttcaccatgttagccaggatggtctcaatttcctgacctcgtgatccaccctcctcggcctcccaaagtgttgggattacaggcgtgaaccactgtaccagcctatgttgcttgtctttcaaaaagaacagtatttctccacagttcacataacctgttctgggctcattaattgtgtttccagcagttactccatttaaagcataaatagtgttaaccattaccagttatttcaaatactaacatgggtccatttaaaaaaaatatttattttggtacttgggtgtccatattataataatgttgtttttccagaaatatatttgatctttggactgagaatgtttggtaacatagtcaagcatttgttaagccaagtgtggaaatgttcactttttaactttacagtttttttaatgagcaattctacatttctaagaaaaaagatacttcatttttatataaggttacaactgctttataaaaatgtattcacaatgtcattaatctttgcgtttgtgctttatatcttctcagggcagaggttcttgaaatatgtactcaatcatttaacttttattttattttttcatttgtttttaatgaactacctcttgttgaaa

SEQ ID NO: 104015 - DNA, 1602 bp, Homo sapiens
  Payload ID: 451
  Gene Symbol: ACTR10
  Gene Name: actin-related protein 10 homolog (S. cerevisiae)
  ENST ID: ENST00000545307
  CDS Start-End: 139-696
ggcccggcgcgccgcggccgcgcgaggcccccgccgtcgccgacgcccgagcgccggagccccggccccgccccgcgagcgccgagacttgttggccgcggagactgcgaccctcttctctcagtctgccttactaccatgccgctctacgagggcctggggagcggcggggagaagacggcggtcgtgatcgacctgggagaggcctttaccaagtgtggatttgctggagaaactggtccaagatgtataattcctagtgtgataaaaagagctgggatgcctaagcctgtcagagttgttcagtataatatcaatacagaagaattatattcctacctaaaggaattcatccacatactatatttcaggcatctattggtgaatcccagagaccgccgagttgtgattatcgaatcggtattatgtccttctcacttcagagagacactcactcgtgttcttttcaaatattttgaggttccatctgtcttgcttgctccaagtcatctaatggctcttctgacgcttggaattaattctgccatggtcctagattgtggatatagggaaagcctggtgttacccatatcttttttgaatcccagttctaaattgttggggagcactacccctaggaggaaaagctcttcacaaagagttggaaactcaactattggaacaatgtactgttgacacaagtgttgctaaagaacagagccttccctcagtgatgggttcagttccggaaggtgtcttagaggacattaaagcgcgtacttgctttgtaagtgatctgaagcgaggactaaaaatccaagcagcaaaatttaatattgatgggaataatgagcgtccctccccacccccaaatgttgactatccattagatggagagaagattttacatatccttggatcaatcagagattcagttgtggaaattctttttgaacaagataatgaagagcaatcagttgccactttaatattggattcccttatacagtgtccgatagacaccaggaagcaactagcagagaatttggtagtcataggtggcacttctatgttgccaggatttctccacagattgcttgcagaaataaggtatttggtagaaaaaccaaaatataaaaaagcacttggcactaagacatttcgaattcatactccacctgcaaaagctaattgtgtggcctggttgggaggggctatttttggagcattacaagatatacttgggagccgttctgtttcaaaggaatattataatcagacgggccgtatacctgattggtgttctctcaataacccacctttggaaatgatgtttgatgtcgggaaaactcaaccacctctgatgaagagagcattttccactgagaaatagaagtttgattaaaaatcaaccttgcttcatatcaaatatttaaccaattataagcaaattgtacaaagtatgtaggatgttttgttatagaggactatagtggaagtgaaagcattctgtgtttactctttgcattaatatataattcttttgactttgtttctcttgtgtagtggtaaaatggtagctggtgcttattgagatttgct

SEQ ID NO: 104016 - DNA, 705 bp, Homo sapiens
  Payload ID: 451
  Gene Symbol: ACTR10
  Gene Name: actin-related protein 10 homolog (S. cerevisiae)
  ENST ID: ENST00000555337
  CDS Start-End: 70-450
gccccgcgagcgccgagacttgttggccgcggagactgcgaccctcttctctcagtctgccttactaccatgccgctctacgagggcctggggagcggcggggagaagacggcggtcgtgatcgacctgggagaggcctttaccaagtgtggatttgctggagaaactggtccaagatgtataattcctagtgtgataaaaagagctgggatgcctaagcctgtcagagttgttcagtataatatcaatacagaagaattatattcctacctaaaggaattcatccacatactatatttcaggcatctattggtgaatcccagagaccgccgagttgtgattatcgaatcggtattatgtccttctcacttcagagagacactcactcgtgttcttttcaaatattttgagagagttggaaactcaactattggaacaatgtactgttgacacaagtgttgctaaagaacagagccttccctcagtgatgggttcagttccggaaggtgtcttagaggacattaaagagattcagttgtggaaattctttttgaacaagataatgaagagcaatcagttgccactttaatattggattcccttatacagtgtccgatagacaccaggaagcaactagcagagaatttggtagtcataggtggcacttctatgttgccaggatttctccacagattgcttgcagaa

SEQ ID NO: 104017 - DNA, 687 bp, Homo sapiens
  Payload ID: 451
  Gene Symbol: ACTR10
  Gene Name: actin-related protein 10 homolog (S. cerevisiae)
  ENST ID: ENST00000554642
  CDS Start-End: 1-448
aagtgatctgaagcgaggactaaaaatccaagcagcaaaatttaatattgatgggaataatgagtgtccgatagacaccaggaagcaactagcagagaatttggtagtcataggtggcacttctatgttgccaggatttctccacagattgcttgcagaaataaggtatttggtagaaaaaccaaaatataaaaaagcacttggcactaagacatttcgaattcatactccacctgcaaaagctaattgtgtggcctggttgggaggggctatttttggagcattacaagatatacttgggagccgttctgtttcaaaggaatattataatcagacgggccgtatacctgattggtgttctctcaataacccacctttggaaatgatgtttgatgtcgggaaaactcaaccacctctgatgaagagagcattttccactgagaaatagaagtttgattaaaaatcaaccttgcttcatatcaaatatttaaccaattataagcaaattgtacaaagtatgtaggatgttttgttatagaggactatagtggaagtgaaagcattctgtgtttactctttgcattaatatataattcttttgactttgtttctcttgtgtagtggtaaaatggtagctggtgcttattgagatttgctgtatttatatcaataaagtatagtaaagca

SEQ ID NO: 104018 - DNA, 780 bp, Homo sapiens
  Payload ID: 451
  Gene Symbol: ACTR10
  Gene Name: actin-related protein 10 homolog (S. cerevisiae)
  ENST ID: ENST00000553907
  CDS Start-End: 1-106
gcgtacttgctttgtaagtgatctgaagcgaggactaaaaatccaagcagcaaaatttaatattgatgggaataatgagagattcagttgtggaaattctttttgaacaagataatgaagagcaatcagttgccactttaatattggattcccttatacagtgtccgatagacaccaggaagcaactagcagagaatttggtagtcataggtggcacttctatgttgccaggatttctccacagattgcttgcagaaataaggtatttggtagaaaaaccaaaatataaaaaagcacttggcactaagacatttcgaattcatactccacctgcaaaagctaattgtgtggcctggttgggaggggctatttttggagcattacaagatatacttgggagccgttctgtttcaaaggaatattataatcagacgggccgtatacctgattggtgttctctcaataacccacctttggaaatgatgtttgatgtcgggaaaactcaaccacctctgatgaagagagcattttccactgagaaatagaagtttgattaaaaatcaaccttgcttcatatcaaatatttaaccaattataagcaaattgtacaaagtatgtaggatgttttgttatagaggactatagtggaagtgaaagcattctgtgtttactctttgcattaatatataattcttttgactttgtttctcttgtgtagtggtaaaatggtagctggtgcttattgagatttgctgtatttatatcaataaagtatagtaa

SEQ ID NO: 104019 - DNA, 603 bp, Homo sapiens
  Payload ID: 451
  Gene Symbol: ACTR10
  Gene Name: actin-related protein 10 homolog (S. cerevisiae)
  ENST ID: ENST00000556748
  CDS Start-End: 65-196
gcgagcgccgagacttgttggccgcggagactgcgaccctcttctctcagtctgccttactaccatgccgctctacgagggcctggggagcggcggggagaagacggcggtcgtgatcgacctgggagaggcctttaccaacctgtcagagttgttcagtataatatcaatacagaagaattatattcctacctaaaggaattcatccacatactatatttcaggcatctattggtgaatcccagagaccgccgagttgtgattatcgaatcggtattatgtccttctcacttcagagagacactcactcgtgttcttttcaaatattttgagagagttggaaactcaactattggaacaatgtactgttgacacaagtgttgctaaagaacagagccttccctcagtgatgggttcagttccggaaggtgtcttagaggacattaaagcgcgtacttgctttgtaagtgatctgaagcgaggactaaaaatccaagcagcaaaatttaatattgatgggaataatgagcgtccctccccacccccaaatgttgactatccattagatggagagaagattttacatatccttggatcaatcag

SEQ ID NO: 104020 - DNA, 484 bp, Homo sapiens
  Payload ID: 451
  Gene Symbol: ACTR10
  Gene Name: actin-related protein 10 homolog (S. cerevisiae)
  ENST ID: ENST00000556243
  CDS Start-End: 8-280
tactaccatgccgctctacgagggcctggggagcggcggggagaagacggcggtcgtgatcgacctgggagaggcctttaccaagtgtggatttgctggagaaactggtccaagatgtataattcctagtgtgataaaaagagctgggatgcctaaggttctcactctgtcacccaggctggagtgcagtggcacgatcttggctcactgcaacctctgcctccctgcaacctccacctcctgggttcaagcagttctcccacttcagcctcctgagtagctgggactacagcctgtcagagttgttcagtataatatcaatacagaagaattatattcctacctaaaggaattcatccacatactatatttcaggcatctattggtgaatcccagagaccgccgagttgtgattatcgaatcggtattatgtccttctcacttcagagagacactcactcgtgttcttttcaaatattttgag

SEQ ID NO: 104021 - DNA, 1517 bp, Homo sapiens
  Payload ID: 451
  Gene Symbol: ACTR10
  Gene Name: actin-related protein 10 homolog (S. cerevisiae)
  ENST ID: ENST00000555229
  CDS Start-End: 77-616
cggccccgccccgcgagcgccgagacttgttggccgcggagactgcgaccctcttctctcagtctgccttactaccatgccgctctacgagggcctggggagcggcggggagaagacggcggtcgtgatcgacctgggagaggcctttaccaagtgtggatttgctggagaaactggtccaagatgtataattcctagtgtgataaaaagagctgggatgcctaagcctgtcagagttgttcagtataatatcaatacagaagaattatattcctacctaaaggaattcatccacatactatatttcaggcatctattggtgaatcccagagaccgccgagttgtgattatcgaatcggtattatgtccttctcacttcagagagacactcactcgtgttcttttcaaatattttgaggttccatctgtcttgcttgctccaagtcatctaatggctcttctgacgcttggaattaattctgccatggtcctagattgtggatatagggaaagcctggtgaatcccagttctaaattgttggggagcactacccctaggaggaaaagctcttcacaaagagttggaaactcaactattggaacaatgtactgttgacacaagtgttgctaaagaacagagccttccctcagtgatgggttcagttccggaaggtgtcttagaggacattaaagcgcgtacttgctttgtaagtgatctgaagcgaggactaaaaatccaagcagcaaaatttaatattgatgggaataatgagcgtccctccccacccccaaatgttgactatccattagatggagagaagattttacatatccttggatcaatcagagattcagttgtggaaattctttttgaacaagataatgaagagcaatcagttgccactttaatattggattcccttatacagtgtccgatagacaccaggaagcaactagcagagaatttggtagtcataggtggcacttctatgttgccaggatttctccacagattgcttgcagaaataaggtatttggtagaaaaaccaaaatataaaaaagcacttggcactaagacatttcgaattcatactccacctgcaaaagctaattgtgtggcctggttgggaggggctatttttggagcattacaagatatacttgggagccgttctgtttcaaaggaatattataatcagacgggccgtatacctgattggtgttctctcaataacccacctttggaaatgatgtttgatgtcgggaaaactcaaccacctctgatgaagagagcattttccactgagaaatagaagtttgattaaaaatcaaccttgcttcatatcaaatatttaaccaattataagcaaattgtacaaagtatgtaggatgttttgttatagaggactatagtggaagtgaaagcattctgtgtttactctttgcattaatatataattcttttgactttgtttctcttgtgtagtggtaaaatggtagctggtgcttattgagat

SEQ ID NO: 104022 - DNA, 1544 bp, Homo sapiens
  Payload ID: 451
  Gene Symbol: ACTR10
  Gene Name: actin-related protein 10 homolog (S. cerevisiae)
  ENST ID: ENST00000554402
  CDS Start-End: 1-908
tgccgctctacgagggcctggggagcggcggggagaagacggcggtcgtgatcgacctgggagaggcctttaccaagtgtggatttgctggagaaactggtccaagatgtataattcctagtgtgataaaaagagctgggatgcctaagcctgtcagagttgttcagtataatatcaatacagaagaattatattcctacctaaaggaattcatccacatactatatttcaggcatctattggtgaatcccagagaccgccgagttgtgattatcgaatcggtattatgtccttctcacttcagagagacactcactcgtgttcttttcaaatattttgaggttccatctgtcttgcttgctccaagtcatctaatggctcttctgacgcttggaattaattctgccatggtcctagattgtggatatagggaaagcctggtgttacccatatatgaaggaatcccagttctaaattgttggggagcactacccctaggaggaaaagctcttcacaaagagttggaaactcaactattggaacaatgtactgttgacacaagtgttgctaaagaacagagccttccctcagtgatgggttcagttccggaaggtgtcttagaggacattaaagcgcgtacttgctttgtaagtgatctgaagcgaggactaaaaatccaagcagcaaaatttaatattgatgggaataatgagcgtccctccccacccccaaatgttgactatccattagatggagagaagattttacatatccttggatcaatcagagattcagttgtggaaattctttttgaacaagataatgaagagcaatcagttgccactttaatattggattcccttatacagtgttgctcttgttgcccaggctggagtgcaatggcatgatctcagctcagcacaacctccgcccccgggttcaatgtccgatagacaccaggaagcaactagcagagaatttggtagtcataggtggcacttctatgttgccaggatttctccacagattgcttgcagaaataaggtatttggtagaaaaaccaaaatataaaaaagcacttggcactaagacatttcgaattcatactccacctgcaaaagctaattgtgtggcctggttgggaggggctatttttggagcattacaagatatacttgggagccgttctgtttcaaaggaatattataatcagacgggccgtatacctgattggtgttctctcaataacccacctttggaaatgatgtttgatgtcgggaaaactcaaccacctctgatgaagagagcattttccactgagaaatagaagtttgattaaaaatcaaccttgcttcatatcaaatatttaaccaattataagcaaattgtacaaagtatgtaggatgttttgttatagaggactatagtggaagtgaaagcattctgtgtttactctttgcattaatatataattcttttgactttgtttctcttgtgtagtggtaaaatggtagctggtgcttattgagatttgctgtatttat

SEQ ID NO: 104023 - DNA, 7591 bp, Homo sapiens
  Payload ID: 452
  Gene Symbol: ARPIN
  Gene Name: actin-related protein 2/3 complex inhibitor
  Uniprot ID: Q7Z6K5
  ENST ID: ENST00000357484
  CDS Start-End: 122-802
cgccattcccggatccgccggctgggaatcgcgggtccccgcgcgtcctgcagcacttcccgcgccgcgcccccagcccagtgcgccggctctgtgccggggtgcccgggcggtcgggagaatgagccgcatctaccacgacggcgcgctccggaacaaggcggtgcagagcgtccggctgccaggggcctgggaccccgccgcccaccaggggggaaatggtgtcctgctggagggagaactgatcgatgtatctcggcacagcatcttggacactcatggcaggaaggagcgctactacgtgctgtatatccggcccagtcacatccatcgccgtaaattcgacgccaagggaaatgaaatcgagcccaacttcagcgccaccaggaaggtgaacacgggcttcctcatgtcgtcctacaaggtggaagccaagggggacactgacaggctcacgcccgaggcgctgaaggggctggtcaacaagccagagctgctcgcgctgacagagagcctcacccccgaccacacagtggcgttctggatgcccgagtcagagatggaggtgatggaactcgagctgggggccggggtacggctgaagactcggggcgatggtcccttcctggattcattggccaaacttgaggctggaacagtgaccaagtgtaatttcactggtgatggaaagacaggggcatcctggacagacaacatcatggcccaaaagtgttcgaagggggctgcagcggagatccgagagcagggggatggggcagaggacgaggagtgggatgactgagggacgtggctgcctctgggggcaccagcaccttctgtagcattgtggaacatttcttccatgaacttctactctggagctggagagaacagtctgccaagtcttacctggttcttccccatagccaccttggaatactctttgaacaagctctgctaaaaccaaacccatgaccactgtgttggtggtggggcctcatgctgtggctcagggagggcccctccctgcatgtgagtctagccttcctagacattacatgatgaccctttaaaaaaaaattagagatggaggtctcactatgttgcccaggctgatctcaaactcctggactcaagcgatccacccccctccacctcccaaggtgttgggattacaggcgtgagccactgcacccagcctcatgttgaccctggccctggatagcagctttgtttgtagaggcaggtggtgggagagaccctaggacagcctgagagtaactggacctggtattggtgcggagtggggaatatcccttgtctaaatgcagagcagctgagagaagttagcggggctcttcctccgttctcattgtttcctgctttccttccccacccaccccttcctcagcactctgtgttgtagcctgtactatcctgcttcaagcctccgtgtcccttgtaccttccccctaccttgagttgccagttctttactccctcaaatgttcccatgccacctctggggtttctgttatctgacatccctggctgctttcctggtagatgccattcccagagaggccaacagcgttcccaggcgtggctggctggtccgcatctctcagactcactctgccaggctacagttttgagaataccttttttgttgttgttttgtacctggagaactttttatgaatgagtaaatcttcagaaaggaattcctccacccttactgggttattgtcaggtgtaaacggcctttcagctgagcaatgttcctatgagaaggaagccatttctcttggctcatgaacactgccttttgggtagtatacccacacccagatctgtgaagagacctggaattgaagtctccatgtcgtcaggacttggtggcatgtggatcttgcttgacttgggaaaagagagggtggtggtgaactaataattatggagtccccctaatgtgtcgaacacaatgctagatgatttccatgataataattactcatacttgtgctaagcacttgcgatatcgtacttctcacaacagtccatgaggtactgattattattcccattttctcatgagactaaagctcagagctctaggatagtatacagtggcaagaggaatttacatccaagcactcagatttcaaagcccacattcttaactaccggactattcatattacagagcaggaaaagggtctcagacaggttaagcaacctgcccagagtcacacagctaatgagtagcagaatcaggattcaaacccagagctgtcaaaagcaaaccttatgttccttccactgtcccctgcttccttgcccttcagaaaggtcttggaaacaggggccagaggatgtggtagccacttcactggtgttctgtgtctgaatgggactttctcacaggcaggccatgctgggacctcagccatgggggtggccagggaggtggttgagcagaaggatagctggggacactgactgggggtagagtcacccagtgtctttagacatcctgctgtctaaagcactgtgtccaaagggtatggcacacttatatggacaggtcaccattccaaacaaggaggcccagtgtgtcaataggagaggtcctaaagcaacaaaaagggcggggtgtcttggatgggcttcaggaagggaaagaccattgtgtctggagctcagagaatgggggctggtgtttgagatgaggctggagattgggcatggcatcctcacgcatgttaaggaattggggactttatccttaacatcctggaagccagtgatcccatggagagtgagaagatctgatctgtgtttcaaaggtcacttgactgccgagcagctggaggcgagttgctcctttaggagactgctgcagttgcctgggtgagaggctagaggggtctggtctatagcagtggcaggggagatggaaagaagagaatgatttgaggggcattcggggggcaaaatcaacaggacctggggggagacgaagggatcaagaatgatgcccagattctgggtgagtggcagtgctgtggtgcacaagtagtgatgttatgtttccgggtgacctgctgtttagcaggagcccagcctgtggctaagaagtatagagaactgaaactagctccctagggatgggaaaaccaagtgggctgaggataagaacagggccccagggctgggtgcagtcgctcacgcctgtaatcttagcactttgggaggccgaggtgggcggatcacttgaggtcaggagttcgaaaccagcctgatcaacacagtgaaaccccgtctctaccaaaaaatacaaaaattacccggacatggtggcacatgcctgtagttccagcgccttgggaggctgaggcatgagaatttcttgaacccgggaggtggaggttgcagtgagctgagattgccactgcactccagcctgggcaacacagtgagaccctgtctcaaaaaaaaaaaaaaaaaaaagaatagggtcccaggctcagcaggtagggacactgaggtaaaatcctattccctaggactagggactaggaagggagaaaataggaagctgctgtggcataggcatctgcatgggcagatggtgaggccaaagcccctgattttgccatacctcctgccctggtcaggactggttcaggcattagggcaggcccagccagggcagaagccttcctagatacacctgtggggagttgaggaactacagcagggctgaaaccctgctttcaggggcccccatgtggctggtaggggcagcttttggaagctagactggatcctattactccccagatgaaaagttcaaattccttaatacaactcagagctcatcacaatgtcacaaccctcctttctcggctcgcttcctccttaagagctctggggcgattctttcagaccagcctgagggatcttccacaggttgttaatagggctagaaacaaaaagtggtggtgtttctatgatctaatttgttggaacaaacgtagtgttaaactcaaacatttctgtaggatttcttggagctttaactatactaacatttactgtaactcttcaggacagggtatgattacgtatttcccacatttctttggtcagagaacccgtttttgtgaggagcatttcatgggacagctgttgtgagaaacagtttgggaagggctgtgttggtcccatggaggggctggctgttcccagagcaggtcactcccccacttgcattgccttgcctggactcttttcttggagggaggtccctttcctctacccatctgaatttttttttcttccaccagtgtccagcttgcctttcaccatgggcctaatgatggaaattacagttattttgtatcttcaaacagaaccaagcaaatcctctgagcttcattcatatgggaaattttctttctttcttttttttttttttgagatggaatttcgctcttgttgcccaggctggagtgcaatggctcaatctcggctcactgcaacctccacctcccaggttcaagagtttctcctgcctcagcaggaggattactgtaatcccaagtagctgggattacaggcctgcgccaccacgactagctaattttgtacttttagtagagatgcgatttcaccatgttggctaggctggtctcgaactcctgacctcaggtgatccaccctcctcagcctcccaaagtgctgggattacaggcatgagccacagtgccggacattatgggaaaattttttgagggactaaactaatctccacaaatagcaatgcatttaggaaatatatttaaaggggaaaaaaagactcatagtttcactcagtcatgttcataatttttagtatttgggttttttagcatgtaatttgtgtacatagttttggtttttgtaaacttgcataggggttttctggtacaaactggaaaacctgctagacaaattctgaaacatctgtaatgcttgtaggtagttgttgtaacactatgcccacacataatcactttccatattgctgcatagtctttgtaaccatttttcttcttcttttttttgagatggagttttgctcttgttgcccaggctggagtgcaatggcgcgatcttggcccactgcaacctctgcctcccgggttcaagctattctgctgccttagcctcccgagtagctgggattacaggcacacgccaccacgcccggctagtttttgtatttttagtagagacggggtttcaccatgtcagccaggcttttcttgaacttctgatctcaagtgatcctcactcctcagcctcccaaattgctgggattacaggcgtgagccaccacgcccacctgtaaccattatttttaagattgctaccattggatagttctgtcatggtccaacttttggatatttaaaattgatccctgtgtggctaacagaattaatgtttccaaaaatgttgaaaattatatagttctcttaattccccacctctaactatatttttgggttatttctttaggaacagatgcccaggagtcatattactgagaatctagaaatcttttgcaaagttcttgttatattgccaaattgcttcccaaaagggttgttctaaaccataatttcaccagcaatgtaggggagaaccatttttatgctgcccttgtgagaattgggtatgaaaacatttttaaaatgatttttgatgaggtgaaaataatatttgaatatattttaatttgcctttcccccacttatagtgagcttaaacattttttccttttcctagctgtatttctccctttgttattcgttctttcgtccatttatctactggggagatggggagtgttatctttttagtttatcagttatttgcattttaaatataaccatttgccatattttaacaacgatttttccattaaataattctttttataaaaaaactttatatatctgttgatgttttgtgatttttattgcttctaagctaatacagatttttggatcttattcaatttcgctttcttctgtttaggttattatctggttttatacctaactacttattttcaaattgctaaccagttatcctaatagtatttactgaattccttcccactcctacatcacatattaaaattattttatgcctaaattatttataatatttcagttattcttcctataattacaatttgaaccatcaaagtaggttttcatagttggcagagctagttcttcttcataattctgtttcagaattttctttgatattcttcctcaacattttaaacattttgtcaagtttcagtgcaactgacttttggtttttatttatttaaaaactgggccatgccgggcgcagtggctcacgcctgtaatcccagcacttcgggagactgagatgggtgaatcacttgaggtcaggagtttgagaccagactggccaatgtggtgaaaccccatctctactaaaaatacaaaaatttgctgggcatggtggcatgtgcctgtaatcccagctactggggaggctgaagcaggagaattgtttgaacccgggagacggaggttgcagtgagccaagattgtgccactgcactccagcctgggcaacagagtgagactccatctcaaacaaacaaacaaacaaacaaacaaaaaactggactaggcgtggtggcggtttgggagactgaggctggaggattgcctgaggccagcagtttgaggttacagtgaggtatgactgtgccactgcactccaacctgggtaagaccctatctctgaaaaacaaacaagcaaaccccagaactctggctgcaaaagtagtacatatttctttgaaggaaaaaaaggaaaacttgataatcctaccacccaaagatgtttttaaatcacttatgtggtactcagttatgtgccatgcactgtccaagtgcttacaaatattatactaactccctttgtgtttataacaactgtctgaagtcagtagactcattttccagttttccagtttaggaaactgatattacaccttttctacagatggggaaacttgcccagggtgcccaggcagtccgcagaaccatgctttgaatcagggcagtgtggttccagggtcctgtacagatcaaacaccctgactctgccattccatcagatacatgattcatattttggtgtatttgcctccaatcttgagcaaagtgggttgtccctgtacatactttgtgtaatcttttagcttaacaggtgtcatgaacacttccgtatcataaatctttcccagcatgatttttattatctatttaatatttctcatattcaatgtagaacaatgcacttaaccaatttctcatttttgtaataattttcttcccattttcccctgtaataacactgctgagatatatatttttttcttcttttttttactgttctgaagatactctggcagaaatgtatgttcctcaggctaaatcttttcacacatccacaatcattttatcataaattctagagctggaaa

SEQ ID NO: 104024 - DNA, 698 bp, Homo sapiens
  Payload ID: 452
  Gene Symbol: ARPIN
  Gene Name: actin-related protein 2/3 complex inhibitor
  ENST ID: ENST00000560096
  CDS Start-End: 1-409
ggcgctgaaggggctggtcaacaagccagagctgctcgcgctgacagagagcctcacccccgaccacacagtggcgttctggatgcccgagtcagagatggaggtgatggaactcgagctgggggccggggtacggctgaagactcggggcgatggtcccttcctggattcattggccaaacttgaggctggaacagtgaccaagtgtaatttcactggtgatggaaagacaggggcatcctggacagacaacatcatggcccaaaagtgttcgaagggggctgcagcggagatccgagagcagggggatggggcagaggacgaggagtgggtaggtacctggtgttggtgcagttgtatctcctggcaggagcatggtacatactggttgaggttgtgggtaggatgagaagacgacaggatgaatcttaccccccagctttagtggaattctgtgaaacacctgggaatgtgttagcatcaggagaattcctctaaggtatgaagaatgacaacctgggacctttcttgtaggtggctctgaacctaactattccccaaagattcccaagtggtaggaaggagggggtgcagagggatattaatcatggtcattaagtctcaaaacatttctacttcaagtgaatacattaaccatgctgaggcagttgaacaactgaatgcgtagtttttcctcc

SEQ ID NO: 104025 - DNA, 2145 bp, Homo sapiens
  Payload ID: 452
  Gene Symbol: ARPIN
  Gene Name: actin-related protein 2/3 complex inhibitor
  ENST ID: ENST00000460685
  CDS Start-End: 833-1225
aacaggatcgggtgggggggtgggatgcgggtgggggaaaactggggttgccaaagccgcctctccgccttcagtccgcccctccagtccgccgctcccggcgcccctgccgccgcgcccgcccagcgaccccatgacacagatcggcttaaagctccccgcctgtccgcctgccctcgagagagggtcccgacccccagacaggtctccgaaggctgggcttcgcctcacgccgacctccggccccaccccacccgcgtaactataaactccagctacttgccgcgctgcttttgcacagactcatgccctgccccagaagggacagtggccgtgctgtggcgggaacagcgggcgggctggtccagagcagggcctgcctgggtgaggaggatttggagggccaggccctgtcgtcacagggttatgaggccgaagggaccattccatttacaactgcgctgaagaattgtgctaagtgaaataagccagatacagaaagacaaatactgtgtgatctcgtatatggaacctataaaagcgttgaaccatagaaacggcagaacagaccaggcgctgtggttcacgcctgtaatcccagcactttgggaggccgaggcgggtggatcacttgaggggaaatggtgtcctgctggagggagaactgatcgatgtatctcggcacagcatcttggacactcatggcaggaaggagcgctactacgtgctgtatatccggcccagtcacatccatcgccgtaaattcgacgccaagggaaatgaaatcgagcccaacttcagcgccaccaggaaggtgaacacgggcttcctcatgtcgtcctacaaggtggaagccaagggggacactgacaggctcacgcccgaggcgctgaaggggctggtcaacaagccagagctgctcgcgctgacagagagcctcacccccgaccacacagtggcgttctggatgcccgagtcagagatggaggtgatggaactcgagctgggggccggggtacggctgaagactcggggcgatggtcccttcctggattcattggccaaacttgaggctggaacagtgaccaagtgtaatttcactggtgatggaaagacaggggcatcctggacagacaacatcatggcccaaaagtgttcgaagggggctgcagcggagatccgagagcagggggatggggcagaggacgaggagtgggatgactgagggacgtggctgcctctgggggcaccagcaccttctgtagcattgtggaacatttcttccatgaacttctactctggagctggagagaacagtctgccaagtcttacctggttcttccccatagccaccttggaatactctttgaacaagctctgctaaaaccaaacccatgaccactgtgttggtggtggggcctcatgctgtggctcagggagggcccctccctgcatgtgagtctagccttcctagacattacatgatgaccctttaaaaaaaaattagagatggaggtctcactatgttgcccaggctgatctcaaactcctggactcaagcgatccacccccctccacctcccaaggtgttgggattacaggcgtgagccactgcacccagcctcatgttgaccctggccctggatagcagctttgtttgtagaggcaggtggtgggagagaccctaggacagcctgagagtaactggacctggtattggtgcggagtggggaatatcccttgtctaaatgcagagcagctgagagaagttagcggggctcttcctccgttctcattgtttcctgctttccttccccacccaccccttcctcagcactctgtgttgtagcctgtactatcctgcttcaagcctccgtgtcccttgtaccttccccctaccttgagttgccagttctttactccctcaaatgttcccatgccacctctggggtttctgttatctgacatccctggctgctttcctggtagatgccattcccagagaggccaacagcgttcccaggcgtggctggctggtccgcatctctcagactcactctgccaggctacagttttgagaataccttttttgttgttgttttgtacctggagaactttttatgaatgagtaaatcttcagaaagg

SEQ ID NO: 104026 - DNA, 1437 bp, Homo sapiens
  Payload ID: 453
  Gene Symbol: ACTRT1
  Gene Name: actin-related protein T1
  Uniprot ID: Q8TDG2
  ENST ID: ENST00000371124
  CDS Start-End: 193-1323
ggagataagattcagaggttgaggatggggtgtcctggtggactgaaggtagcctactagctgtacatgggtgacaacttgaaacttcagaaccctgaagtttaaaaaattctaaaggtgcctgtcatctcagagagtgacgtaagtgttctttctttatttgggggaagtccaggagaacatattacagacatgtttaatccacatgcattagatgttcctgctgtaatttttgacaatggttcaggactctgcaaagcaggcctgtctggagagattggaccccgccatgtcatcagctccgtcttgggacattgtaaattcaatgtgcctttagcaagacttaatcagaagtacttcgtggggcaagaagccctgtacaagtatgaggccctacatttgcactaccccattgagcgtggactggtaacaggatgggatgacatggagaaactctggaaacatctctttgagcgggagcttggagtaaaacccagccaacagcctgtacttatgaccgagccctctttgaatcctagggaaattcgagaaaagctagcagaaatgatgtttgagaccttcagtgtgcctggtttctacctgtctaatcatgcggtggcagcgctctatgcctctgcctgtgtcacaggcctggtggtggacagtggagatggggtcacttgcactgtccccatctttgagggttactccctgcctcacgcagtcaccaaactctgtatggcagggagggacatcacagagcacctcacccggctcctctttgctagcgggtttaacttcccttgcatactcaacaaggccgtggtaaataacatcaaagagaagttgtgctacatcgccttggagccagagaaagagctacgcaagagccggggagaggtcctgggagcatacagactgccagatggacatgtcatccactttggggatgagctgtaccaagtgcccgaggttctttttgcacctgaccagctgggcatccacagcccaggactctcaaaaatggtctccagcagcatcatgaagtgtgacactgacatccagaataaactttatgcagacattgtactctccgggggcaccactctcctccctgggctggaggaaaggctcatgaaggaagtggaacagctggcttccaaaggtactcccatcaagatcacagcttctcctgatagatgcttctctgcatggattggtgcatccatcatgacctctatgagcagtttcaagcagatgtgggtcacctcggcagacttcaaggagtatgggacatctgtggttcaaagaaggtgcttttaaagatccttgagcagaggagacatcttgaagtgtcagattacaggagtaccagtgggagatggcattttcttctgggcttcagcatgatgttcaataaaagttttgccatttcaa

SEQ ID NO: 104027 - DNA, 1421 bp, Homo sapiens
  Payload ID: 454
  Gene Symbol: ACTRT2
  Gene Name: actin-related protein T2
  Uniprot ID: Q8TDY3
  ENST ID: ENST00000378404
  CDS Start-End: 205-1338
ggaagaggcctcagcaggcccaggccacctggagggagagcagacctgcggctgaggatgcagggctcccgggcacggtgctagccctgccttgagacaccccgagagctgtgggaagagctgtgggatcccctattgcatcacaaagcggccctggagggctggtctttattttgatgaggctgagaagggaaggctgcgggcatgtttaatccgcacgctttagactccccggctgtgatttttgacaatggctcggggttctgcaaagcgggcctgtctggggagtttggaccccggcacatggtcagctccatcgtggggcacctgaaattccaggctccctcagcagaggccaaccagaagaagtactttgtgggggaggaggccctgtacaagcaggaggccctgcagctgcactcccctttcgagcgtggcctgatcacagggtgggatgacgtggagagactctggaagcacctctttgagtgggagctaggcgtgaaacccagcgaccagcccctgcttgcaacggagccctccctgaaccccagggagaaccgtgagaagatggcagaagtcatgttcgagaacttcggcgtgcccgctttctacctgtcggaccaggcggtgctggctctctacgcctctgcctgtgtcacgggcctggtggtggacagcggggatgcggtcacctgcactgtccccatctttgagggttactccctgccccacgcagtcaccaagctccacgtggcgggcagggacatcacggagctcctcatgcagctgctcctggccagcggccacaccttcccctgccagctggacaagggtctcgtggacgacatcaaaaagaagctgtgctacgtggccttggagcccgagaaggagctttcccggaggccggaggaggtcctgagggagtacaagctgcccgacgggaacatcatcagcctcggggacccgctgcaccaggcgcccgaggccctgttcgtgccccagcagctgggcagccagagccccgggctctcgaatatggtctccagcagcatcaccaagtgtgataccgacatccagaagatcctctttggggagattgtgctgtcggggggcactaccctgttccacgggctggatgaccggcttctcaaggagctggagcagctggcctccaaggacacccccatcaagatcacggctccccccgaccggtggttctccacctggattggagcctccatcgtcacctctctgagtagcttcaagcagatgtgggtcaccgccgcagacttcaaggagtttgggacctccgtggtgcagagaagatgcttctgaaggccgcttctcgttgggtaccgtggggggtgaaccctagccccagctttgggaggatgttcaataaaggaccaatgccggaa

SEQ ID NO: 104028 - DNA, 2005 bp, Homo sapiens
  Payload ID: 455
  Gene Symbol: ACTRT3
  Gene Name: actin-related protein T3
  Uniprot ID: Q9BYD9
  ENST ID: ENST00000330368
  CDS Start-End: 376-1494
agaattccgtggctttggaaaataaaactgctgttatagctcttctgggtatttgagaaatgcacttgtgaagggttagagttgaatcttttgatgcgaaagtcgggttttcctgatactgggattccgggattccaggtgttggggtggcccaattcctgcgagaagcaatagcgggcggtaacatgaggagcacggtgcgtccagcgagtccttccgcctggggccctgccgaccccctgcctgcgcccccaggactctggcctcacccggccgtgccggggcctctgtgacgcggcgttccaggcactcggccccggccgagcccgtagctagagcggctcagagacaggaggcggcggcagcagcggcggcatgaaccactgccagctaccggtggtgatcgacaacggctcgggaatgatcaaggcgggcgtggctgggtgccgggagccccagtttatctacccgaacattatcggccgcgccaagggccagagccgcgcggcccagggcgggctagaactctgcgtgggcgaccaagctcaggactggaggagctcgctgttcatcagttacccagtggagcgtggtctcattacttcatgggaggacatggagatcatgtggaagcatatctatgactataacctaaagctgaagccgtgtgatggcccagtcttgattactgagccagcgctgaacccactggccaaccggcaacagatcacggaaatgttttttgagcatctgggtgttcctgccttctatatgtccatccaggctgtgctggctctctttgctgctggcttcactactggccttgtgctgaattcaggtgctggggttacccagagtgtgcccatctttgagggttactgtctgcctcatggtgtgcagcaactggatctggcaggccttgacctcaccaactacctcatggtgctaatgaagaaccatggtatcatgttgctcagtgcttcagacagaaagattgttgaagacatcaaggagagcttttgttatgtggcaatgaactacgaagaggaaatggccaagaaacccgattgtctagagaaagtttaccaactacctgatgggaaggtcatccagctccatgaccagctcttttcttgtccagaggccctcttctctccgtgtcatatgaaccttgaggcccctggcattgataagatatgcttcagcagcataatgaaatgtgatacaggcctgaggaattccttcttttccaatattatccttgccgggggatcaacctctttccctggtttagacaagcggttagttaaggatatagcaaaggtggctcctgccaacaccgctgtgcaagttatagctcctccagaaaggaaaatatcagtgtggatgggaggttctattcttgcatccttgtctgccttccaggacatgtggatcactgctgcagaatttaaagaagttggacccaacatagtacaccaaagatgcttctgaaatacagataaaatggttggaagaaaatgttttgagtatatgtgacagaaaactttggatattatatgtttctgggagaagagaaaatacttcacctattgggatgccaatatttctgttgtatttctataatgggtttgggggataataatggtgaagctcaagaacagatgtctattgagtagaaccaagttaaaataatgtttcccatagtgtttcttctataacttgacgttggtgagcttatatttcccttggaagagagcatttgtggtacaatatgctatgtgccaaatgagtgataagatttaagcttattgaagtttagggaaagaaggttgctgtggtgaggaacgagactccatagcagaggtatgccatcatggaaggggtggcattgggatggagcgcagatatccaggcaagcatactaaaatgaacaagttgctaaagatgagaatgaacaaagcatattcagggcatgtttaatagactgattttgtttttaaaa

SEQ ID NO: 104029 - DNA, 4701 bp, Homo sapiens
  Payload ID: 456
  Gene Symbol: ALCAM
  Gene Name: activated leukocyte cell adhesion molecule
  Uniprot ID: Q13740
  ENST ID: ENST00000306107
  CDS Start-End: 501-2252
agagcagcccggagaccgctgccgccgctgccgctgctaccaccgctgccacctgaggagacccgccgcccccccgtcgccgcctcctgcgagtccttcttagcacctggcgtttcatgcacattgccactgccattattattatcattccaatacaaggaaaataaaagaagataccagcgaaaagaaccgcttacacctttccgaattactcaagtgtctcctggaaacagagggtcgttgtccccggaggagcagccgaagggcccgtgggctggtgttgaccgggagggaggaggagttgggggcattgcgtggtggaaagttgcgtgcggcagagaaccgaaggtgcagcgccacagcccaggggacggtgtgtctgggagaagacgctgcccctgcgtcgggacccgccagcgcgcgggcaccgcggggcccgggacgacgccccctcctgcggcgtggactccgtcagtggcccaccaagaaggaggaggaatatggaatccaagggggccagttcctgccgtctgctcttctgcctcttgatctccgccaccgtcttcaggccaggccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcaaccctcccccagaggaatttttgttttacttaccaggacagcccgaaggaataagaagctcaaatacttacacactgacggatgtgaggcgcaatgcaacaggagactacaagtgttccctgatagacaaaaaaagcatgattgcttcaacagctatcacagttcactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcaatggacaattactggcagtggaagcgtcataaaccaaacagaggaatctccttatattaatggcaggtattatagtaaaattatcatttcccctgaagagaatgttacattaacttgcacagcagaaaaccaactggagagaacagtaaactccttgaatgtctctgctataagtattccagaacacgatgaggcagacgagataagtgatgaaaacagagaaaaggtgaatgaccaggcaaaactaattgtgggaatcgttgttggtctcctccttgctgcccttgttgctggtgtcgtctactggctgtacatgaagaagtcaaagactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatttggtagcacttacctctacagacacctgctaataaattattttctgtcaaaagaaaaaacacaagcatgtgtgagagacagtttggaaaaatcatggtcaacattcccattttcatagatcacaatgtaaatcactataattacaaattggtgttaaatcctttgggttatccactgccttaaaattatacctatttcatgtttaaaaagatatcaatcagaattggagtttttaacagtggtcattatcaaagctgtgttattttccacagaatatagaatatatatttttttcgtgtgtgtttttgttaactaccctacagatattgaatgcaccttgagataatttagtgtttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtagaccagatatgggctacttgtgactagacttttaaactttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatgaaaaataaattgaaaattaaagtcagatgagaataggaataatactttgccacttctgcattatttagaaacatacgttattgtacatttgtaaaccatttactgtctgggcaatagtgactccgtttaataaaagcttccgtagtgcattggtatggattaaatgcataaaatattcttagactcgatgctgtataaaatattatgggaaaaaaagaaaatacgttattttgcctctaaacttttattgaagttttatttggcaggaaaaaaaattgaatcttggtcaacatttaaaccaaagtaaaaggggaaaaaccaaagttatttgttttgcatggctaagccattctgttatctctgtaaatactgtgatttcttttttattttctctttagaattttgttaaagaaattctaaaatttttaaacacctgctctccacaataaatcacaaacactaaaataaaattacttccatataaatattattttctcttttggtgtgggagatcaaaggtttaaagtctaacttctaagatatatttgcagaaagaagcaacatgacaatagagagagttatgctacaattatttcttggtttccacttgcaatggttaattaagtccaaaaacagctgtcagaacctcgagagcagaacatgagaaactcagagctctggaccgaaagcagaaagtttgccgggaaaaaaaaagacaacattattaccatcgattcagtgcctggataaagaggaaagcttacttgtttaatggcagccacatgcacgaagatgctaagaagaaaaagaattccaaatcctcaacttttgaggtttcggctctccaatttaactctttggcaacaggaaacaggttttgcaagttcaaggttcactccctatatgtgattataggaattgtttgtggaaatggattaacatacccgtctatgcctaaaagataataaaactgaaatatgtcttca

SEQ ID NO: 104030 - DNA, 1818 bp, Homo sapiens
  Payload ID: 456
  Gene Symbol: ALCAM
  Gene Name: activated leukocyte cell adhesion molecule
  ENST ID: ENST00000486979
  CDS Start-End: 119-1717
aaaccctaaagcccagtgcttttagtgacatttcaaatgccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcaaccctcccccagaggaatttttgttttacttaccaggacagcccgaaggaataagaagctcaaatacttacacactgacggatgtgaggcgcaatgcaacaggagactacaagtgttccctgatagacaaaaaaagcatgattgcttcaacagctatcacagttcactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcaatggacaattactggcagtggaagcgtcataaaccaaacagaggaatctccttatattaatggcaggtattatagtaaaattatcatttcccctgaagagaatgttacattaacttgcacagcagaaaaccaactggagagaacagtaaactccttgaatgtctctgctataagtattccagaacacgatgaggcagacgagataagtgatgaaaacagagaaaaggtgaatgaccaggcaaaactaattgtgggaatcgttgttggtctcctccttgctgcccttgttgctggtgtcgtctactggctgtacatgaagaagtcaaagactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaa

SEQ ID NO: 104031 - DNA, 2496 bp, Homo sapiens
  Payload ID: 456
  Gene Symbol: ALCAM
  Gene Name: activated leukocyte cell adhesion molecule
  ENST ID: ENST00000465413
  CDS Start-End: 1-1033
gttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcaatggacaattactggcagtggaagcgtcataaaccaaacagaggaatctccttatattaatggcaggtattatagtaaaattatcatttcccctgaagagaatgttacattaacttgcacagcagaaaaccaactggagagaacagtaaactccttgaatgtctctgctataagtattccagaacacgatgaggcagacgagataagtgatgaaaacagagaaaaggtgaatgaccaggcaaaactaattgtgggaatcgttgttggtctcctccttgctgcccttgttgctggtgtcgtctactggctgtacatgaagaagtcaaagactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatttggtagcacttacctctacagacacctgctaataaattattttctgtcaaaagaaaaaacacaagcatgtgtgagagacagtttggaaaaatcatggtcaacattcccattttcatagatcacaatgtaaatcactataattacaaattggtgttaaatcctttgggttatccactgccttaaaattatacctatttcatgtttaaaaagatatcaatcagaattggagtttttaacagtggtcattatcaaagctgtgttattttccacagaatatagaatatatatttttttcgtgtgtgtttttgttaactaccctacagatattgaatgcaccttgagataatttagtgtttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtagaccagatatgggctacttgtgactagacttttaaactttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatg

SEQ ID NO: 104032 - DNA, 4189 bp, Homo sapiens
  Payload ID: 456
  Gene Symbol: ALCAM
  Gene Name: activated leukocyte cell adhesion molecule
  Uniprot ID: Q13740
  ENST ID: ENST00000472644
  CDS Start-End: 67-1779
gcccgggacgacgccccctcctgcggcgtggactccgtcagtggcccaccaagaaggaggaggaatatggaatccaagggggccagttcctgccgtctgctcttctgcctcttgatctccgccaccgtcttcaggccaggccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcaaccctcccccagaggaatttttgttttacttaccaggacagcccgaaggaataagaagctcaaatacttacacactgacggatgtgaggcgcaatgcaacaggagactacaagtgttccctgatagacaaaaaaagcatgattgcttcaacagctatcacagttcactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcaatggacaattactggcagtggaagcgtcataaaccaaacagaggaatctccttatattaatggcaggtattatagtaaaattatcatttcccctgaagagaatgttacattaacttgcacagcagaaaaccaactggagagaacagtaaactccttgaatgtctctgctaatgaaaacagagaaaaggtgaatgaccaggcaaaactaattgtgggaatcgttgttggtctcctccttgctgcccttgttgctggtgtcgtctactggctgtacatgaagaagtcaaagactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatttggtagcacttacctctacagacacctgctaataaattattttctgtcaaaagaaaaaacacaagcatgtgtgagagacagtttggaaaaatcatggtcaacattcccattttcatagatcacaatgtaaatcactataattacaaattggtgttaaatcctttgggttatccactgccttaaaattatacctatttcatgtttaaaaagatatcaatcagaattggagtttttaacagtggtcattatcaaagctgtgttattttccacagaatatagaatatatatttttttcgtgtgtgtttttgttaactaccctacagatattgaatgcaccttgagataatttagtgtttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtagaccagatatgggctacttgtgactagacttttaaactttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatgaaaaataaattgaaaattaaagtcagatgagaataggaataatactttgccacttctgcattatttagaaacatacgttattgtacatttgtaaaccatttactgtctgggcaatagtgactccgtttaataaaagcttccgtagtgcattggtatggattaaatgcataaaatattcttagactcgatgctgtataaaatattatgggaaaaaaagaaaatacgttattttgcctctaaacttttattgaagttttatttggcaggaaaaaaaattgaatcttggtcaacatttaaaccaaagtaaaaggggaaaaaccaaagttatttgttttgcatggctaagccattctgttatctctgtaaatactgtgatttcttttttattttctctttagaattttgttaaagaaattctaaaatttttaaacacctgctctccacaataaatcacaaacactaaaataaaattacttccatataaatattattttctcttttggtgtgggagatcaaaggtttaaagtctaacttctaagatatatttgcagaaagaagcaacatgacaatagagagagttatgctacaattatttcttggtttccacttgcaatggttaattaagtccaaaaacagctgtcagaacctcgagagcagaacatgagaaactcagagctctggaccgaaagcagaaagtttgccgggaaaaaaaaagacaacattattaccatcgattcagtgcctggataaagaggaaagcttacttgtttaatggcagccacatgcacgaagatgctaagaagaaaaagaattccaaatcctcaacttttgaggtttcggctctccaatttaactctttggcaacaggaaacaggttttgcaagttcaaggttcactccctatatgtgattataggaattgtttgtggaaatggattaacatacccg

SEQ ID NO: 104033 - DNA, 1501 bp, Homo sapiens
  Payload ID: 457
  Gene Symbol: ASCC1
  Gene Name: activating signal cointegrator 1 complex subunit 1
  Uniprot ID: Q8N9N2
  ENST ID: ENST00000317126
  CDS Start-End: 348-1421
ctttctaccctcaatgccgagcacagaacctggggcagtgtttccactgtgcttccagtcccgagcatttcggatgaatgaatgatgaacaaacgacagaacgcagggcgagcagctcagcaaaggtcatgcaggagatagagaagcgctgtgtcatgagtattggatcattatggatttttttctttctcattgtgcagatctattcgcacaactctatcttcaaccagtttgccaggcccaccggaggtgcccagtaaaattttgtcaaacaaatactgatgatgaagtatcctgggacttggccctgtcagggcataattggaatatcatttggagaaagtgtcatggaagttctgcgtccacagcttataagaattgatggccggaattacaggaagaatccagtccaagaacagacctatcaacatgaagaagatgaagaggacttctatcaaggctccatggagtgtgctgatgagccctgtgatgcctacgaggtggagcagaccccacaaggattccggtctactttgagggcccccagcttgctctataagcatatagttggaaagagaggggacactaggaagaaaatagaaatggagaccaaaacttctattagcattcctaaacctggacaagacggggaaattgtaatcactggccagcatcgaaatggtgtaatttcagcccgaacacggattgatgttcttttggacacttttcgaagaaagcagcccttcactcacttccttgcctttttcctcaatgaagttgaggttcaggaaggattcctgagattccaggaggaagtactggcgaagtgctccatggatcatggggttgacagcagcattttccagaatcctaaaaagcttcatctaactattgggatgttggtgcttttgagtgaggaagagatccagcagacatgtgagatgctacagcagtgtaaagaggaattcattaatgatatttctgggggtaaacccctagaagtggagatggcagggatagaatacatgaatgatgatcctggcatggtggatgttctttacgccaaagtccatatgaaagatggctccaacaggctacaagaattagttgatcgagtgctggaacgttttcaggcatctggactaatagtgaaagagtggaatagtgtgaaactgcatgctacagttatgaatacactattcaggaaagaccccaatgctgaaggcaggtacaatctctacacagcggaaggcaaatatatcttcaaggaaagagaatcatttgatggccgaaatattttaaagttgtttgagaacttctactttggctccctaaagctgaattcaattcacatctctcagaggttcaccgtagacagctttggaaactacgcttcctgtggacaaattgacttctcctgaggtggatcttggaaagcactagaaactaaacatcttcaccaggtgctgaagaaaagtgtcttcgttttaattgccaagca

SEQ ID NO: 104034 - DNA, 2002 bp, Homo sapiens
  Payload ID: 457
  Gene Symbol: ASCC1
  Gene Name: activating signal cointegrator 1 complex subunit 1
  Uniprot ID: Q8N9N2
  ENST ID: ENST00000317168
  CDS Start-End: 116-1189
ctggggaaatttcctatcgcacgtctgctgcagcagtctcctgtttctcctcctaccttctccatttttctagtccctgcagggcataattggaatatcatttggagaaagtgtcatggaagttctgcgtccacagcttataagaattgatggccggaattacaggaagaatccagtccaagaacagacctatcaacatgaagaagatgaagaggacttctatcaaggctccatggagtgtgctgatgagccctgtgatgcctacgaggtggagcagaccccacaaggattccggtctactttgagggcccccagcttgctctataagcatatagttggaaagagaggggacactaggaagaaaatagaaatggagaccaaaacttctattagcattcctaaacctggacaagacggggaaattgtaatcactggccagcatcgaaatggtgtaatttcagcccgaacacggattgatgttcttttggacacttttcgaagaaagcagcccttcactcacttccttgcctttttcctcaatgaagttgaggttcaggaaggattcctgagattccaggaggaagtactggcgaagtgctccatggatcatggggttgacagcagcattttccagaatcctaaaaagcttcatctaactattgggatgttggtgcttttgagtgaggaagagatccagcagacatgtgagatgctacagcagtgtaaagaggaattcattaatgatatttctgggggtaaacccctagaagtggagatggcagggatagaatacatgaatgatgatcctggcatggtggatgttctttacgccaaagtccatatgaaagatggctccaacaggctacaagaattagttgatcgagtgctggaacgttttcaggcatctggactaatagtgaaagagtggaatagtgtgaaactgcatgctacagttatgaatacactattcaggaaagaccccaatgctgaaggcaggtacaatctctacacagcggaaggcaaatatatcttcaaggaaagagaatcatttgatggccgaaatattttaaagttgtttgagaacttctactttggctccctaaagctgaattcaattcacatctctcagaggttcaccgtagacagctttggaaactacgcttcctgtggacaaattgacttctcctgaggtggatcttggaaagcactagaaactaaacatcttcaccaggtgctgaagaaaagtgtcttcgttttaattgccaagcagggatgtggacatttggatggtgactttcctgggtggttccccatagattcaccattgcctctaatggtgtctacacccgtcatactaccagctgagatggtggtgggcataaggagaatttgtgcctataacccttagtgtgttctggttttttttcttttaatttttaaattgtcgtaaaatactcataaaacatactgtcttcaccatttttaagtgcacagttcagtaacgttaactgttaatacattcataatgctgtgtggccgtcaccgccgtccatctccataggcttctcagcttgtaaaatggaaactgtacccattaaacagtaattcccactcctcccagcccccgcagccaccattctgctttctgtctctctggttttgactattctcagtatctcatataagtggaatcatacagtgacttgtctttttgtgactggcttatttcacttagcataatgtcctcaaggttcatccatgttgtgtcaggtgacaggatttccttcctgtattatacatataatggaatgttccgttacatgtgcgtaccacactctgttcctccatcagtgaacacttggcttgcttcctcttgactattgggagtagtgctaatacagacacgggggtgcaaatatctctttgagactctgcctttaattcctttaccacccagagttttatctttagcaaaataaccattaaagttgtttgcctttta

SEQ ID NO: 104035 - DNA, 2270 bp, Homo sapiens
  Payload ID: 457
  Gene Symbol: ASCC1
  Gene Name: activating signal cointegrator 1 complex subunit 1
  Uniprot ID: Q8N9N2
  ENST ID: ENST00000342444
  CDS Start-End: 103-1305
ctatcgcacgtctgctgcagcagtctcctgtttctcctcctaccttctccatttttctagtccctgcagggcataattggaatatcatttggagaaagtgtcatggaagttctgcgtccacagcttataagaattgatggccggaattacaggaagaatccagtccaagaacagacctatcaacatgaagaagatgaagaggacttctatcaaggctccatggagtgtgctgatgagccctgtgatgcctacgaggtggagcagaccccacaaggattccggtctactttgagggcccccagcttgctctataatctcattcacttgaacacatcaaacgactgtgggttccagaagataactttggattgtcagaatatttatacttggaagtccaggcatatagttggaaagagaggggacactaggaagaaaatagaaatggagaccaaaacttctattagcattcctaaacctggacaagacggggaaattgtaatcactggccagcatcgaaatggtgtaatttcagcccgaacacggattgatgttcttttggacacttttcgaagaaagcagcccttcactcacttccttgcctttttcctcaatgaagttgaggttcaggaaggattcctgagattccaggaggaagtactggcgaagtgctccatggatcatggggttgacagcagcattttccagaatcctaaaaagcttcatctaactattgggatgttggtgcttttgagtgaggaagagatccagcagacatgtgagatgctacagcagtgtaaagaggaattcattaatgatatttctgggggtaaacccctagaagtggagatggcagggatagaatacatgaatgatgatcctggcatggtggatgttctttacgccaaagtccatatgaaagatggctccaacaggctacaagaattagttgatcgagtgctggaacgttttcaggcatctggactaatagtgaaagagtggaatagtgtgaaactgcatgctacagttatgaatacactattcaggaaagaccccaatgctgaaggcaggtacaatctctacacagcggaaggcaaatatatcttcaaggaaagagaatcatttgatggccgaaatattttaaagagctttgccttgttgcccaggctggagtacaatgatgcaatctccgctcactgcaacctgtgcctcccgggttcaagtgattctcctgcctcagcctcccaagtagctgggattacaggtgtctctgatgcatattctcagagcctaccaggaaaatcctagaatcgagaagggcttgggacacagagagctagtggttgtttgagaacttctactttggctccctaaagctgaattcaattcacatctctcagaggttcaccgtagacagctttggaaactacgcttcctgtggacaaattgacttctcctgaggtggatcttggaaagcactagaaactaaacatcttcaccaggtgctgaagaaaagtgtcttcgttttaattgccaagcagggatgtggacatttggatggtgactttcctgggtggttccccatagattcaccattgcctctaatggtgtctacacccgtcatactaccagctgagatggtggtgggcataaggagaatttgtgcctataacccttagtgtgttctggttttttttcttttaatttttaaattgtcgtaaaatactcataaaacatactgtcttcaccatttttaagtgcacagttcagtaacgttaactgttaatacattcataatgctgtgtggccgtcaccgccgtccatctccataggcttctcagcttgtaaaatggaaactgtacccattaaacagtaattcccactcctcccagcccccgcagccaccattctgctttctgtctctctggttttgactattctcagtatctcatataagtggaatcatacagtgacttgtctttttgtgactggcttatttcacttagcataatgtcctcaaggttcatccatgttgtgtcaggtgacaggatttccttcctgtattatacatataatggaatgttccgttacatgtgcgtaccacactctgttcctccatcagtgaacacttggcttgcttcctcttgactattgggagtagtgctaatacagacacgggggtgcaaatatctctttgagactctgcctttaattcctttaccacccagagttttatctttagcaaaataaccattaaagttgtttgcctttta

SEQ ID NO: 104036 - DNA, 1510 bp, Homo sapiens
  Payload ID: 457
  Gene Symbol: ASCC1
  Gene Name: activating signal cointegrator 1 complex subunit 1
  Uniprot ID: Q8N9N2
  ENST ID: ENST00000394915
  CDS Start-End: 308-1510
ccccacccccaggaccagcctgagtggctgcgctcaccacgacgaggaccgcggcgtgttcgccccccaacagacggagccagcggcgaaggcggcgtgcgcgcgcccgtgccgtggtgggcgtggccggggcggagacgcgaggaggggagcagagaacgcgctcgcgtagaggaattccgggtcctcctcctcgccctaccttggtttacctgcagccgcctagtcctcttctccttctctttgatgattcagggcctcggcttccctcacgggcataattggaatatcatttggagaaagtgtcatggaagttctgcgtccacagcttataagaattgatggccggaattacaggaagaatccagtccaagaacagacctatcaacatgaagaagatgaagaggacttctatcaaggctccatggagtgtgctgatgagccctgtgatgcctacgaggtggagcagaccccacaaggattccggtctactttgagggcccccagcttgctctataatctcattcacttgaacacatcaaacgactgtgggttccagaagataactttggattgtcagaatatttatacttggaagtccaggcatatagttggaaagagaggggacactaggaagaaaatagaaatggagaccaaaacttctattagcattcctaaacctggacaagacggggaaattgtaatcactggccagcatcgaaatggtgtaatttcagcccgaacacggattgatgttcttttggacacttttcgaagaaagcagcccttcactcacttccttgcctttttcctcaatgaagttgaggttcaggaaggattcctgagattccaggaggaagtactggcgaagtgctccatggatcatggggttgacagcagcattttccagaatcctaaaaagcttcatctaactattgggatgttggtgcttttgagtgaggaagagatccagcagacatgtgagatgctacagcagtgtaaagaggaattcattaatgatatttctgggggtaaacccctagaagtggagatggcagggatagaatacatgaatgatgatcctggcatggtggatgttctttacgccaaagtccatatgaaagatggctccaacaggctacaagaattagttgatcgagtgctggaacgttttcaggcatctggactaatagtgaaagagtggaatagtgtgaaactgcatgctacagttatgaatacactattcaggaaagaccccaatgctgaaggcaggtacaatctctacacagcggaaggcaaatatatcttcaaggaaagagaatcatttgatggccgaaatattttaaagagctttgccttgttgcccaggctggagtacaatgatgcaatctccgctcactgcaacctgtgcctcccgggttcaagtgattctcctgcctcagcctcccaagtagctgggattacaggtgtctctgatgcatattctcagagcctaccaggaaaatcctag

SEQ ID NO: 104037 - DNA, 2683 bp, Homo sapiens
  Payload ID: 457
  Gene Symbol: ASCC1
  Gene Name: activating signal cointegrator 1 complex subunit 1
  Uniprot ID: Q8N9N2
  ENST ID: ENST00000394919
  CDS Start-End: 308-1381
ccccacccccaggaccagcctgagtggctgcgctcaccacgacgaggaccgcggcgtgttcgccccccaacagacggagccagcggcgaaggcggcgtgcgcgcgcccgtgccgtggtgggcgtggccggggcggagacgcgaggaggggagcagagaacgcgctcgcgtagaggaattccgggtcctcctcctcgccctaccttggtttacctgcagccgcctagtcctcttctccttctctttgatgattcagggcctcggcttccctcacgggcataattggaatatcatttggagaaagtgtcatggaagttctgcgtccacagcttataagaattgatggccggaattacaggaagaatccagtccaagaacagacctatcaacatgaagaagatgaagaggacttctatcaaggctccatggagtgtgctgatgagccctgtgatgcctacgaggtggagcagaccccacaaggattccggtctactttgagggcccccagcttgctctataagcatatagttggaaagagaggggacactaggaagaaaatagaaatggagaccaaaacttctattagcattcctaaacctggacaagacggggaaattgtaatcactggccagcatcgaaatggtgtaatttcagcccgaacacggattgatgttcttttggacacttttcgaagaaagcagcccttcactcacttccttgcctttttcctcaatgaagttgaggttcaggaaggattcctgagattccaggaggaagtactggcgaagtgctccatggatcatggggttgacagcagcattttccagaatcctaaaaagcttcatctaactattgggatgttggtgcttttgagtgaggaagagatccagcagacatgtgagatgctacagcagtgtaaagaggaattcattaatgatatttctgggggtaaacccctagaagtggagatggcagggatagaatacatgaatgatgatcctggcatggtggatgttctttacgccaaagtccatatgaaagatggctccaacaggctacaagaattagttgatcgagtgctggaacgttttcaggcatctggactaatagtgaaagagtggaatagtgtgaaactgcatgctacagttatgaatacactattcaggaaagaccccaatgctgaaggcaggtacaatctctacacagcggaaggcaaatatatcttcaaggaaagagaatcatttgatggccgaaatattttaaagttgtttgagaacttctactttggctccctaaagctgaattcaattcacatctctcagaggttcaccgtagacagctttggaaactacgcttcctgtggacaaattgacttctcctgaggtggatcttggaaagcactagaaactaaacatcttcaccaggtgctgaagaaaagtgtcttcgttttaattgccaagcagggatgtggacatttggatggtgactttcctgggtggttccccatagattcaccattgcctctaatggtgtctacacccgtcatactaccagctgagatggtggtgggcataaggagaatttgtgcctataacccttagtgtgttctggttttttttcttttaatttttaaattgtcgtaaaatactcataaaacatactgtcttcaccatttttaagtgcacagttcagtaacgttaactgttaatacattcataatgctgtgtggccgtcaccgccgtccatctccataggcttctcagcttgtaaaatggaaactgtacccattaaacagtaattcccactcctcccagcccccgcagccaccattctgctttctgtctctctggttttgactattctcagtatctcatataagtggaatcatacagtgacttgtctttttgtgactggcttatttcacttagcataatgtcctcaaggttcatccatgttgtgtcaggtgacaggatttccttcctgtattatacatataatggaatgttccgttacatgtgcgtaccacactctgttcctccatcagtgaacacttggcttgcttcctcttgactattgggagtagtgctaatacagacacgggggtgcaaatatctctttgagactctgcctttaattcctttaccacccagagttttatctttagcaaaataaccattaaagttgtttgccttttactttgcttggtctatcattttcctaccaaagtttgtcctcttaatatttgttggattcctgttccttcaccccatccccaccctcatcttcccatgcccctgatggagttgcagtgttgcagcccttttttgtttacttttcaaggcagcagcaaaagaaactgatgatatcagcaggactgtgcagagttccctggaagaatgtcagccacaggaggccctcactcctccctcaccacggaccagcagagggaggcgggaatgctggggagccccagcctcccacccctgcctcctcacattcttcctccctccatgtcctctccttcttctccttccttattcttgccttgattctttctctctttatattctttaactgcacttctgaactctgtgttaagttgctacattgtgaggactgtgtctaacagtgagatttattattgggactgcacaaatcacttgtgaataaaatgtttaacggtg

SEQ ID NO: 104038 - DNA, 548 bp, Homo sapiens
  Payload ID: 457
  Gene Symbol: ASCC1
  Gene Name: activating signal cointegrator 1 complex subunit 1
  ENST ID: ENST00000530461
  CDS Start-End: 177-548
ggggaaatttcctatcgcacgtctgctgcagcagtctcctgtttctcctcctaccttctccatttttctagtccctgcagcttataagaattgatggccggaattacaggaagaatccagtccaagaacagacctatcaacatgaagaagatgaagaggacttctatcaaggctccatggagtgtgctgatgagccctgtgatgcctacgaggtggagcagaccccacaaggattccggtctactttgagggcccccagcttgctctataagcatatagttggaaagagaggggacactaggaagaaaatagaaatggagaccaaaacttctattagcattcctaaacctggacaagacggggaaattgtaatcactggccagcatcgaaatggtgtaatttcagcccgaacacggattgatgttcttttggacacttttcgaagaaagcagcccttcactcacttccttgcctttttcctcaatgaagttgaggttcaggaaggattcctgagattccaggaggaagtactggcgaagtgctccatg

SEQ ID NO: 104039 - DNA, 1798 bp, Homo sapiens
  Payload ID: 457
  Gene Symbol: ASCC1
  Gene Name: activating signal cointegrator 1 complex subunit 1
  ENST ID: ENST00000486689
  CDS Start-End: 1-877
ctataagcatatagttggaaagagaggggacactaggaagaaaatagaaatggagaccaaaacttctattagcattcctaaacctggacaagacggggaaattgtaatcactggccagcatcgaaatggtgtaatttcagcccgaacacggattgatgttcttttggacacttttcgaagaaagcagcccttcactcacttccttgcctttttcctcaatgaagttgaggttcaggaaggattcctgagattccaggaggaagtactggcgaagtgctccatggatcatggggttgacagcagcattttccagaatcctaaaaagcttcatctaactattgggatgttggtgcttttgagtgaggaagagatccagcagacatgtgagatgctacagcagtgtaaagaggaattcattaatgatatttctgggggtaaacccctagaagtggagatggcagggatagaatacatgaatgatgatcctggcatggtggatgttctttacgccaaagtccatatgaaagatggctccaacaggctacaagaattagttgatcgagtgctggaacgttttcaggcatctggactaatagtgaaagagtggaatagtgtgaaactgcatgctacagttatgaatacactattcaggaaagaccccaatgctgaaggcaggtacaatctctacacagcggaaggcaaatatatcttcaaggaaagagaatcatttgatggccgaaatattttaaagagctttgccttgttgcccaggctggagtacaatgatgcaatctccgctcactgcaacctgtgcctcccgggttcaagtgattctcctgcctcagcctcccaagtagctgggattacagttgtttgagaacttctactttggctccctaaagctgaattcaattcacatctctcagaggttcaccgtagacagctttggaaactacgcttcctgtggacaaattgacttctcctgaggtggatcttggaaagcactagaaactaaacatcttcaccaggtgctgaagaaaagtgtcttcgttttaattgccaagcagggatgtggacatttggatggtgactttcctgggtggttccccatagattcaccattgcctctaatggtgtctacacccgtcatactaccagctgagatggtggtgggcataaggagaatttgtgcctataacccttagtgtgttctggttttttttcttttaatttttaaattgtcgtaaaatactcataaaacatactgtcttcaccatttttaagtgcacagttcagtaacgttaactgttaatacattcataatgctgtgtggccgtcaccgccgtccatctccataggcttctcagcttgtaaaatggaaactgtacccattaaacagtaattcccactcctcccagcccccgcagccaccattctgctttctgtctctctggttttgactattctcagtatctcatataagtggaatcatacagtgacttgtctttttgtgactggcttatttcacttagcataatgtcctcaaggttcatccatgttgtgtcaggtgacaggatttccttcctgtattatacatataatggaatgttccgttacatgtgcgtaccacactctgttcctccatcagtgaacacttggcttgcttcctcttgactattgggagtagtgctaatacagacacgggggtgcaaatatctctttgagactctgcctttaattcctttaccacccagagttttatctttagcaaaataaccattaaagttgtttgcctttt

SEQ ID NO: 104040 - DNA, 540 bp, Homo sapiens
  Payload ID: 457
  Gene Symbol: ASCC1
  Gene Name: activating signal cointegrator 1 complex subunit 1
  ENST ID: ENST00000526751
  CDS Start-End: 231-540
gacgcgaggaggggagcagagaacgcgctcgcgtagaggaattccgggtcctcctcctcgccctaccttggtttacctgcagccgcctagtcctcttctccttctctttgatgattcagggcctcggcttccctcacgatattgcagaaagacacagctttcctcttcctctccaaaccacctcgaagcagggttaaggcataattggaatatcatttggagaaagtgtcatggaagttctgcgtccacagcttataagaattgatggccggaattacaggaagaatccagtccaagaacagacctatcaacatgaagaagatgaagaggacttctatcaaggctccatggagtgtgctgatgagccctgtgatgcctacgaggtggagcagaccccacaaggattccggtctactttgagggcccccagcttgctctataagcatatagttggaaagagaggggacactaggaagaaaatagaaatggagaccaaaacttctattagcattcctaaacctggacaagacggggaaattg

SEQ ID NO: 104041 - DNA, 581 bp, Homo sapiens
  Payload ID: 457
  Gene Symbol: ASCC1
  Gene Name: activating signal cointegrator 1 complex subunit 1
  ENST ID: ENST00000524829
  CDS Start-End: 212-581
atgcgcactcggtcaaacccggcctggggaaatttcctatcgcacgtctgctgcagcagtctcctgtttctcctcctaccttctccatttttctagtccctgcagggcctcggcttccctcacgatattgcagaaagacacagctttcctcttcctctccaaaccacctcgaagcaggggcataattggaatatcatttggagaaagtgtcatggaagttctgcgtccacagcttataagaattgatggccggaattacaggaagaatccagtccaagaacagacctatcaacatgaagaagatgaagaggacttctatcaaggctccatggagtgtgctgatgagccctgtgatgcctacgaggtggagcagaccccacaaggattccggtctactttgagggcccccagcttgctctataagcatatagttggaaagagaggggacactaggaagaaaatagaaatggagaccaaaacttctattagcattcctaaacctggacaagacggggaaattgtaatcactggccagcatcgaaatggtgtaatttcagcccgaacacggattgatgttcttt

SEQ ID NO: 104042 - DNA, 599 bp, Homo sapiens
  Payload ID: 457
  Gene Symbol: ASCC1
  Gene Name: activating signal cointegrator 1 complex subunit 1
  ENST ID: ENST00000533958
  CDS Start-End: 431-599
ctatcgcacgtctgctgcagcagtctcctgtttctcctcctaccttctccatttttctagtccctgcagccccacccccaggaccagcctgagtggctgcgctcaccacgacgaggaccgcggcgtgttcgccccccaacagacggagccagcggcgaaggcggcgtgcgcgcgcccgtgccgtggtgggcgtggccggggcggagacgcgaggaggggagcagagaacgcgctcgcgtagaggaattccgggtcctcctcctcgccctaccttggtttacctgcagccgcctagtcctcttctccttctctttgatgattcagggcctcggcttccctcacgatattgcagaaagacacagctttcctcttcctctccaaaccacctcgaagcaggggcataattggaatatcatttggagaaagtgtcatggaagttctgcgtccacagcttataagaattgatggccggaattacaggaagaatccagtccaagaacagacctatcaacatgaagaagatgaagaggacttctatcaaggctccatggagtgtgctgatgagccctgtgatgcctacgaggtggagcagaccccac

SEQ ID NO: 104043 - DNA, 580 bp, Homo sapiens
  Payload ID: 457
  Gene Symbol: ASCC1
  Gene Name: activating signal cointegrator 1 complex subunit 1
  ENST ID: ENST00000527593
  CDS Start-End: 124-580
cctatcgcacgtctgctgcagcagtctcctgtttctcctcctaccttctccatttttctagtccctgcagatggtaattatatttttcagggcataattggaatatcatttggagaaagtgtcatggaagttctgcgtccacagcttataagaattgatggccggaattacaggaagaatccagtccaagaacagacctatcaacatgaagaagatgaagaggacttctatcaaggctccatggagtgtgctgatgagccctgtgatgcctacgaggtggagcagaccccacaaggattccggtctactttgagggcccccagcttgctctataagcatatagttggaaagagaggggacactaggaagaaaatagaaatggagaccaaaacttctattagcattcctaaacctggacaagacggggaaattgtaatcactggccagcatcgaaatggtgtaatttcagcccgaacacggattgatgttcttttggacacttttcgaagaaagcagcccttcactcacttccttgcctttttcctcaatgaagttgaggttcaggaaggattcctgagat

SEQ ID NO: 104044 - DNA, 569 bp, Homo sapiens
  Payload ID: 457
  Gene Symbol: ASCC1
  Gene Name: activating signal cointegrator 1 complex subunit 1
  ENST ID: ENST00000532011
  CDS Start-End: 110-241
aaatttcctatcgcacgtctgctgcagcagtctcctgtttctcctcctaccttctccatttttctagtccctgcagggcataattggaatatcatttggagaaagtgtcatggaagttctgcgtccacagcttataagaattgatggccggaattacaggaagaatccagtccaagaacagacctatcaacatgaagaagatgaagaggacttctatcaaggctggagtgcagtggcgtgatctgggctctctgcaacctctacctcccgggttcaagcaattctcctgcctcatcttccccagtagctggaactacaggctccatggagtgtgctgatgagccctgtgatgcctacgaggtggagcagaccccacaaggattccggtctactttgagggcccccagcttgctctataagcatatagttggaaagagaggggacactaggaagaaaatagaaatggagaccaaaacttctattagcattcctaaacctggacaagacggggaaattgtaatcactggccagcatcgaaatggtgtaatttcagcccgaacacggattga

SEQ ID NO: 104045 - DNA, 527 bp, Homo sapiens
  Payload ID: 457
  Gene Symbol: ASCC1
  Gene Name: activating signal cointegrator 1 complex subunit 1
  ENST ID: ENST00000525286
  CDS Start-End: 1-527
taatcactggccagcatcgaaatggtgtaatttcagcccgaacacggattgatgttcttttggacacttttcgaagaaagcagcccttcactcacttccttgcctttttcctcaatgaagttgaggttcaggaaggattcctgagattccaggaggaagtactggcgaagtgctccatggatcatggggttgacagcagcattttccagaatcctaaaaagcttcatctaactattgggatgttggtgcttttgagtgaggaagagatccagcagacatgtgagatgctacagcagtgtaaagaggaattcattaagctacaagaattagttgatcgagtgctggaacgttttcaggcatctggactaatagtgaaagagtggaatagtgtgaaactgcatgctacagttatgaatacactattcaggaaagaccccaatgctgaaggcaggtacaatctctacacagcggaaggcaaatatatcttcaaggaaagagaatcatttgatggccgaaatattttaaag

SEQ ID NO: 104046 - DNA, 640 bp, Homo sapiens
  Payload ID: 457
  Gene Symbol: ASCC1
  Gene Name: activating signal cointegrator 1 complex subunit 1
  ENST ID: ENST00000461369
  CDS Start-End: 1-211
tctcattcacttgaacacatcaaacgactgtgggttccagaagataactttggattgtcagaatatttatacttggaagtccaggcatatagttggaaagagaggggacactaggaagaaaatagaaatggagaccaaaacttctattagcattcctaaacctggacaagacggggaaattgagaaatcagagaaggaaatgatctggtagcttttaatcctctagacaaggatctggtcttgtctgttttgaaatctcaggcaatggaacatcagaagcttctccacctccaaccactgtagagacagagtttcagtaaattgcctaggctgtctggaactcctggcctcaggcaatcctcctgccttggcctttgccccagagtgctgggattacagtaatcactggccagcatcgaaatggtgtaatttcagcccgaacacggattgatgttcttttggacacttttcgaagaaagcagcccttcactcacttccttgcctttttcctcaatgaagttgaggttcaggaaggattcctgagattccaggaggaagtactggcgaagtgctccatggatcatggggttgacagcagcattttccagaatcctaaaaagcttcatctaactattgggat

SEQ ID NO: 104047 - DNA, 450 bp, Homo sapiens
  Payload ID: 457
  Gene Symbol: ASCC1
  Gene Name: activating signal cointegrator 1 complex subunit 1
  ENST ID: ENST00000531048
  CDS Start-End: 34-450
ggcataattggaatatcatttggagaaagtgtcatggaagttctgcgtccacagcttataagaattgatggccggaattacaggaagaatccagtccaagaacagacctatcaacatgaagaagatgaagaggacttctatcaagtaatcactggccagcatcgaaatggtgtaatttcagcccgaacacggattgatgttcttttggacacttttcgaagaaagcagcccttcactcacttccttgcctttttcctcaatgaagttgaggttcaggaaggattcctgagattccaggaggaagtactggcgaagtgctccatggatcatggggttgacagcagcattttccagaatcctaaaaagcttcatctaactattgggatgttggtgcttttgagtgaggaagagatccagcagacatgtgagatgctacagcagtgtaaagag

SEQ ID NO: 104048 - DNA, 839 bp, Homo sapiens
  Payload ID: 457
  Gene Symbol: ASCC1
  Gene Name: activating signal cointegrator 1 complex subunit 1
  ENST ID: ENST00000530394
  CDS Start-End: 1-437
gtaaagaggaattcattaatgatatttctgggggtaaacccctagaagtggagatggcagggatagaatacatgaatgatgatcctggcatggtggatgttctttacgccaaagtccatatgaaagatggctccaacaggctacaagaattagttgatcgagtgctggaacgttttcaggcatctggactaatagtgaaagagtggaatagtgtgaaactgcatgctacagttatgaatacactattcaggaaagaccccaatgctgaaggcaggtacaatctctacacagcggaaggcaaatatatcttcaaggaaagagaatcatttgatggccgaaatattttaaaggtgtctctgatgcatattctcagagcctaccaggaaaatcctagaatcgagaagggcttgggacacagagagctagtggttgtttgagaacttctactttggctccctaaagctgaattcaattcacatctctcagaggttcaccgtagacagctttggaaactacgcttcctgtggacaaattgacttctcctgaggtggatcttggaaagcactagaaactaaacatcttcaccaggtgctgaagaaaagtgtcttcgttttaattgccaagcagggatgtggacatttggatggtgactttcctgggtggttccccatagattcaccattgcctctaatggtgtctacacccgtcatactaccagctgagatggtggtgggcataaggagaatttgtgcctataacccttagtgtgttctggttttttttcttttaatttttaaattgtcgtaaaatactcataaaacatactgtcttcaccattt

SEQ ID NO: 104049 - DNA, 2793 bp, Homo sapiens
  Payload ID: 458
  Gene Symbol: ASCC2
  Gene Name: activating signal cointegrator 1 complex subunit 2
  Uniprot ID: Q9H1I8
  ENST ID: ENST00000307790
  CDS Start-End: 115-2388
agtttgaccccggaagtgcgggcgctcagggagctgtcaccgtggtcggcggcggcggcggcggcggcggcacagagccggtggtggagccgccgaggagggtcacgcagcacaatgccagctctgcccctggaccaactccagatcacccacaaggacccgaagacaggaaagctgaggacttcaccagcgctgcaccccgagcagaaggcagaccggtattttgtgttatacaaaccgccccctaaagacaacattcccgccctagtggaggagtacctggaacgcgccaccttcgtagccaatgacctcgactggctcctggccttgcctcacgataaattctggtgccaggtgatctttgacgagactctacagaagtgcctggactcctacctgcgctatgtcccccgcaaattcgacgagggggtggcctcagcccctgaggttgttgacatgcagaagcgcctccatcgaagtgtttttctcaccttcctccgcatgtccactcacaaggaatccaaagatcacttcatttccccttctgcgtttggagaaatcctctacaataacttcctctttgacattccaaagatcctggacctctgcgtgctctttggaaaaggcaactcaccactgctccagaagatgataggaaacatctttacacagcagccaagttactacagtgacctggatgaaaccctgcctaccatccttcaggtcttcagcaatatcctccagcactgtggtttgcaaggggacggggccaataccacaccccagaagcttgaggagaggggccgattgacccccagtgacatgcctctcctggaattaaaggacattgttctctacctttgtgatacctgcaccacactttgggcctttctggatatcttccctttggcttgccagaccttccagaagcacgacttttgttacagactagcttccttctacgaagcagcaattcccgaaatggagtctgcaattaagaagaggaggcttgaagatagcaagcttcttggtgacctgtggcagaggctctcccattccaggaagaagctaatggagattttccacatcatcctgaaccagatctgcctccttcccatcctagaaagcagctgtgacaacattcagggcttcatcgaagagttccttcagatcttcagctccttgctgcaggagaagaggttcctccgggactatgatgcactcttccccgtggccgaagacatcagcttgctgcagcaggcctcatcagtcttggacgagacgcggactgcctacatcctccaggcagtcgagagtgcatgggaaggggtggacagacggaaagccacagatgctaaagacccatcggtgattgaggagcctaatggggagcctaacggggtcacggtgacagcagaggcagtcagtcaagcatcatcacatccggagaactcggaggaagaggagtgcatgggagcagccgcggctgtgggccctgccatgtgtggggtggaactggactctctcatctcccaagtgaaggacctgctgccagaccttggtgagggcttcatcctggcctgcctggagtactaccactacgacccagagcaggtgatcaacaatatcctggaggagcggctggcccccaccctcagccagctggaccgcaacctagacagagaaatgaaaccagaccctacacccctgctgacgtctcgccacaacgtcttccagaatgacgagtttgatgtgttcagcagggactcagtagacctgagccgggtgcacaagggcaagagcaccaggaaggaggaaaacacgcggagtttgctgaacgacaagcgtgcagtggcggcacagcggcagcgctacgagcagtacagcgtggtggtggaggaggtgccactgcagccaggcgagagcctgccctaccacagtgtctactacgaggatgagtacgatgacacatacgatggcaaccaggtgggcgccaatgatgcagactctgatgacgagctcatcagccgcaggccattcaccatccctcaggtgctgagaaccaaagtgcctagagaagggcaggaggaggatgacgacgatgaggaagacgatgctgacgaggaggctcccaagcccgaccattttgttcaggaccctgcagtgctgagagagaaggcagaagccaggcgcatggcctttctcgccaagaaagggtaccggcatgacagctcaacagcagtggccggcagcccccgaggccatgggcagagccgcgagacaacccaggaacgcaggaagaaggaagccaacaaggcgacaagagccaaccacaaccggagaaccatggccgaccgcaagaggagcaaaggcatgatcccatcctgagacctggtgcagggccagtggggaggcagcggcaccagactcaccaggccgtgctcccatcgcctggggcctcctcactaggggccccaagttcaactcaacccctcaacagcctcagctttgcagcccctgagaaggccgcctctcatctaccagccagccatgagcgccttcctgcagaacacacagtgccttatgccacagccgaagaatccgtggggccggcaagcaggcaccttcccccagctgcgctagcgggaaagagatggggatggagtcccaaggcaagcgccccaaacctcgggccacaagacaccacttcccctttaccctggacagcaggaaacctgtatattcaaaaacacaaaaagtcctgctaataaaatttttgaccctttcaaacga

SEQ ID NO: 104050 - DNA, 2823 bp, Homo sapiens
  Payload ID: 458
  Gene Symbol: ASCC2
  Gene Name: activating signal cointegrator 1 complex subunit 2
  Uniprot ID: Q9H1I8
  ENST ID: ENST00000397771
  CDS Start-End: 179-2452
gcagtttgaccccggaagtgcgggcgctcagggagctgtcaccgtggtcggcggcggcggcggcggcggcggcacagagccggtggtggagccgccgaggccacctcgtgtatgcagagaccatgtgtgtctgatctgctgggatcctagagctggaacaggagggtcacgcagcacaatgccagctctgcccctggaccaactccagatcacccacaaggacccgaagacaggaaagctgaggacttcaccagcgctgcaccccgagcagaaggcagaccggtattttgtgttatacaaaccgccccctaaagacaacattcccgccctagtggaggagtacctggaacgcgccaccttcgtagccaatgacctcgactggctcctggccttgcctcacgataaattctggtgccaggtgatctttgacgagactctacagaagtgcctggactcctacctgcgctatgtcccccgcaaattcgacgagggggtggcctcagcccctgaggttgttgacatgcagaagcgcctccatcgaagtgtttttctcaccttcctccgcatgtccactcacaaggaatccaaagatcacttcatttccccttctgcgtttggagaaatcctctacaataacttcctctttgacattccaaagatcctggacctctgcgtgctctttggaaaaggcaactcaccactgctccagaagatgataggaaacatctttacacagcagccaagttactacagtgacctggatgaaaccctgcctaccatccttcaggtcttcagcaatatcctccagcactgtggtttgcaaggggacggggccaataccacaccccagaagcttgaggagaggggccgattgacccccagtgacatgcctctcctggaattaaaggacattgttctctacctttgtgatacctgcaccacactttgggcctttctggatatcttccctttggcttgccagaccttccagaagcacgacttttgttacagactagcttccttctacgaagcagcaattcccgaaatggagtctgcaattaagaagaggaggcttgaagatagcaagcttcttggtgacctgtggcagaggctctcccattccaggaagaagctaatggagattttccacatcatcctgaaccagatctgcctccttcccatcctagaaagcagctgtgacaacattcagggcttcatcgaagagttccttcagatcttcagctccttgctgcaggagaagaggttcctccgggactatgatgcactcttccccgtggccgaagacatcagcttgctgcagcaggcctcatcagtcttggacgagacgcggactgcctacatcctccaggcagtcgagagtgcatgggaaggggtggacagacggaaagccacagatgctaaagacccatcggtgattgaggagcctaatggggagcctaacggggtcacggtgacagcagaggcagtcagtcaagcatcatcacatccggagaactcggaggaagaggagtgcatgggagcagccgcggctgtgggccctgccatgtgtggggtggaactggactctctcatctcccaagtgaaggacctgctgccagaccttggtgagggcttcatcctggcctgcctggagtactaccactacgacccagagcaggtgatcaacaatatcctggaggagcggctggcccccaccctcagccagctggaccgcaacctagacagagaaatgaaaccagaccctacacccctgctgacgtctcgccacaacgtcttccagaatgacgagtttgatgtgttcagcagggactcagtagacctgagccgggtgcacaagggcaagagcaccaggaaggaggaaaacacgcggagtttgctgaacgacaagcgtgcagtggcggcacagcggcagcgctacgagcagtacagcgtggtggtggaggaggtgccactgcagccaggcgagagcctgccctaccacagtgtctactacgaggatgagtacgatgacacatacgatggcaaccaggtgggcgccaatgatgcagactctgatgacgagctcatcagccgcaggccattcaccatccctcaggtgctgagaaccaaagtgcctagagaagggcaggaggaggatgacgacgatgaggaagacgatgctgacgaggaggctcccaagcccgaccattttgttcaggaccctgcagtgctgagagagaaggcagaagccaggcgcatggcctttctcgccaagaaagggtaccggcatgacagctcaacagcagtggccggcagcccccgaggccatgggcagagccgcgagacaacccaggaacgcaggaagaaggaagccaacaaggcgacaagagccaaccacaaccggagaaccatggccgaccgcaagaggagcaaaggcatgatcccatcctgagacctggtgcagggccagtggggaggcagcggcaccagactcaccaggccgtgctcccatcgcctggggcctcctcactaggggccccaagttcaactcaacccctcaacagcctcagctttgcagcccctgagaaggccgcctctcatctaccagccagccatgagcgccttcctgcagaacacacagtgccttatgccacagccgaagaatccgtggggccggcaagcaggcaccttcccccagctgcgctagcgggaaagagatggggatggagtcccaaggcaagcgccccaaacctcgggccacaagacaccacttcccctttaccctggacagcaggaaacctgtatattcaaaaacacaaaaag

SEQ ID NO: 104051 - DNA, 580 bp, Homo sapiens
  Payload ID: 458
  Gene Symbol: ASCC2
  Gene Name: activating signal cointegrator 1 complex subunit 2
  ENST ID: ENST00000449900
  CDS Start-End: 249-485
tttgaccccggaagtgcgggcgctcagggagctgtcaccgtggtcggcggcggcggcggcggcggcggcacagagccggtggtggagccgccgaggccacctcgtgtatgcagagaccatgtgtgtctgatctgctgggatcctagagctggaacaggccaagtgatattgtgaaaagaacactggacagcaagacaggagaccttggatctgccactcactgactgtgaggagggtcacgcagcacaatgccagctctgcccctggaccaactccagatcacccacaaggacccgaagacaggaaagctgaggacttcaccagcgctggaaacatctttacacagcagccaagttactacagtgacctggatgaaaccctgcctaccatccttcaggtcttcagcaatatcctccagcactgtggtttgcaaggggacggggccaataccacaccccagaagcttgaggagaggggccgattgacccccagtgacatgcctctcctggaattaaaggacattgttctctacctttgtgatacctgcaccacactttgggcctttctggatatcttccct

SEQ ID NO: 104052 - DNA, 2753 bp, Homo sapiens
  Payload ID: 458
  Gene Symbol: ASCC2
  Gene Name: activating signal cointegrator 1 complex subunit 2
  ENST ID: ENST00000458594
  CDS Start-End: 80-193
gccacctcgtgtatgcagagaccatgtgtgtctgatctgctgggatcctagagctggaacaggagggtcacgcagcacaatgccagctctgcccctggaccaactccagatcacccacaaggacccgaagacaggaaagctgaggacttcaccagcgctgatttgtacctgtaactccatgatacaaatttgatttaaatgggagggggtcctgcagacccacatgagaggtggccttgaagaatccttgtggtacccacaggctctacagtttggaaactcgccaccccgagcagaaggcagaccggtattttgtgttatacaaaccgccccctaaagacaacattcccgccctagtggaggagtacctggaacgcgccaccttcgtagccaatgacctcgactggctcctggccttgcctcacgataaattctggtgccaggtgatctttgacgagactctacagaagtgcctggactcctacctgcgctatgtcccccgcaaattcgacgagggggtggcctcagcccctgaggttgttgacatgcagaagcgcctccatcgaagtgtttttctcaccttcctccgcatgtccactcacaaggaatccaaagatcacttcatttccccttctgcgtttggagaaatcctctacaataacttcctctttgacattccaaagatcctggacctctgcgtgctctttggaaaaggcaactcaccactgctccagaagatgataggaaacatctttacacagcagccaagttactacagtgacctggatgaaaccctgcctaccatccttcaggtcttcagcaatatcctccagcactgtggtttgcaaggggacggggccaataccacaccccagaagcttgaggagaggggccgattgacccccagtgacatgcctctcctggaattaaaggacattgttctctacctttgtgatacctgcaccacactttgggcctttctggatatcttccctttggcttgccagaccttccagaagcacgacttttgttacagactagcttccttctacgaagcagcaattcccgaaatggagtctgcaattaagaagaggaggcttgaagatagcaagcttcttggtgacctgtggcagaggctctcccattccaggaagaagctaatggagattttccacatcatcctgaaccagatctgcctccttcccatcctagaaagcagctgtgacaacattcagggcttcatcgaagagttccttcagatcttcagctccttgctgcaggagaagaggttcctccgggactatgatgcactcttccccgtggccgaagacatcagcttgctgcagcaggcctcatcagtcttggacgagacgcggactgcctacatcctccaggcagtcgagagtgcatgggaaggggtggacagacggaaagccacagatgctaaagacccatcggtgattgaggagcctaatggggagcctaacggggtcacggtgacagcagaggcagtcagtcaagcatcatcacatccggagaactcggaggaagaggagtgcatgggagcagccgcggctgtgggccctgccatgtgtggggtggaactggactctctcatctcccaagtgaaggacctgctgccagaccttgagaaatgaaaccagaccctacacccctgctgacgtctcgccacaacgtcttccagaatgacgagtttgatgtgttcagcagggactcagtagacctgagccgggtgcacaagggcaagagcaccaggaaggaggaaaacacgcggagtttgctgaacgacaagcgtgcagtggcggcacagcggcagcgctacgagcagtacagcgtggtggtggaggaggtgccactgcagccaggcgagagcctgccctaccacagtgtctactacgaggatgagtacgatgacacatacgatggcaaccaggtgggcgccaatgatgcagactctgatgacgagctcatcagccgcaggccattcaccatccctcaggtgctgagaaccaaagtgcctagagaagggcaggaggaggatgacgacgatgaggaagacgatgctgacgaggaggctcccaagcccgaccattttgttcaggaccctgcagtgctgagagagaaggcagaagccaggcgcatggcctttctcgccaagaaagggtaccggcatgacagctcaacagcagtggccggcagcccccgaggccatgggcagagccgcgagacaacccaggaacgcaggaagaaggaagccaacaaggcgacaagagccaaccacaaccggagaaccatggccgaccgcaagaggagcaaaggcatgatcccatcctgagacctggtgcagggccagtggggaggcagcggcaccagactcaccaggccgtgctcccatcgcctggggcctcctcactaggggccccaagttcaactcaacccctcaacagcctcagctttgcagcccctgagaaggccgcctctcatctaccagccagccatgagcgccttcctgcagaacacacagtgccttatgccacagccgaagaatccgtggggccggcaagcaggcaccttcccccagctgcgctagcgggaaagagatggggatggagtcccaaggcaagcgccccaaacctcgggccacaagacaccacttcccctttaccctggacagcaggaaacctgtatattcaaaaacacaaaaagtcctgctaataaaatttttgaccctt

SEQ ID NO: 104053 - DNA, 469 bp, Homo sapiens
  Payload ID: 458
  Gene Symbol: ASCC2
  Gene Name: activating signal cointegrator 1 complex subunit 2
  ENST ID: ENST00000454854
  CDS Start-End: 178-291
agtttgaccccggaagtgcgggcgctcagggagctgtcaccgtggtcggcggcggcggcggcggcggcggcacagagccggtggtggagccgccgaggttatcatcatctctttctggtcatgtctgtctcatacttaaatgactcctcactgccttcaggagggtcacgcagcacaatgccagctctgcccctggaccaactccagatcacccacaaggacccgaagacaggaaagctgaggacttcaccagcgctgatttgtacctgtaactccatgatacaaatttgatttaaatgggagggggtcctgcagacccacatgagaggtggccttgaagaatccttgtggtacccacaggctctacagtttggaaactcgccaccccgagcagaaggcagaccggtattttgtgttatacaaaccgccccctaaagacaacattcccgccctagtggaggagtacctg

SEQ ID NO: 104054 - DNA, 529 bp, Homo sapiens
  Payload ID: 458
  Gene Symbol: ASCC2
  Gene Name: activating signal cointegrator 1 complex subunit 2
  ENST ID: ENST00000453160
  CDS Start-End: 1-163
aagtgcgggcgctcagggagctgtcaccgtggtcggcggcggcggcggcggcggcggcacagagccggtggtggagccgccgaggccacctcgtgtatgcagagaccatgtgtgtctgatctgctgggatcctagagctggaacaggccaagtgatattgtgaaaagaacactggacagcaagacaggagaccttggatctgccactcactgactgtgagcaccccgagcagaaggcagaccggtattttgtgttatacaaaccgccccctaaagacaacattcccgccctagtggaggagtacctggaacgcgccaccttcgtagccaatgacctcgactggctcctggccttgcctcacgataaattctggtgccaggtgatctttgacgagactctacagaagtgcctggactcctacctgcgctatgtcccccgcaaattcgacgagggggtggcctcagcccctgaggttgttgacatgcagaagcgcctccatcgaagtgtttttctcaccttcctccgcatg

SEQ ID NO: 104055 - DNA, 873 bp, Homo sapiens
  Payload ID: 458
  Gene Symbol: ASCC2
  Gene Name: activating signal cointegrator 1 complex subunit 2
  ENST ID: ENST00000431535
  CDS Start-End: 154-873
gccacctcgtgtatgcagagaccatgtgtgtctgatctgctgggatcctagagctggaacaggccaagtgatattgtgaaaagaacactggacagcaagacaggagaccttggatctgccactcactgactgtgaggagggtcacgcagcacaatgccagctctgcccctggaccaactccagatcacccacaaggacccgaagacaggaaagctgaggacttcaccagcgctgcaccccgagcagaaggcagaccggtattttgtgttatacaaaccgccccctaaagacaacattcccgccctagtggaggagtacctggaacgcgccaccttcgtagccaatgacctcgactggctcctggccttgcctcacgataaattctggtgccaggtgatctttgacgagactctacagaagtgcctggactcctacctgcgctatgtcccccgcaaattcgacgagggggtggcctcagcccctgaggttgttgacatgcagaagcgcctccatcgaagtgtttttctcaccttcctccgcatgtccactcacaaggaatccaaagatcacttcatttccccttctgcgtttggagaaatcctctacaataacttcctctttgacattccaaagatcctggacctctgcgtgctctttggaaaaggcaactcaccactgctccagaagatgataggaaacatctttacacagcagccaagttactacagtgacctggatgaaaccctgcctaccatccttcaggtcttcagcaatatcctccagcactgtggtttgcaaggggacggggccaataccacaccccagaagcttgaggagaggggccgattgacccccagtgacatgcctctcctg

SEQ ID NO: 104056 - DNA, 261 bp, Homo sapiens
  Payload ID: 458
  Gene Symbol: ASCC2
  Gene Name: activating signal cointegrator 1 complex subunit 2
  ENST ID: ENST00000411532
  CDS Start-End: 1-261
tcctggcctgcctggagtactaccactacgacccagagcagagaaatgaaaccagaccctacacccctgctgacgtctcgccacaacgtcttccagaatgacgagtttgatgtgttcagcagggactcagtagacctgagccgggtgcacaagggcaagagcaccaggaaggaggaaaacacgcggagtttgctgaacgacaagcgtgcagtggcggcacagcggcagcgctacgagcagtacagcgtggtggtggaggag

SEQ ID NO: 104057 - DNA, 2594 bp, Homo sapiens
  Payload ID: 458
  Gene Symbol: ASCC2
  Gene Name: activating signal cointegrator 1 complex subunit 2
  Uniprot ID: Q9H1I8
  ENST ID: ENST00000542393
  CDS Start-End: 145-2190
gagacttcctgtctgctcctgcggaatcgcagtttgaccccggaagtgcgggcgctcagggagctgtcaccgtggtcggcggcggcggcggcggcggcggcacagagccggtggtggagccgccgaggagggtcacgcagcacaatgccagctctgcccctggaccaactccagatcacccacaaggacccgaagacaggaaagctgaggacttcaccagcgctggtgatctttgacgagactctacagaagtgcctggactcctacctgcgctatgtcccccgcaaattcgacgagggggtggcctcagcccctgaggttgttgacatgcagaagcgcctccatcgaagtgtttttctcaccttcctccgcatgtccactcacaaggaatccaaaatcctggacctctgcgtgctctttggaaaaggcaactcaccactgctccagaagatgataggaaacatctttacacagcagccaagttactacagtgacctggatgaaaccctgcctaccatccttcaggtcttcagcaatatcctccagcactgtggtttgcaaggggacggggccaataccacaccccagaagcttgaggagaggggccgattgacccccagtgacatgcctctcctggaattaaaggacattgttctctacctttgtgatacctgcaccacactttgggcctttctggatatcttccctttggcttgccagaccttccagaagcacgacttttgttacagactagcttccttctacgaagcagcaattcccgaaatggagtctgcaattaagaagaggaggcttgaagatagcaagcttcttggtgacctgtggcagaggctctcccattccaggaagaagctaatggagattttccacatcatcctgaaccagatctgcctccttcccatcctagaaagcagctgtgacaacattcagggcttcatcgaagagttccttcagatcttcagctccttgctgcaggagaagaggttcctccgggactatgatgcactcttccccgtggccgaagacatcagcttgctgcagcaggcctcatcagtcttggacgagacgcggactgcctacatcctccaggcagtcgagagtgcatgggaaggggtggacagacggaaagccacagatgctaaagacccatcggtgattgaggagcctaatggggagcctaacggggtcacggtgacagcagaggcagtcagtcaagcatcatcacatccggagaactcggaggaagaggagtgcatgggagcagccgcggctgtgggccctgccatgtgtggggtggaactggactctctcatctcccaagtgaaggacctgctgccagaccttggtgagggcttcatcctggcctgcctggagtactaccactacgacccagagcaggtgatcaacaatatcctggaggagcggctggcccccaccctcagccagctggaccgcaacctagacagagaaatgaaaccagaccctacacccctgctgacgtctcgccacaacgtcttccagaatgacgagtttgatgtgttcagcagggactcagtagacctgagccgggtgcacaagggcaagagcaccaggaaggaggaaaacacgcggagtttgctgaacgacaagcgtgcagtggcggcacagcggcagcgctacgagcagtacagcgtggtggtggaggaggtgccactgcagccaggcgagagcctgccctaccacagtgtctactacgaggatgagtacgatgacacatacgatggcaaccaggtgggcgccaatgatgcagactctgatgacgagctcatcagccgcaggccattcaccatccctcaggtgctgagaaccaaagtgcctagagaagggcaggaggaggatgacgacgatgaggaagacgatgctgacgaggaggctcccaagcccgaccattttgttcaggaccctgcagtgctgagagagaaggcagaagccaggcgcatggcctttctcgccaagaaagggtaccggcatgacagctcaacagcagtggccggcagcccccgaggccatgggcagagccgcgagacaacccaggaacgcaggaagaaggaagccaacaaggcgacaagagccaaccacaaccggagaaccatggccgaccgcaagaggagcaaaggcatgatcccatcctgagacctggtgcagggccagtggggaggcagcggcaccagactcaccaggccgtgctcccatcgcctggggcctcctcactaggggccccaagttcaactcaacccctcaacagcctcagctttgcagcccctgagaaggccgcctctcatctaccagccagccatgagcgccttcctgcagaacacacagtgccttatgccacagccgaagaatccgtggggccggcaagcaggcaccttcccccagctgcgctagcgggaaagagatggggatggagtcccaaggcaagcgccccaaacctcgggccacaagacaccacttcccctttaccctggacagcaggaaacctgtatattcaaaaacacaaaaagtcctgctaataaaatttttgaccctttcaaacg

SEQ ID NO: 104058 - DNA, 3618 bp, Homo sapiens
  Payload ID: 459
  Gene Symbol: ASCC3
  Gene Name: activating signal cointegrator 1 complex subunit 3
  ENST ID: ENST00000324696
  CDS Start-End: 354-500
ggcgctgcagcggggcggtgacgtgtaggccggcgccagctccactctgtccctcctcgccgggtctgtgcgtctttgcgtctgtctgtctgactgatggtcctcacacgcggttccctgtgactgggcgcgaccccggcaagcgcggcttggagggcggacggggcgcggcgatacagctgcccgctcgcatctttggccctgcgctcagctcctcacccggcgtgggaagttaaagtaaaaccgaaagggaagaaggcgcggtggcaggagctgacagagtgatgggaaacgcgtgagccaggccgagagtttcaggtttcttgctgtatggatcactgattgaataatagatggctttacctcgtctcacaggagccttgcgttccttttcaaatgtcaccaagcaagataattataatgaagaagtggctgacttaaagttggaactgataatgggagagaagcaattgaaagtggggctgcatttctcttcatgacatttcacttgaaggactctgttggtcacaaggaaacaaaggctatcaaacagatgtttggcccctttccttcatcatctgccactgcagcttgtaatgctactaatcgaattatttctcattttagtcaagatgatcttactgctcttgtgcagatgacagaaaaagaacatggcgatagggttttttttggtaaaaatttagcattttcatttgacatgcatgatttggaccactttgacgaactgccaataaatggtgaaactcagaaaactataagcctagattataagaagtttctgaatgaacatctccaggaggcttgcaccccagaactcaagcctgtggaaaaaacaaatggctcctttttgtggtgtgaagttgaaaagtacctaaattcaactttgaaggaaatgactgaagtgccaagagtagaagatctttgctgtactttatatgatatgcttgcttctattaaaagtggtgatgaacttcaggatgagctatttgaactgctgggacctgaaggacttgaacttattgagaaactcctccagaacagaattacaattgtggatagatttcttaattcttcaaatgatcataggtttcaggctcttcaagacaattgtaaaaaaattttaggagaaaatgctaaacccaattatggttgtcaagtcactattcagtctgaacaagaaaagcagttaatgaaacaatatcgacgtgaagaaaaaagaattgccagacgagaaaaaaaggctggagaagatttagaagtttcagaaggacttatgtgctttgatcctaaggaattgcggatacaaagagaacaggcacttctgaatgctagaagtgttccaattctgagcaggcagagagatgcagacgttgaaaaaatacattatccccatgtgtatgattcccaggctgaagccatgaaaacatcagcatttattgctggtgcaaagatgattttgccagaaggaatccaaagagagaataacaagctttatgaagaagtaaggattccctacagcgaaccaatgccactcagctttgaggaaaagccagtttatatccaagacttagatgagatcggacagctggcttttaaaggaatgaagagactcaatagaatccagtcaatagtgtttgagactgcctacaacaccaatgagaacatgctgatttgtgcccctacaggagctggaaaaaccaacattgcaatgctgacagtcttgcatgaaattcgccaacattttcaacaaggtgttatcaaaaagaatgaatttaagattgtatatgttgctccaatgaaagccttggcagctgaaatgacagattacttcagcagacgtctagagccactaggcatcattgtgaaagaattgactggtgacatgcagttgtccaaaagtgaaattttacgaactcagatgcttgtgaccacaccagaaaaatgggatgtagtgacaagaaagagtgttggggatgtagctctttcccagattgtaaggctccttattcttgatgaagttcatttgctgcatgaagatagaggaccagtattagaaagcatagttgcccgtactttacggcaggtggaatccacacagagtatgataaggattctcggactgtctgcaactttacctaactacctcgatgttgccacatttttacatgttaatccatacattggacttttcttctttgatggccgttttcgaccagtacctcttggacagacatttttggggattaaatgtgcaaataagatgcagcagttgaataacatggatgaagtatgttatgaaaatgttttgaagcaagtaaaggctggacaccaggtgatggtgtttgtacatgctcgaaatgccactgtaagaacagctatgtctctaatagaaagagcaaaaaattgtggccatattcccttcttttttcctacccaaggacatgactatgtacttgcagaaaaacaggtacaaaggtcgagaaataagcaagtacgagaattattcccagatggttttagtattcatcatgcaggaatgcttcggcaggacagaaatttagttgaaaacttgttttctaatgggcatatcaaagtcctagtgtgtacagctacgttagcctggggtgtcaatcttcccgcccatgctgttattattaagggaacacaaatatatgctgcaaaaagaggctcctttgttgaccttggaattttagatgtcatgcagatatttggtcgagctggacgaccacaatttgacaaatttggggaaggaataattataacaacgcatgataaactcagccattacctcactttgctcactcaacgaaacccaattgagagtcagtttctggaaagccttgcagataacctaaatgcagagattgctctgggaacagttactaatgtggaagaagcagtgaagtggataagttacacttatctttatgtacggatgagagcaaatccattagcatatggcatcagtcacaaggcttatcagattgacccaacattaagaaagcatcgagaacagttggtcattgaagttggacgaaaactagacaaagctcagatgattcgttttgaggagcgaactggatatttttcctcaactgatttgggtagaactgccagccattactatattaaatacaacaccattgagacctttaatgaactctttgatgctcacaaaacagaaggtgatatctttgccatagtctccaaagctgaagaatttgatcaaattaaggtcagagaagaggaaatagaggagttagataccttattaagcaatttttgtgaactctccactcctggaggtgtagagaatagttatgggaaaataaacatcttacttcaaacttatatcagccgaggagaaatggacagtttctcccttatatcagattctgcatatgttgcacagaatgcagctagaattgtccgtgctctttttgaaattgctctgaggaaacgttggcctaccatgacctacaggctcctgaatcttagtaaagtcattgacaagaggctttggggttgggctagccctttgagacaattttcaatcctaccaccacacatcctaac

SEQ ID NO: 104059 - DNA, 852 bp, Homo sapiens
  Payload ID: 459
  Gene Symbol: ASCC3
  Gene Name: activating signal cointegrator 1 complex subunit 3
  ENST ID: ENST00000324723
  CDS Start-End: 324-852
gtaggccggcgccagctccactctgtccctcctcgccgggtctgtgcgtctttgcgtctgtctgtctgactgatggtcctcacacgcggttccctgtgactgggcgcgaccccggcaagcgcggcttggagggcggacggggcgcggcgatacagctgcccgctcgcatctttggccctgcgctcagctcctcacccggcgtgggaagttaaagtaaaaccgaaagggaagaaggcgcggtggcaggagctgacagagtgatgggaaacgcgtgagccaggccgagaggtttcttgctgtatggatcactgattgaataatagatggctttacctcgtctcacaggagccttgcgttccttttcaaatgtcaccaagcaagataattataatgaagaagtggctgacttaaagataaagcgatctaaacttcatgaacaagttttagatttgggcctgacatggaagaagataataaaatttttgaatgaaaaactggagaagagtaaaatgcaaagtataaatgaagacttaaaagatatattacatgctgcaaagcagatagttggaactgataatgggagagaagcaattgaaagtggggctgcatttctcttcatgacatttcacttgaaggactctgttggtcacaaggaaacaaaggctatcaaacagatgtttggcccctttccttcatcatctgccactgcagcttgtaatgctactaatcgaattatttctcattttagtcaagatgatcttactgctcttgtgcagatgacagaaaaagaacatggcgatagggttttttttggtaaaaatttagcattttcatttgacatgcatgatttgg

SEQ ID NO: 104060 - DNA, 3433 bp, Homo sapiens
  Payload ID: 459
  Gene Symbol: ASCC3
  Gene Name: activating signal cointegrator 1 complex subunit 3
  Uniprot ID: Q8N3C0
  ENST ID: ENST00000369143
  CDS Start-End: 293-628
gggtctgtgcgtctttgcgtctgtctgtctgactgatggtcctcacacgcggttccctgtgactgggcgcgaccccggcaagcgcggcttggagggcggacggggcgcggcgatacagctgcccgctcgcatctttggccctgcgctcagctcctcacccggcgtgggaagttaaagtaaaaccgaaagggaagaaggcgcggtggcaggagctgacagagtgatgggaaacgcgtgagccaggccgagagtttcaggtttcttgctgtatggatcactgattgaataatagatggctttacctcgtctcacaggagccttgcgttccttttcaaatgtcaccaagcaagataattataatgaagaagtggctgacttaaagataaagcgatctaaacttcatgaacaagttttagatttgggcctgacatggaagaagataataaaatttttgaatgaaaaactggagaagagtaaaatgcaaagtataaatgaagacttaaaagatatattacatgctgcaaagcagatagaagtgaattgtccattccagaagaggaggctggatggaaaagaggaggatgagaagatgagcagagcttctgacagattcagaggactaagatgacaaaaatgactaaaatggacaaaagaagaaatagaaaatctgaatatttgactattaaaggaatttaatctgtaattaaaaaccttaagtacaaagaaatctatatgctatgatggctttaatggagaatgtcataatgtcatttaaaaaggtatgagagtactattgtagattaaaagaggttaaaggcatataataatcaaaatgtaatgtatgatccttgattgactcttgaatcagaaaaaaattacgtatttttggggccgttggagaaatctgaatatgggctggacatcattaggtaatattagatctcaggtgtgataatgttgtggctatgtaagaggatatcctaaatctcaggagaagcatactgcagtatatatagtggtatctcatgaagattaaaatgtactgtcaaatgtgtcagcaaaagaaatacacatgatgtgtgtgtgtgatcaagtgtttataatgagtggattaataaatatgagaagatagggtgatttgttgtaaagtaataaaggtttaaaaattacatgattcagtagagaaaaagcattttatgaatatctaacattacttatgataaaaaatctcagcaaactaggaatagaaggggattttgttaatctgataagctgtagctataaaaaacttggagaaaacatacttaatgctacaaagttagaagcttccctgaggtacggaattagacacaaatgcctgttaccacttctgtttctcactgtattaaaaatccttgctaacataatatggcaagaaaaagtaagggcataaagactggaaaaaaaaacttttccatttttcacatgactgtacctgtagaaaatgaatttaacaaggttaatataaaaatcaattttatttctacttactagaagcacattaaaaattacacttatctttatgtaacgtaatacattttaccttaaattttaaaattttaatttattttacgtttacaaaagcatcataaacatcaaatacgtaggagtaaatttaacaaaaaataagcaagacttcatggaaaactaaaatattgagagaatttaaagaagatctaaataaacagagggatataccaagaattggaagactcactattataatgatatattttttacccaaattgatctgtagattcagtgctatcccaggcacagtcttatgtttgagggtgtgtgtgtgtgtgtgtgtgtatgtgtgcatgtgtgtgtgtggaaattgacaagggtaatatgaaagttatatggaaattcaaaggcaaagagcagcctggttaactttgaaaaataaaaagggagaacttactctagtagatcttaaaacttattataaagataagtatacagtgtggtgttggtccaagaataggcaaatggactagtatgacagaatatagcccagaaacaaacctacggatagaaatatacttgatttataatgaaggccaaacaatagtgagacaaggctattttttcagtatatggtgctgggtcaactgcatatacagatgaaaaaaagtacctattttacaaataattttaaacagcctacagaattaagcatgatacacaaaacaatacatcttctaaaagatgtaaaagagtgtcttcaggatctttgtatgtgcgaaaatttatcaaacagagaacaaaaagtacaaagggaatgattaagttggactgtagtaaaattaataccttctatttattaagagtaaaaaggcaaaacatggagtgggagaatatagcttcaagatatataaccaaaaagagagcttttatccaggttaaatacgagctcctacaaatcaataaggaaaggacagataatcctatatgaacatgagtaagagctttgaacaaggacttcacaagagatagttgaccagtaaacatgaaaagggcttcagcttcattggtagtcaaggatatgccactgcatgcccattagaatggttaaaatgtaaaagactgacatacctattgttaggatcaagaatgtgaactagaatttttgtctactgctgctagagtttacaattggtacaaccactttgagtaactgtttgacagtgtctactattacctactgtggttggacaagtgaaattttaaatcttaggacataaatatccaataaaaatgcttgtacatacatgtatatcaaaaataggtgcattcattgcaacattatttgtgatagccttaatgtagaaacaacccagttcattgttaaaaagcttaagttgtagtatgtagactgccttatagcagtaacggattacagctatgtataacattgtaagtgaatcttataatgttgacaaaagaagccatacaacacatattatgattccattaatatgaaactgaaaactaggcatgaccagtctctggttttagaagtcaggatagtggctgcttttgaggaaggaggtagtgactaggagtgaatatgagggaggtttctggggagctgataatgttctgattcttgaagtagttaaccagattacacaggtgtgttcgttttttgataattctttgaactgtatgtgtactgtatattttcttgttatattcaataaaaagaattactatgatttttatattacatagattaaataagaagtatttcagattgataagtaacacatgcttgtgtatttatttagcttaaggtttggctatcatggtgagaactcctatgtaccctgctcaggtcctggtaaacagtatcataagtataataaattggtgtttttcattctca

SEQ ID NO: 104061 - DNA, 8146 bp, Homo sapiens
  Payload ID: 459
  Gene Symbol: ASCC3
  Gene Name: activating signal cointegrator 1 complex subunit 3
  Uniprot ID: Q8N3C0
  ENST ID: ENST00000369162
  CDS Start-End: 346-6954
agcggggcggtgacgtgtaggccggcgccagctccactctgtccctcctcgccgggtctgtgcgtctttgcgtctgtctgtctgactgatggtcctcacacgcggttccctgtgactgggcgcgaccccggcaagcgcggcttggagggcggacggggcgcggcgatacagctgcccgctcgcatctttggccctgcgctcagctcctcacccggcgtgggaagttaaagtaaaaccgaaagggaagaaggcgcggtggcaggagctgacagagtgatgggaaacgcgtgagccaggccgagagtttcaggtttcttgctgtatggatcactgattgaataatagatggctttacctcgtctcacaggagccttgcgttccttttcaaatgtcaccaagcaagataattataatgaagaagtggctgacttaaagataaagcgatctaaacttcatgaacaagttttagatttgggcctgacatggaagaagataataaaatttttgaatgaaaaactggagaagagtaaaatgcaaagtataaatgaagacttaaaagatatattacatgctgcaaagcagatagttggaactgataatgggagagaagcaattgaaagtggggctgcatttctcttcatgacatttcacttgaaggactctgttggtcacaaggaaacaaaggctatcaaacagatgtttggcccctttccttcatcatctgccactgcagcttgtaatgctactaatcgaattatttctcattttagtcaagatgatcttactgctcttgtgcagatgacagaaaaagaacatggcgatagggttttttttggtaaaaatttagcattttcatttgacatgcatgatttggaccactttgacgaactgccaataaatggtgaaactcagaaaactataagcctagattataagaagtttctgaatgaacatctccaggaggcttgcaccccagaactcaagcctgtggaaaaaacaaatggctcctttttgtggtgtgaagttgaaaagtacctaaattcaactttgaaggaaatgactgaagtgccaagagtagaagatctttgctgtactttatatgatatgcttgcttctattaaaagtggtgatgaacttcaggatgagctatttgaactgctgggacctgaaggacttgaacttattgagaaactcctccagaacagaattacaattgtggatagatttcttaattcttcaaatgatcataggtttcaggctcttcaagacaattgtaaaaaaattttaggagaaaatgctaaacccaattatggttgtcaagtcactattcagtctgaacaagaaaagcagttaatgaaacaatatcgacgtgaagaaaaaagaattgccagacgagaaaaaaaggctggagaagatttagaagtttcagaaggacttatgtgctttgatcctaaggaattgcggatacaaagagaacaggcacttctgaatgctagaagtgttccaattctgagcaggcagagagatgcagacgttgaaaaaatacattatccccatgtgtatgattcccaggctgaagccatgaaaacatcagcatttattgctggtgcaaagatgattttgccagaaggaatccaaagagagaataacaagctttatgaagaagtaaggattccctacagcgaaccaatgccactcagctttgaggaaaagccagtttatatccaagacttagatgagatcggacagctggcttttaaaggaatgaagagactcaatagaatccagtcaatagtgtttgagactgcctacaacaccaatgagaacatgctgatttgtgcccctacaggagctggaaaaaccaacattgcaatgctgacagtcttgcatgaaattcgccaacattttcaacaaggtgttatcaaaaagaatgaatttaagattgtatatgttgctccaatgaaagccttggcagctgaaatgacagattacttcagcagacgtctagagccactaggcatcattgtgaaagaattgactggtgacatgcagttgtccaaaagtgaaattttacgaactcagatgcttgtgaccacaccagaaaaatgggatgtagtgacaagaaagagtgttggggatgtagctctttcccagattgtaaggctccttattcttgatgaagttcatttgctgcatgaagatagaggaccagtattagaaagcatagttgcccgtactttacggcaggtggaatccacacagagtatgataaggattctcggactgtctgcaactttacctaactacctcgatgttgccacatttttacatgttaatccatacattggacttttcttctttgatggccgttttcgaccagtacctcttggacagacatttttggggattaaatgtgcaaataagatgcagcagttgaataacatggatgaagtatgttatgaaaatgttttgaagcaagtaaaggctggacaccaggtgatggtgtttgtacatgctcgaaatgccactgtaagaacagctatgtctctaatagaaagagcaaaaaattgtggccatattcccttcttttttcctacccaaggacatgactatgtacttgcagaaaaacaggtacaaaggtcgagaaataagcaagtacgagaattattcccagatggttttagtattcatcatgcaggaatgcttcggcaggacagaaatttagttgaaaacttgttttctaatgggcatatcaaagtcctagtgtgtacagctacgttagcctggggtgtcaatcttcccgcccatgctgttattattaagggaacacaaatatatgctgcaaaaagaggctcctttgttgaccttggaattttagatgtcatgcagatatttggtcgagctggacgaccacaatttgacaaatttggggaaggaataattataacaacgcatgataaactcagccattacctcactttgctcactcaacgaaacccaattgagagtcagtttctggaaagccttgcagataacctaaatgcagagattgctctgggaacagttactaatgtggaagaagcagtgaagtggataagttacacttatctttatgtacggatgagagcaaatccattagcatatggcatcagtcacaaggcttatcagattgacccaacattaagaaagcatcgagaacagttggtcattgaagttggacgaaaactagacaaagctcagatgattcgttttgaggagcgaactggatatttttcctcaactgatttgggtagaactgccagccattactatattaaatacaacaccattgagacctttaatgaactctttgatgctcacaaaacagaaggtgatatctttgccatagtctccaaagctgaagaatttgatcaaattaaggtcagagaagaggaaatagaggagttagataccttattaagcaatttttgtgaactctccactcctggaggtgtagagaatagttatgggaaaataaacatcttacttcaaacttatatcagccgaggagaaatggacagtttctcccttatatcagattctgcatatgttgcacagaatgcagctagaattgtccgtgctctttttgaaattgctctgaggaaacgttggcctaccatgacctacaggctcctgaatcttagtaaagtcattgacaagaggctttggggttgggctagccctttgagacaattttcaatcctaccaccacacatcctaacaagattagaagaaaaaaagcttactgtggataagctgaaagacatgaggaaagatgaaataggtcacattttacatcatgtgaatattggactgaaggtcaaacaatgtgttcatcagattccttctgttatgatggaagcatccattcagcctatcacaaggactgtcctccgagtgacactcagcatctatgctgatttcacttggaatgatcaggtacatgggacagtaggagaaccttggtggatttgggtagaagatcctacaaatgatcatatttatcattcagagtattttctagctctaaaaaaacaagtcattagtaaagaagcccaactactggtatttacaatccctatttttgagcctttgccttcccaatactacatccgagcagtgtctgatagatggttgggtgctgaggcagtatgtattatcaactttcaacatctaattctaccagagagacatcctcctcatacagaattactggatcttcagcctttaccaatcacagctttgggatgtaaagcatatgaagccctgtacaacttcagccactttaaccctgtacagacacaaatatttcatacattgtatcacacggattgtaatgtcctacttggagcacctactggatcgggaaagactgttgcagctgaattagccattttcagagtcttcaacaaataccctacttcaaaggcggtatatattgcacccctaaaagccctagtacgtgaaagaatggatgattggaaagttagaatagaagaaaaacttggtaaaaaagttattgaactaacaggggatgtgactcctgatatgaaatccattgccaaggctgaccttatcgtcactacgccagagaagtgggatggagtcagcagaagctggcaaaataggaactatgttcagcaagtcactattctcatcatagatgagatccatctgcttggggaggaaagaggccctgttctagaggtcattgtatctcgaacaaattttatctcatcacacacagaaaagcctgttagaatagttggactatctactgcattagctaatgccagagaccttgctgattggctcaatattaagcagatgggcttgtttaacttccgaccatcagtacgcccagttccactggaagttcacattcaaggctttccaggtcaacattactgtcctcgtatggctagtatgaacaagcctgcatttcaggcaattagaagccattctccagccaaacctgttttgatatttgtctcatcaagacgtcaaactcgtcttactgctttggaattgatcgccttcctggctactgaagaagatccaaagcagtggttaaacatggatgaaagagagatggagaacatcattgcaacagtaagagattccaacctcaagctgacccttgctttcgggataggaatgcatcatgctggactacatgagagggaccgaaaaacagtagaggaactatttgtaaactgtaaagttcaggttcttattgctacaagcacattagcctggggtgtaaactttccagctcatttagtaattattaagggaacagaatactatgatggaaaaacaagacgttatgtggattttcccattacagatgtcctccagatgatggggcgtgctgggaggccgcagttcgatgaccaaggcaaagctgtaattctagttcatgacataaagaaagacttttataaaaaatttctttatgaacctttcccagtagaatcaagtttattaggagtgctctctgaccacttaaatgcagagattgctggtggtacaattacatctaagcaagatgcattggattatatcacctggacttactttttccgacgtcttatcatgaatcccagctattacaatttgggtgatgtgagccatgattctgtgaacaagtttctgtcccatctgattgagaagtccctgattgaattggaactttcctactgtattgaaattggagaggataatcgcagcattgaacctctaacttatggccgaattgcctcctattactatttgaagcatcaaacagttaaaatgttcaaggaccgcttgaagcctgaatgcagtactgaagaactgctttcaattctaagtgatgcagaagaatatacagatttgccagtgagacacaatgaagatcatatgaatagtgaactggcaaaatgtcttcccattgaatcaaatcctcattcatttgacagccctcacaccaaagcacatctcctgctacaggcacatctcagccgagccatgctaccctgcccagattatgacactgataccaaaacagtcttggaccaagctctcagagtatgtcaggcaatgctggacgtggctgcaaaccagggctggctggtgactgtcctgaatatcaccaacctgattcagatggtgatccagggtcggtggttaaaggactcttctcttcttacactaccaaacatagaaaaccatcatcttcaccttttcaagaaatggaagccgattatgaagggcccacatgctaggggtcggacctccatcgagtcccttcctgaactgatccatgcctgtggagggaaagaccatgtatttagctccatggtagaaagtgagctacatgctgcaaaaacgaaacaggcatggaatttcttatctcacttgccagtgataaatgttggcataagtgttaaaggctcgtgggatgacttagttgaaggacataatgaactctctgtctcaactctgactgcagacaaacgagatgacaacaaatggatcaaattgcatgctgaccaagagtatgtgcttcaagtgagcttgcagagagtccactttgggttccacaagggaaagccagagagctgtgcagttactcctcgatttcccaaatcaaaagacgaaggatggtttttgatattaggagaagtggataagagagaacttattgctttgaaaagagtaggatatattcgaaatcatcatgttgcttccctttctttttatacccctgaaatacctggaaggtatatctacacattatatttcatgagtgactgctaccttggcctggaccagcagtatgacatctatctcaacgttacacaagcgagtctttctgcacaggtcaacaccaaggtctctgattccctgactgacctggcattaaagtaacttgacctgaacaatccatttgaaaggagtggctaagaattctctctgttcagtcatctagacaaatcgaattacttgatgtttgccttgaaagaatcaacttctaacctcaaccatccaggaaattgacagtggctgcagtattgactccagtgacataaagttaaccacagtggccttttaacaaatgttgccttttataatgttatctttatgagtttcttgatatgtaagatgaaaaagcatttagaataatcttttaatttgtgtatatttgggatgatatttaggagctatcaatcaaattttacatctcacaatgtactgtttacatggatattggctgctttttttaaggaaaaccacattgagatgtgacaagtgttaggacttgtcacagatttctaactctgccgcataaactataaatctgtaaggtggtacacagcgtgtcttgttagcaaaatttatactttgatatgatcacatgtagaagtagcttcaagaatttcttgtagtcataaatgtttaataatatatgatgtaaaattatattatggagcctaatgatgataacaaagaaaacaatatactgatcttagaaaatgtagacatggttaactgggaaataaaatatagagtggcacttcaagacaagctgactcaatgttttcttctgcttcctttaaataatatccccttactcatctgttcttcttttctttcccttctacttcaaggctttatttctattatctttctgacatatttatttacagaagtagagaagtataatctaattcatgttgtagcacttacagatcatatagtacaattatttgtctttatgctctccaggaaaaatctgagacagaaaatttttcacccctatggataggttttcacctgtaataaagaaaatttctctatgtccaaacaaattccttcttgaaaaatactttttcaaactaaaaacttgttaaaattcaatgttcatataatatgcattctagtggaatgaaattctacctttgtgaaataatttcagttttcttagccctaaaatgaattattttaaaacattttccaatgtcattgttacaaatactagaatttaagtgtttctgaaattggaatgtattgcttgtatatatccttttccatgcttaaataaaaaagaagaagaaataaa

SEQ ID NO: 104062 - DNA, 2828 bp, Homo sapiens
  Payload ID: 459
  Gene Symbol: ASCC3
  Gene Name: activating signal cointegrator 1 complex subunit 3
  Uniprot ID: Q8N3C0
  ENST ID: ENST00000522650
  CDS Start-End: 346-2541
agcggggcggtgacgtgtaggccggcgccagctccactctgtccctcctcgccgggtctgtgcgtctttgcgtctgtctgtctgactgatggtcctcacacgcggttccctgtgactgggcgcgaccccggcaagcgcggcttggagggcggacggggcgcggcgatacagctgcccgctcgcatctttggccctgcgctcagctcctcacccggcgtgggaagttaaagtaaaaccgaaagggaagaaggcgcggtggcaggagctgacagagtgatgggaaacgcgtgagccaggccgagagtttcaggtttcttgctgtatggatcactgattgaataatagatggctttacctcgtctcacaggagccttgcgttccttttcaaatgtcaccaagcaagataattataatgaagaagtggctgacttaaagataaagcgatctaaacttcatgaacaagttttagatttgggcctgacatggaagaagataataaaatttttgaatgaaaaactggagaagagtaaaatgcaaagtataaatgaagacttaaaagatatattacatgctgcaaagcagatagttggaactgataatgggagagaagcaattgaaagtggggctgcatttctcttcatgacatttcacttgaaggactctgttggtcacaaggaaacaaaggctatcaaacagatgtttggcccctttccttcatcatctgccactgcagcttgtaatgctactaatcgaattatttctcattttagtcaagatgatcttactgctcttgtgcagatgacagaaaaagaacatggcgatagggttttttttggtaaaaatttagcattttcatttgacatgcatgatttggaccactttgacgaactgccaataaatggtgaaactcagaaaactataagcctagattataagaagtttctgaatgaacatctccaggaggcttgcaccccagaactcaagcctgtggaaaaaacaaatggctcctttttgtggtgtgaagttgaaaagtacctaaattcaactttgaaggaaatgactgaagtgccaagagtagaagatctttgctgtactttatatgatatgcttgcttctattaaaagtggtgatgaacttcaggatgagctatttgaactgctgggacctgaaggacttgaacttattgagaaactcctccagaacagaattacaattgtggatagatttcttaattcttcaaatgatcataggtttcaggctcttcaagacaattgtaaaaaaattttaggagaaaatgctaaacccaattatggttgtcaagtcactattcagtctgaacaagaaaagcagttaatgaaacaatatcgacgtgaagaaaaaagaattgccagacgagaaaaaaaggctggagaagatttagaagtttcagaaggacttatgtgctttgatcctaaggaattgcggatacaaagagaacaggcacttctgaatgctagaagtgttccaattctgagcaggcagagagatgcagacgttgaaaaaatacattatccccatgtgtatgattcccaggctgaagccatgaaaacatcagcatttattgctggtgcaaagatgattttgccagaaggaatccaaagagagaataacaagctttatgaagaagtaaggattccctacagcgaaccaatgccactcagctttgaggaaaagccagtttatatccaagacttagatgagatcggacagctggcttttaaaggaatgaagagactcaatagaatccagtcaatagtgtttgagactgcctacaacaccaatgagaacatgctgatttgtgcccctacaggagctggaaaaaccaacattgcaatgctgacagtcttgcatgaaattcgccaacattttcaacaaggtgttatcaaaaagaatgaatttaagattgtatatgttgctccaatgaaagccttggcagctgaaatgacagattacttcagcagacgtctagagccactaggcatcattgtgaaagaattgactggtgacatgcagttgtccaaaagtgaaattttacgaactcagatgcttgtgaccacaccagaaaaatgggatgtagtgacaagaaagagtgttggggatgtagctctttcccagattgtaaggctccttattcttgatgaagttcatttgctgcatgaagatagaggaccagtattagaaagcatagttgcccgtactttacggcaggtggaatccacacagagtatgataaggattctcggactgtctgcaactttacctaactacctcgatgttgccacatttttacatgttaatccatacattggacttttcttctttgatggccgttttcgaccagtacctcttggacagacatttttggggattaaatgtgcaaataagatgcagcagttgaataacatggatgaagtatgttatgaaaatgttttgaagcaagtaaaggctggacaccaggtacacttattttatctgcttttacacttatttatctgcttttagagagtgcttaatgataaaaattattaatatttacgctcttcagaagaaaatttttctttaattctgaggcaatgactcagaggttctaattcttaataactgctttagcccaatgggtaagtcataaaaatattcatagatattatcatcccagtattgataggtcgtgctattttgtttgccatttttaattttaaatattatattcttactgttttcatgaagcaatatcaattgaaatgtaatatatataataaagttctgtattgtttgatggtgtttagaaa

SEQ ID NO: 104063 - DNA, 2181 bp, Homo sapiens
  Payload ID: 460
  Gene Symbol: ATF1
  Gene Name: activating transcription factor 1
  Uniprot ID: P18846
  ENST ID: ENST00000262053
  CDS Start-End: 23-838
gaggcggcagccacagttgattatggaagattcccacaagagtaccacgtcagagacagcacctcaacctggttcagcagttcagggagctcacatttctcatattgctcaacaggtatcatctttatcagaaagtgaggagtcccaggactcatccgacagcataggctcctcacagaaagcccacgggatcctagcacggcgcccatcttacagaaaaattttgaaagacttatcttctgaagatacacggggcagaaaaggagacggagaaaattctggagtttctgctgctgtcacttctatgtctgttccaactcccatctatcagactagcagcggacagtacattgccattgccccaaatggagccttacagttggcaagtccaggcacagatggagtacagggacttcagacattaaccatgacaaattcaggcagtactcagcaaggtacaactattcttcagtatgcacagacctctgatggacagcagatacttgtgcccagcaatcaggtggtcgtacaaactgcatcaggagatatgcaaacatatcagatccgaactacaccttcagctacttctctgccacaaactgtggtgatgacatctcctgtgactctcacctctcagacaactaagacagatgacccccaattgaaaagagaaataaggttaatgaaaaacagagaagctgctcgagaatgtcgcagaaagaagaaagaatatgtgaaatgcctggaaaaccgagttgcagtcctggaaaatcaaaataaaactctaatagaagagttaaaaactttgaaggatctttattccaataaaagtgtttgattcctaagaaagaaaatatttttgtggacatgcataaaaattaaatggatttcctagtggagttttataaattaaaaggtcaaaactgaagctttttatttaggcttttccaaatcaaggataaatatcttacgcacgatatctagtgacagaggagaaagtggaaaatgacctcaaggaagctacgggcacaactggaagctttgtagaaattaaacatattcaaggagcaagaaatgaactttcagcagtctaaattttctaaataaccaatagttgccaatctaaaatggcagagaagatgaaatttgataaactgaattttttttaaaaatccatttaccctacaggtttgcatttgtttgctgaaatttacctttttttagttatatatatgtgtgtgtgtgtgtgtaatttctgccaataaattctaaattacaaaggtaagagaaaacctagtacattactaaatatataaagtatatgttctgattatgtatacttgttctagtgtcaagtctttttaagtgggtttttaaaagtttgttattggacttgaatggatttttgagactaggttaattatttttgaggtcttatcctaaaaggcatctaaggtacatgaatggagtatggtgattttataacattttttatcagaatggaaaaagaactgtttaaaagtttgatacttttaaatagttggtttttttgcttactctggtaatgattttctacaaatacataataaattgtttttttgagtctatattctgtatgcagttgaatatccattacttattctgctgtgctttaatagaatggaatgtttacaggcccttaaaatattatttttaaaaaaccttctgaagatacataccaaagtttttccaagaagattttataatcaatttaataatgtaaggtttatcagattctataatagtatagttattaaggcaattttatgttagagactattttgtaatgtagtgagtggtacctttataagaaaagtgactgccaatatatttttatagctgatctttataaattctaatgttgagtttttaatgattattttaaatgtttatatagtttagtaaaatttgcatctcaaagtatcatttttatattatgggacgttttcagattggctaatatttgcattgtaaattttgtatgcagtttatctaaaattcaaaaatactgtcagtacaccagcgtttaacatctatattccaatttgtatacagtttaaaattgtactgcaaaactattgtgtgctcttacacagtatgcatcatattgttgtctgtgaaattaaaggacatttgatagtc

SEQ ID NO: 104064 - DNA, 568 bp, Homo sapiens
  Payload ID: 460
  Gene Symbol: ATF1
  Gene Name: activating transcription factor 1
  ENST ID: ENST00000549612
  CDS Start-End: 237-470
aggcttgtgtagatcatgccgccagtagcggccctgactgccgaggaaacggtagcttaggacagttggctgttaagtgacactgattctccccgccccgcctgacccccgagaaggaggcttgtcccccgctgcgtgagggggtggggaagtgggtagtgaattcggatctacctgggaggggggagtggaagttcccgccccggagagcggcgaggcggcagccacagttgattatggaagattcccacaagagtaccacgtcagagacagcacctcaacctggttcagcagttcagggagctcacatttctcatattgctcaacagggtctcactctgtcacccagactggtgtgcagtagtgtgaacatagctcactgcagccttgacctcctgtgctcaagcaatcctcctgcctcagctccccaagtagcagggaccacaggtatcatctttatcagaaagtgaggagtcccaggactcatccgacagcataggctcctcacagaaagcccacgggatcctagcacggcgcccatcttacagaaaaattttgaaagacttat

SEQ ID NO: 104065 - DNA, 549 bp, Homo sapiens
  Payload ID: 460
  Gene Symbol: ATF1
  Gene Name: activating transcription factor 1
  ENST ID: ENST00000552510
  CDS Start-End: 39-549
cagggccggcgtcggtcaaggtcaattggcagttgattatggaagattcccacaagagtaccacgtcagagacagcacctcaacctggttcagcagttcagggagctcacatttctcatattgctcaacaggtatcatctttatcagaaagtgaggagtcccaggactcatccgacagcataggctcctcacagaaagcccacgggatcctagcacggcgcccatcttacagaaaaattttgaaagacttatcttctgaagatacacggggcagaaaaggagacggagaaaattctggagtttctgctgctgtcacttctatgtctgttccaactcccatctatcagactagcagcggacagtacattgccattgccccaaatggagccttacagttggcaagtccaggcacagatggagtacagggacttcagacattaaccatgacaaattcaggcagtactcagcaaggtacaactattcttcagtatgcacagacctctgatggacagcagatacttgtgcccagcaatcaggtggtcgtacaaa

SEQ ID NO: 104066 - DNA, 745 bp, Homo sapiens
  Payload ID: 460
  Gene Symbol: ATF1
  Gene Name: activating transcription factor 1
  ENST ID: ENST00000552487
  CDS Start-End: 146-745
cccttccagtcgtgcgtctcctcctttccctcgcccccaaataaaagtaaagcccgaaaccgcccgccgcggggtggctttcgcctcagaagccgccctttgcagtcgcaggcgctagctctccgtgggaggtctcgagttgattatggaagattcccacaagagtaccacgtcagagacagcacctcaacctggttcagcagttcagggagctcacatttctcatattgctcaacaggtatcatctttatcagaaagtgaggagtcccaggactcatccgacagcataggctcctcacagaaagcccacgggatcctagcacggcgcccatcttacagaaaaattttgaaagacttatcttctgaagatacacggggcagaaaaggagacggagaaaattctggagtttctgctgctgtcacttctatgtctgttccaactcccatctatcagactagcagcggacagtacattgccattgccccaaatggagccttacagttggcaagtccaggcacagatggagtacagggacttcagacattaaccatgacaaattcaggcagtactcagcaaggtacaactattcttcagtatgcacagacctctgatggacagcagatacttgtgcccagcaatcaggtggtcgtacaaactgcatcaggagatatgcaaacatatcagatccgaactacaccttcagctacttctctgccacaaactgtggtgatgacatctcctgtg

SEQ ID NO: 104067 - DNA, 970 bp, Homo sapiens
  Payload ID: 460
  Gene Symbol: ATF1
  Gene Name: activating transcription factor 1
  ENST ID: ENST00000551831
  CDS Start-End: 159-326
tccgcgcctcggtgcagagctgcgctgcgcccttccagtcgtgcgtctcctcctttccctcgcccccaaataaaaagacgaggtcttgctacattgtccaggatggagaagtaggaattcttaaggatattgttatggagggaaaaaaatcattgattatggaagattcccacaagagtaccacgtcagagacagcacctcaacctggttcagcagttcagggagctcacatttctcatattgctcaacagttgccattgccccaaatggagccttacagttggcaagtccaggcacagatggagtacagggacttcagacattaaccatgacaaattcaggcagtactcagcaaggtacaactattcttcagtatgcacagacctctgatggacagcagatacttgtgcccagcaatcaggtggtcgtacaaactgcatcaggagatatgcaaacatatcagatccgaactacaccttcagctacttctctgccacaaactgtggtgatgacatctcctgtgactctcacctctcagacaactaagacagatgacccccaattgaaaagagaaataaggttaatgaaaaacagagaagctgctcgagaatgtcgcagaaagaagaaagaatatgtgaaatgcctggaaaaccgagttgcagtcctggaaaatcaaaataaaactctaatagaagagttaaaaactttgaaggatctttattccaataaaagtgtttgattcctaagaaagaaaatatttttgtggacatgcataaaaattaaatggatttcctagtggagttttataaattaaaaggtcaaaactgaagctttttatttaggcttttccaaatcaaggataaatatcttacgcacgatatctagtgacagaggagaaagtggaaaatgacctcaaggaagctacgggcacaactggaagctttgtagaaattaaacatattcaaggagc

SEQ ID NO: 104068 - DNA, 4176 bp, Homo sapiens
  Payload ID: 461
  Gene Symbol: ATF2
  Gene Name: activating transcription factor 2
  Uniprot ID: P15336
  ENST ID: ENST00000264110
  CDS Start-End: 300-1817
gttgtcagtccgatctcgcgagagaggacggaagcctgtgggagcccgtggcctttaaagtgccgttcagccttttcctccaggggtgctttgtaaacacggctgtgctcagggctcgcgggtgaccgaaaggatcatgaactagtgacctggaaagggtactagatggaaacttgagaaaggactgcttattgataacagctaaggtattcctggaagcagagtaaataaagctcatggcccaccagctagaaagtattcttgccatgagaaaaagaatgtgataagttattcaacttatgaaattcaagttacatgtgaattctgccaggcaatacaaggacctgtggaatatgagtgatgacaaaccctttctatgtactgcgcctggatgtggccagcgttttaccaacgaggatcatttggctgtccataaacataaacatgagatgacactgaaatttggtccagcacgtaatgacagtgtcattgtggctgatcagaccccaacaccaacaagattcttgaaaaactgtgaagaagtgggtttgtttaatgagttggcgagtccatttgagaatgaattcaagaaagcttcagaagatgacattaaaaaaatgcctctagatttatcccctcttgcaacacctatcataagaagcaaaattgaggagccttctgttgtagaaacaactcaccaggatagtcctttacctcacccagagtctactaccagtgatgagaaggaagtaccattggcacaaactgcacagcccacatcagctattgttcgtccagcatcattacaggttcccaatgtgctgcttacaagttctgactcaagtgtaattattcagcaggcagtaccttcaccaacctcaagtactgtaatcacccaggcaccatcctctaacaggccaattgtccctgtaccaggcccatttcctcttctgttacatcttcctaatggacaaaccatgcctgttgctattcctgcatcaattacaagttctaatgtgcatgttccagctgcagtcccactcgttcgaccagtcaccatggtgcctagtgttccaggaatcccaggtccttcctctccccaaccagtacagtcagaagcaaaaatgagattaaaagctgctttgacccagcaacatcctccagttaccaatggtgatactgtcaaaggtcatggtagcggattggttaggactcagtcagaggaatctcgaccgcagtcattacaacagccagccacatccactacagaaactccggcttctccagctcacacaactccacagacccaaagtacaagtggtcgtcggagaagagcagctaacgaagatcctgatgaaaaaaggagaaagtttttagagcgaaatagagcagcagcttcaagatgccgacaaaaaaggaaagtctgggttcagtctttagagaagaaagctgaagacttgagttcattaaatggtcagctgcagagtgaagtcaccctgctgagaaatgaagtggcacagctgaaacagcttcttctggctcataaagattgccctgtaaccgccatgcagaagaaatctggctatcatactgctgataaagatgatagttcagaagacatttcagtgccgagtagtccacatacagaagctatacagcatagttcggtcagcacatccaatggagtcagttcaacctccaaggcagaagctgtagccacttcagtcctcacccagatggcggaccagagtacagagcctgctctttcacagatcgttatggctccttcctcccagtcacagccctcaggaagttgattaaaaacctgcagtacaacagttttagatactcattagtgacttcaaagggaaatcaaggaaagaccagtttccatttatgcgaaatctgtggttgtaaattttttttttttacttgaaattaaatttggctctaaagttggtgtagcagcagttgatcagactgaaaaacggtttttagtctctggaaaaagactgattttgctttttttataaatattattagatttattaatttttctgtgctcaatgtgtaaattgtattataattcattgtgatttatttcacttttaatttgctggtgttttaataaatgggggtgttactgaatctttcttcccacttccatttcttttgaccaccccttaaccctcaactgtgacggtagtagtattatcatttataccaaagttttgcatagtccctgttgactttgtaatgttaacggagtcataaaagcactaggcaagagaaagatagaaatttgcttttaatctttttgccttttattttgcacattatgcaaaaggaaaaacattaaagaacacttttttttaagtgagtgaaaacatggtaaagacatacagtgcttttatgcacattgttaagctaaatcaaggtcatttataatcattttccttttttatttaagattttaagtaaacaaattttagaattttcagcatttcaaaaatgattttatttttcaagtcttaaattcaatattttacacctatgttttgaggctaaaaatatgaaattatataatgtatgatacagggttatcaaatatctaataatttttgaaattagctcttgtttttggtttttttgttgttgtttttacagatttcaggttacaaactgcaaagtttatgcataattaagtatggtatggttgccagaaaagcctaaaattactacttagaaaatttaagactgtttacccccattgtcttgtacttgcgagctaacttgtactattcttgtgaaagcactgtcatcttttagtagcaaattttgataatgtttctcgtggaaaaaaaaatcagtatctatctttagaacaatgtaattataatgtgggaagtgtgcatgaatgagagagagtgtgtgtgtatctgtgtgtgtgtgcgcgtgtgtgtgtgtcttttaatagtttatgccagcaatctttgcttgaatgtttaacgatgccttcagtgtgatgctggccaatagatgattgcagtttaaaatgtcattattgtgcaggcttggataactaacattccatgatgtagcttgtttctgatgagatgattgtaggtacatttttctcattatccaatcatctgtgggatacttagttttctaatgtgccattatctatttttattctgcagttatgttcaaaatacagtacatattttaaaatagaataaattgttaaacataaaattttaaaagtagtagatgtgcgtaagaaaactttgtaaaatagttatgagtcctacccagtagcaacttctggcattcaagcaggattccactatgtaaatatctgtaatgcatttataataagttgtgtagtttgtcctgcatccatactacactatttgctaaagtctcagtgccatctcctaatgagactgacattttaaaagtctgtatggaatatccttgataattcaaggaaatatccctcctgcctaagttccaaactgggaaacattcaaattatataaatgacatttcaggactttaagtatgaagataatgggaattttattgttttgctttttaaaatgagagcatttttatttgataattttttttaaatttttaatttttaactaatttcattattttaaagtaatcagtttttcaaatcatgattttgatatcattattctaaggagttatctcaaaggcacaaaatatgaattctgcaagaaggctattttttattgtagtttgaatgggttaggaaaagcctcaatttttcactcttaagtccttcagtacatttttctttcatcttattacttatgcaagttaaggttctttggtaacagaattcttgcaactgtaaaataaaactacatagatgtaagaagtcatgtaaacggttaacaagcttaccaaggttagcaaaactttcattgtaaatcagtctgtactgagcaaataaaaatcattattagttgtataaacacaaattccattttgactttcaggatgtcatactacttctgtacctagcattttcagtccttatatttgcaatgttacacaaactgtactattttcttttatgtgcagtttgcatgagtaaaccatcagagaataaattctatctttaaattatgttcataa

SEQ ID NO: 104069 - DNA, 4079 bp, Homo sapiens
  Payload ID: 461
  Gene Symbol: ATF2
  Gene Name: activating transcription factor 2
  Uniprot ID: P15336
  ENST ID: ENST00000345739
  CDS Start-End: 377-1720
gttgtcagtccgatctcgcgagagaggacggaagcctgtgggagcccgtggcctttaaagtgccgttcagccttttcctccaggggtgctttgtaaacacggctgtgctcagggctcgcgggtgaccgaaaggatcatgaactagtgacctggaaagggtactagatggaaacttgagaaaggactgcttattgataacagctaaggtattcctggaagcagagtaaataaagctcatggcccaccagctagaaagtattcttgccatgagaaaaagaatgtgataagttattcaacttatgaaattcaagttacatgtgaattctgccaggcaatacaaggacctgtggaatatgagtgatgacaaaccctttctatgtactgcgcctggatgtggccagatcagaccccaacaccaacaagattcttgaaaaactgtgaagaagtgggtttgtttaatgagttggcgagtccatttgagaatgaattcaagaaagcttcagaagatgacattaaaaaaatgcctctagatttatcccctcttgcaacacctatcataagaagcaaaattgaggagccttctgttgtagaaacaactcaccaggatagtcctttacctcacccagagtctactaccagtgatgagaaggaagtaccattggcacaaactgcacagcccacatcagctattgttcgtccagcatcattacaggttcccaatgtgctgcttacaagttctgactcaagtgtaattattcagcaggcagtaccttcaccaacctcaagtactgtaatcacccaggcaccatcctctaacaggccaattgtccctgtaccaggcccatttcctcttctgttacatcttcctaatggacaaaccatgcctgttgctattcctgcatcaattacaagttctaatgtgcatgttccagctgcagtcccactcgttcgaccagtcaccatggtgcctagtgttccaggaatcccaggtccttcctctccccaaccagtacagtcagaagcaaaaatgagattaaaagctgctttgacccagcaacatcctccagttaccaatggtgatactgtcaaaggtcatggtagcggattggttaggactcagtcagaggaatctcgaccgcagtcattacaacagccagccacatccactacagaaactccggcttctccagctcacacaactccacagacccaaagtacaagtggtcgtcggagaagagcagctaacgaagatcctgatgaaaaaaggagaaagtttttagagcgaaatagagcagcagcttcaagatgccgacaaaaaaggaaagtctgggttcagtctttagagaagaaagctgaagacttgagttcattaaatggtcagctgcagagtgaagtcaccctgctgagaaatgaagtggcacagctgaaacagcttcttctggctcataaagattgccctgtaaccgccatgcagaagaaatctggctatcatactgctgataaagatgatagttcagaagacatttcagtgccgagtagtccacatacagaagctatacagcatagttcggtcagcacatccaatggagtcagttcaacctccaaggcagaagctgtagccacttcagtcctcacccagatggcggaccagagtacagagcctgctctttcacagatcgttatggctccttcctcccagtcacagccctcaggaagttgattaaaaacctgcagtacaacagttttagatactcattagtgacttcaaagggaaatcaaggaaagaccagtttccatttatgcgaaatctgtggttgtaaattttttttttttacttgaaattaaatttggctctaaagttggtgtagcagcagttgatcagactgaaaaacggtttttagtctctggaaaaagactgattttgctttttttataaatattattagatttattaatttttctgtgctcaatgtgtaaattgtattataattcattgtgatttatttcacttttaatttgctggtgttttaataaatgggggtgttactgaatctttcttcccacttccatttcttttgaccaccccttaaccctcaactgtgacggtagtagtattatcatttataccaaagttttgcatagtccctgttgactttgtaatgttaacggagtcataaaagcactaggcaagagaaagatagaaatttgcttttaatctttttgccttttattttgcacattatgcaaaaggaaaaacattaaagaacacttttttttaagtgagtgaaaacatggtaaagacatacagtgcttttatgcacattgttaagctaaatcaaggtcatttataatcattttccttttttatttaagattttaagtaaacaaattttagaattttcagcatttcaaaaatgattttatttttcaagtcttaaattcaatattttacacctatgttttgaggctaaaaatatgaaattatataatgtatgatacagggttatcaaatatctaataatttttgaaattagctcttgtttttggtttttttgttgttgtttttacagatttcaggttacaaactgcaaagtttatgcataattaagtatggtatggttgccagaaaagcctaaaattactacttagaaaatttaagactgtttacccccattgtcttgtacttgcgagctaacttgtactattcttgtgaaagcactgtcatcttttagtagcaaattttgataatgtttctcgtggaaaaaaaaatcagtatctatctttagaacaatgtaattataatgtgggaagtgtgcatgaatgagagagagtgtgtgtgtatctgtgtgtgtgtgcgcgtgtgtgtgtgtcttttaatagtttatgccagcaatctttgcttgaatgtttaacgatgccttcagtgtgatgctggccaatagatgattgcagtttaaaatgtcattattgtgcaggcttggataactaacattccatgatgtagcttgtttctgatgagatgattgtaggtacatttttctcattatccaatcatctgtgggatacttagttttctaatgtgccattatctatttttattctgcagttatgttcaaaatacagtacatattttaaaatagaataaattgttaaacataaaattttaaaagtagtagatgtgcgtaagaaaactttgtaaaatagttatgagtcctacccagtagcaacttctggcattcaagcaggattccactatgtaaatatctgtaatgcatttataataagttgtgtagtttgtcctgcatccatactacactatttgctaaagtctcagtgccatctcctaatgagactgacattttaaaagtctgtatggaatatccttgataattcaaggaaatatccctcctgcctaagttccaaactgggaaacattcaaattatataaatgacatttcaggactttaagtatgaagataatgggaattttattgttttgctttttaaaatgagagcatttttatttgataattttttttaaatttttaatttttaactaatttcattattttaaagtaatcagtttttcaaatcatgattttgatatcattattctaaggagttatctcaaaggcacaaaatatgaattctgcaagaaggctattttttattgtagtttgaatgggttaggaaaagcctcaatttttcactcttaagtccttcagtacatttttctttcatcttattacttatgcaagttaaggttctttggtaacagaattcttgcaactgtaaaataaaactacatagatgtaagaagtcatgtaaacggttaacaagcttaccaaggttagcaaaactttcattgtaaatcagtctgtactgagcaaataaaaatcattattagttgtataaacacaaattccattttgactttcaggatgtcatactacttctgtacctagcattttcagtccttatatttgcaatgttacacaaactgtactattttcttttatgtgcagtttgcatgagtaaaccatcagagaataaattctatctttaaattatgttcataa

SEQ ID NO: 104070 - DNA, 1919 bp, Homo sapiens
  Payload ID: 461
  Gene Symbol: ATF2
  Gene Name: activating transcription factor 2
  Uniprot ID: P15336
  ENST ID: ENST00000392544
  CDS Start-End: 298-1815
gtgggagcccgtggcctttaaagtgccgttcagccttttcctccaggggtgctttgtaaacacggctgtgctcagggctcgcgggtgaccgaaaggatcatgaactagtgacctggaaagggtactagatggaaacttgagaaaggactgcttattgataacagctaaggtattcctggaagcagagtaaataaagctcatggcccaccagctagaaagatttcctgaagaggtagtctgattggcttaactcgtattcttgccatgagaaaaagaatgtgataagttattcaacttatgaaattcaagttacatgtgaattctgccaggcaatacaaggacctgtggaatatgagtgatgacaaaccctttctatgtactgcgcctggatgtggccagcgttttaccaacgaggatcatttggctgtccataaacataaacatgagatgacactgaaatttggtccagcacgtaatgacagtgtcattgtggctgatcagaccccaacaccaacaagattcttgaaaaactgtgaagaagtgggtttgtttaatgagttggcgagtccatttgagaatgaattcaagaaagcttcagaagatgacattaaaaaaatgcctctagatttatcccctcttgcaacacctatcataagaagcaaaattgaggagccttctgttgtagaaacaactcaccaggatagtcctttacctcacccagagtctactaccagtgatgagaaggaagtaccattggcacaaactgcacagcccacatcagctattgttcgtccagcatcattacaggttcccaatgtgctgcttacaagttctgactcaagtgtaattattcagcaggcagtaccttcaccaacctcaagtactgtaatcacccaggcaccatcctctaacaggccaattgtccctgtaccaggcccatttcctcttctgttacatcttcctaatggacaaaccatgcctgttgctattcctgcatcaattacaagttctaatgtgcatgttccagctgcagtcccactcgttcgaccagtcaccatggtgcctagtgttccaggaatcccaggtccttcctctccccaaccagtacagtcagaagcaaaaatgagattaaaagctgctttgacccagcaacatcctccagttaccaatggtgatactgtcaaaggtcatggtagcggattggttaggactcagtcagaggaatctcgaccgcagtcattacaacagccagccacatccactacagaaactccggcttctccagctcacacaactccacagacccaaagtacaagtggtcgtcggagaagagcagctaacgaagatcctgatgaaaaaaggagaaagtttttagagcgaaatagagcagcagcttcaagatgccgacaaaaaaggaaagtctgggttcagtctttagagaagaaagctgaagacttgagttcattaaatggtcagctgcagagtgaagtcaccctgctgagaaatgaagtggcacagctgaaacagcttcttctggctcataaagattgccctgtaaccgccatgcagaagaaatctggctatcatactgctgataaagatgatagttcagaagacatttcagtgccgagtagtccacatacagaagctatacagcatagttcggtcagcacatccaatggagtcagttcaacctccaaggcagaagctgtagccacttcagtcctcacccagatggcggaccagagtacagagcctgctctttcacagatcgttatggctccttcctcccagtcacagccctcaggaagttgattaaaaacctgcagtacaacagttttagatactcattagtgacttcaaagggaaatcaaggaaagaccagtttccatttatgcgaaatctgtggttgtaaattt

SEQ ID NO: 104071 - DNA, 801 bp, Homo sapiens
  Payload ID: 461
  Gene Symbol: ATF2
  Gene Name: activating transcription factor 2
  Uniprot ID: P15336
  ENST ID: ENST00000409499
  CDS Start-End: 263-697
gtgggagcccgtggcctttaaagtgccgttcagccttttcctccaggggtgctttgtaaacacggctgtgctcagggctcgcgggtgaccgaaaggatcatgaactagtgacctggaaagggtactagatggaaacttgagaaaggactgcttattgataacagctaaggtattcctggaagcagagtaaataaagctcatggcccaccagctagaaagtattcttgccatgagaaaaagaatgtgataagttattcaacttatgaaattcaagttacatgtgaattctgccaggcaatacaaggacctgtggaatatgagtgatgacaaaccctttctatgtactgcgcctggatgtggccagagtgaagtcaccctgctgagaaatgaagtggcacagctgaaacagcttcttctggctcataaagattgccctgtaaccgccatgcagaagaaatctggctatcatactgctgataaagatgatagttcagaagacatttcagtgccgagtagtccacatacagaagctatacagcatagttcggtcagcacatccaatggagtcagttcaacctccaaggcagaagctgtagccacttcagtcctcacccagatggcggaccagagtacagagcctgctctttcacagatcgttatggctccttcctcccagtcacagccctcaggaagttgattaaaaacctgcagtacaacagttttagatactcattagtgacttcaaagggaaatcaaggaaagaccagtttccatttatgcgaaatctgtggttgtaaattt

SEQ ID NO: 104072 - DNA, 3697 bp, Homo sapiens
  Payload ID: 461
  Gene Symbol: ATF2
  Gene Name: activating transcription factor 2
  ENST ID: ENST00000409437
  CDS Start-End: 184-1353
ctcatggcccaccagctagaaagtattcttgccatgagaaaaagaatgtgataagttattcaacttatgaaattcaagttacatgtgaattctgccagatactgaattcattacttaaaaccacccagaagagaaacctccaggctcagatagcttcactggcaatacaaggacctgtggaatatgagtgatgacaaaccctttctatgtactgcgcctggatgtggccagcgttttaccaacgaggatcatttggctgtccataaacataaacatgagatgacactgaaatttggtccagcacgtaatgacagtgtcattgtggctgatcagaccccaacaccaacaagattcttgaaaaactgtgaagaagtgggtttgtttaatgagttggcgagtccatttgagaatgaattcaagaaagcttcagaagatgacattaaaaaaatgcctctagatttatcccctcttgcaacacctatcataagaagcaaaattgaggagccttctgttgtagaaacaactcaccaggatagtcctttacctcacccagagtctactaccagtgatgagaagctcgttcgaccagtcaccatggtgcctagtgttccaggaatcccaggtccttcctctccccaaccagtacagtcagaagcaaaaatgagattaaaagctgctttgacccagcaacatcctccagttaccaatggtgatactgtcaaaggtcatggtagcggattggttaggactcagtcagaggaatctcgaccgcagtcattacaacagccagccacatccactacagaaactccggcttctccagctcacacaactccacagacccaaagtacaagtggtcgtcggagaagagcagctaacgaagatcctgatgaaaaaaggagaaagtttttagagcgaaatagagcagcagcttcaagatgccgacaaaaaaggaaagtctgggttcagtctttagagaagaaagctgaagacttgagttcattaaatggtcagctgcagagtgaagtcaccctgctgagaaatgaagtggcacagctgaaacagcttcttctggctcataaagattgccctgtaaccgccatgcagaagaaatctggctatcatactgctgataaagatgatagttcagaagacatttcagtgccgagtagtccacatacagaagctatacagcatagttcggtcagcacatccaatggagtcagttcaacctccaaggcagaagctgtagccacttcagtcctcacccagatggcggaccagagtacagagcctgctctttcacagatcgttatggctccttcctcccagtcacagccctcaggaagttgattaaaaacctgcagtacaacagttttagatactcattagtgacttcaaagggaaatcaaggaaagaccagtttccatttatgcgaaatctgtggttgtaaattttttttttttacttgaaattaaatttggctctaaagttggtgtagcagcagttgatcagactgaaaaacggtttttagtctctggaaaaagactgattttgctttttttataaatattattagatttattaatttttctgtgctcaatgtgtaaattgtattataattcattgtgatttatttcacttttaatttgctggtgttttaataaatgggggtgttactgaatctttcttcccacttccatttcttttgaccaccccttaaccctcaactgtgacggtagtagtattatcatttataccaaagttttgcatagtccctgttgactttgtaatgttaacggagtcataaaagcactaggcaagagaaagatagaaatttgcttttaatctttttgccttttattttgcacattatgcaaaaggaaaaacattaaagaacacttttttttaagtgagtgaaaacatggtaaagacatacagtgcttttatgcacattgttaagctaaatcaaggtcatttataatcattttccttttttatttaagattttaagtaaacaaattttagaattttcagcatttcaaaaatgattttatttttcaagtcttaaattcaatattttacacctatgttttgaggctaaaaatatgaaattatataatgtatgatacagggttatcaaatatctaataatttttgaaattagctcttgtttttggtttttttgttgttgtttttacagatttcaggttacaaactgcaaagtttatgcataattaagtatggtatggttgccagaaaagcctaaaattactacttagaaaatttaagactgtttacccccattgtcttgtacttgcgagctaacttgtactattcttgtgaaagcactgtcatcttttagtagcaaattttgataatgtttctcgtggaaaaaaaaatcagtatctatctttagaacaatgtaattataatgtgggaagtgtgcatgaatgagagagagtgtgtgtgtatctgtgtgtgtgtgcgcgtgtgtgtgtgtcttttaatagtttatgccagcaatctttgcttgaatgtttaacgatgccttcagtgtgatgctggccaatagatgattgcagtttaaaatgtcattattgtgcaggcttggataactaacattccatgatgtagcttgtttctgatgagatgattgtaggtacatttttctcattatccaatcatctgtgggatacttagttttctaatgtgccattatctatttttattctgcagttatgttcaaaatacagtacatattttaaaatagaataaattgttaaacataaaattttaaaagtagtagatgtgcgtaagaaaactttgtaaaatagttatgagtcctacccagtagcaacttctggcattcaagcaggattccactatgtaaatatctgtaatgcatttataataagttgtgtagtttgtcctgcatccatactacactatttgctaaagtctcagtgccatctcctaatgagactgacattttaaaagtctgtatggaatatccttgataattcaaggaaatatccctcctgcctaagttccaaactgggaaacattcaaattatataaatgacatttcaggactttaagtatgaagataatgggaattttattgttttgctttttaaaatgagagcatttttatttgataattttttttaaatttttaatttttaactaatttcattattttaaagtaatcagtttttcaaatcatgattttgatatcattattctaaggagttatctcaaaggcacaaaatatgaattctgcaagaaggctattttttattgtagtttgaatgggttaggaaaagcctcaatttttcactcttaagtccttcagtacatttttctttcatcttattacttatgcaagttaaggttctttggtaacagaattcttgcaactgtaaaataaaactacatagatgtaagaagtcatgtaaacggttaacaagcttaccaaggttagcaaaactttcattgtaaatcagtctgtactgagcaaataaaaatcattattagttgtataaacacaaattccattttgactttcaggatgtcatactacttctgtacctagcattttcagtccttatatttgcaatgttacacaaactgtactattttcttttatgtgcagtttgcatgagtaaaccatcagagaataaattctatcttt

SEQ ID NO: 104073 - DNA, 1335 bp, Homo sapiens
  Payload ID: 461
  Gene Symbol: ATF2
  Gene Name: activating transcription factor 2
  Uniprot ID: P15336
  ENST ID: ENST00000409833
  CDS Start-End: 263-892
gtgggagcccgtggcctttaaagtgccgttcagccttttcctccaggggtgctttgtaaacacggctgtgctcagggctcgcgggtgaccgaaaggatcatgaactagtgacctggaaagggtactagatggaaacttgagaaaggactgcttattgataacagctaaggtattcctggaagcagagtaaataaagctcatggcccaccagctagaaagtattcttgccatgagaaaaagaatgtgataagttattcaacttatgaaattcaagttacatgtgaattctgccaggcaatacaaggacctgtggaatatgagtgatgacaaaccctttctatgtactgcgcctggatgtggccagcgttttaccaacgaggatcatttggctgtccataaacataaacatgagatgacactgaaatttggtccagcacgtaatgacagtgtcattgtggctgatcagaccccaacaccaacaagattcttgaaaaactgtgaagaagtgggtttgtttaatgagttggcgagtccatttgagaatgaattcaagaaagcttcagaagatgacattaaaaaaatgcctctagatttatcccctcttgcaacacctatcataagaagcaaaattgaggagccttctgttgtagaaacaactcaccaggatagtcctttacctcacccagagtctactaccagtgatgagaaggaagtaccattggcacaaactgcacagcccacatcagctattgttcgtccagcatcattacaggttcccaatgtgctgcttacaagttctgactcaagtgtaattattcagcaggcagtaccttcaccaacctcaagtactgtaatcacccaggcaccatcctctaacaggccaattgtgtaagtgattcaggccaatcattgaacatatacatgaattaagtttgttttgtaatgatttttcctaagacatttgattattcaaactaagatcttagttttgtatgtgtgtgcatgcttcgaattttggaaaaagtacttgcgtagtcttctttaatataaatattaactaacagagtgggagataaatacaactaaaaacaaatatagaatgtgaatttaagatagtcttattttcatgctatttcacacaaaatataaaattactgcatcaccagattccatttctttcagttcttactggtagctcccaagagctctctgatgacagtttttctcattttacaaattggagattgtcctaagtaaatccataacttttctcttcttttcaatactgctacacaggttatgcatttaagatgcaattaaaaataattaaatttt

SEQ ID NO: 104074 - DNA, 2109 bp, Homo sapiens
  Payload ID: 461
  Gene Symbol: ATF2
  Gene Name: activating transcription factor 2
  Uniprot ID: P15336
  ENST ID: ENST00000409635
  CDS Start-End: 437-1780
gtcagtccgatctcgcgagagaggacggaagcctgtgggagcccgtggcctttaaagtgccgttcagccttttcctccaggggtgctttgtaaacacggctgtgctcagggctcgcgggtgaccgaaaggatcatgaactagtgacctggaaagggtactagatggaaacttgagaaaggactgcttattgataacagctaaggtattcctggaagcagagtaaataaagctcatggcccaccagctagaaagtattcttgccatgagaaaaagaatgtgataagttattcaacttatgaaattcaagttacatgtgaattctgccagatactgaattcattacttaaaaccacccagaagagaaacctccaggctcagatagcttcactggcaatacaaggacctgtggaatatgagtgatgacaaaccctttctatgtactgcgcctggatgtggccagatcagaccccaacaccaacaagattcttgaaaaactgtgaagaagtgggtttgtttaatgagttggcgagtccatttgagaatgaattcaagaaagcttcagaagatgacattaaaaaaatgcctctagatttatcccctcttgcaacacctatcataagaagcaaaattgaggagccttctgttgtagaaacaactcaccaggatagtcctttacctcacccagagtctactaccagtgatgagaaggaagtaccattggcacaaactgcacagcccacatcagctattgttcgtccagcatcattacaggttcccaatgtgctgcttacaagttctgactcaagtgtaattattcagcaggcagtaccttcaccaacctcaagtactgtaatcacccaggcaccatcctctaacaggccaattgtccctgtaccaggcccatttcctcttctgttacatcttcctaatggacaaaccatgcctgttgctattcctgcatcaattacaagttctaatgtgcatgttccagctgcagtcccactcgttcgaccagtcaccatggtgcctagtgttccaggaatcccaggtccttcctctccccaaccagtacagtcagaagcaaaaatgagattaaaagctgctttgacccagcaacatcctccagttaccaatggtgatactgtcaaaggtcatggtagcggattggttaggactcagtcagaggaatctcgaccgcagtcattacaacagccagccacatccactacagaaactccggcttctccagctcacacaactccacagacccaaagtacaagtggtcgtcggagaagagcagctaacgaagatcctgatgaaaaaaggagaaagtttttagagcgaaatagagcagcagcttcaagatgccgacaaaaaaggaaagtctgggttcagtctttagagaagaaagctgaagacttgagttcattaaatggtcagctgcagagtgaagtcaccctgctgagaaatgaagtggcacagctgaaacagcttcttctggctcataaagattgccctgtaaccgccatgcagaagaaatctggctatcatactgctgataaagatgatagttcagaagacatttcagtgccgagtagtccacatacagaagctatacagcatagttcggtcagcacatccaatggagtcagttcaacctccaaggcagaagctgtagccacttcagtcctcacccagatggcggaccagagtacagagcctgctctttcacagatcgttatggctccttcctcccagtcacagccctcaggaagttgattaaaaacctgcagtacaacagttttagatactcattagtgacttcaaagggaaatcaaggaaagaccagtttccatttatgcgaaatctgtggttgtaaattttttttttttacttgaaattaaatttggctctaaagttggtgtagcagcagttgatcagactgaaaaacggtttttagtctctggaaaaagactgattttgctttttttataaatattattagatttattaatttttctgtgctcaatgtgtaaattgtattataattcattgtgatttatttcacttttaatttgctggtgttttaataaatgggggtgttactg

SEQ ID NO: 104075 - DNA, 2113 bp, Homo sapiens
  Payload ID: 461
  Gene Symbol: ATF2
  Gene Name: activating transcription factor 2
  ENST ID: ENST00000417080
  CDS Start-End: 298-1485
gtgggagcccgtggcctttaaagtgccgttcagccttttcctccaggggtgctttgtaaacacggctgtgctcagggctcgcgggtgaccgaaaggatcatgaactagtgacctggaaagggtactagatggaaacttgagaaaggactgcttattgataacagctaaggtattcctggaagcagagtaaataaagctcatggcccaccagctagaaagatttcctgaagaggtagtctgattggcttaactcgtattcttgccatgagaaaaagaatgtgataagttattcaacttatgaaattcaagttacatgtgaattctgccaggcaatacaaggacctgtggaatatgagtgatgacaaaccctttctatgtactgcgcctggatgtggccagcgttttaccaacgaggatcatttggctgtccataaacataaacatgagatgacactgaaatttggtccagcacgtaatgacagtgtcattgtggctgatcagaccccaacaccaacaagattcttgaaaaactgtgaagaagtgggtttgtttaatgagttggcgagtccatttgagaatgaattcaagaaagcttcagaagatgacattaaaaaaatgcctctagatttatcccctcttgcaacacctatcataagaagcaaaattgaggagccttctgttgtagaaacaactcaccaggatagtcctttacctcacccagagtctactaccagtgatgagaaggaagtaccattggcacaaactgcacagcccacatcagctattgttcgtccagcatcattacaggttcccaatgtgctgcttacaagttctgactcaagtgtaattattcagcaggcagtaccttcaccaacctcaagtactgtaatcacccaggcaccatcctctaacaggccaattgtccctgtaccaggcccatttcctcttctgttacatcttcctaatggacaaaccatgcctgttgctattcctgcatcaattacaagttctaatgtgcatgttccagctgcagtcccactcgttcgaccagtcaccatggtgcctagtgttccaggaatcccaggtccttcctctccccaaccagtacagtcagaagcaaaaatgagattaaaagctgctttgacccagcaacatcctccagttaccaatggtgatactgtcaaaggtcatggtagcggattggttaggactcagtcagaggaatctcgaccgcagtcattacaacagccagccacatccactacagaaactccggcttctccagctcacacaactccacagacccaaagtacaagtggtcgtcggagaagagcagctaacgaagatcctgatgaaaaaaggagaaagtttttagagcgaaatagagcagcagcttcaagatgccgacaaaaaaggaaagtctgggttcagtctttagagaagaaagctgaagacttgagttcattaaatggtcagctgcagtgaatatattgctcgtgaaaggtgccagattgacagctttggaaactgaaggactctaattatccacagaccagagtgaagtcaccctgctgagaaatgaagtggcacagctgaaacagcttcttctggctcataaagattgccctgtaaccgccatgcagaagaaatctggctatcatacaaatatttcttcagctctattccataaggcagtgggcacccagatgtttccatatgcatggttgtgccttcttttgacctattgcaggaaaatgaataatttttcttttttccacccagctgctgataaagatgatagttcagaagacatttcagtgccgagtagtccacatacagaagctatacagcatagttcggtcagcacatccaatggagtcagttcaacctccaaggcagaagctgtagccacttcagtcctcacccagatggcggaccagagtacagagcctgctctttcacagatcgttatggctccttcctcccagtcacagccctcaggaagttgattaaaaacctgcagtacaacagttttagatactcattagtgacttcaaagggaaatcaaggaaagaccagtttccatttatgcgaaatctgtggttgtaaattt

SEQ ID NO: 104076 - DNA, 1861 bp, Homo sapiens
  Payload ID: 461
  Gene Symbol: ATF2
  Gene Name: activating transcription factor 2
  ENST ID: ENST00000456655
  CDS Start-End: 263-394
gtgggagcccgtggcctttaaagtgccgttcagccttttcctccaggggtgctttgtaaacacggctgtgctcagggctcgcgggtgaccgaaaggatcatgaactagtgacctggaaagggtactagatggaaacttgagaaaggactgcttattgataacagctaaggtattcctggaagcagagtaaataaagctcatggcccaccagctagaaagtattcttgccatgagaaaaagaatgtgataagttattcaacttatgaaattcaagttacatgtgaattctgccaggcaatacaaggacctgtggaatatgagtgatgacaaaccctttctatgtactgcgcctggatgtggccagatcagaccccaacaccaacaagattcttgaaaaactgtgaagaagtgggtttgtttaatgagttggcgagtccatttgagaatgaattcaagaaagcttcagaagatgacattaaaaaaatgcctctagatttatcccctcttgcaacacctatcataagaagcaaaattgaggagccttctgttgtagaaacaactcaccaggatagtcctttacctcacccagagtctactaccagtgatgagaaggaagtaccattggcacaaactgcacagcccacatcagctattgttcgtccagcatcattacaggttcccaatgtgctgcttacaagttctgactcaagtgtaattattcagcaggcagtaccttcaccaacctcaagtactgtaatcacccaggcaccatcctctaacaggccaattgtccctgtaccaggcccatttcctcttctgttacatcttcctaatggacaaaccatgcctgttgctattcctgcatcaattacaagttctaatgtgcatgttccagctgcagtcccactcgttcgaccagtcaccatggtgcctagtgttccaggaatcccaggtccttcctctccccaaccagtacagtcagaagcaaaaatgagattaaaagctgctttgacccagcaacatcctccagttaccaatggtgatactgtcaaaggtcatggtagcggattggttaggactcagtcagaggaatctcgaccgcagtcattacaacagccagccacatccactacagaaactccggcttctccagctcacacaactccacagacccaaagtacaagtggtcgtcggagaagagcagctaacgaagatcctgatgaaaaaaggagaaagtttttagagcgaaatagagcagcagcttcaagatgccgacaaaaaaggaaagtctgggttcagtctttagagaagaaagctgaagacttgagttcattaaatggtcagctgcagtgaatatattgctcgtgaaaggtgccagattgacagctttggaaactgaaggactctaattatccacagaccagagtgaagtcaccctgctgagaaatgaagtggcacagctgaaacagcttcttctggctcataaagattgccctgtaaccgccatgcagaagaaatctggctatcatactgctgataaagatgatagttcagaagacatttcagtgccgagtagtccacatacagaagctatacagcatagttcggtcagcacatccaatggagtcagttcaacctccaaggcagaagctgtagccacttcagtcctcacccagatggcggaccagagtacagagcctgctctttcacagatcgttatggctccttcctcccagtcacagccctcaggaagttgattaaaaacctgcagtacaacagttttagatactcattagtgacttcaaagggaaatcaaggaaagaccagtttccatttatgcgaaatctgtggttgtaaattt

SEQ ID NO: 104077 - DNA, 2081 bp, Homo sapiens
  Payload ID: 461
  Gene Symbol: ATF2
  Gene Name: activating transcription factor 2
  ENST ID: ENST00000429579
  CDS Start-End: 298-1485
gtgggagcccgtggcctttaaagtgccgttcagccttttcctccaggggtgctttgtaaacacggctgtgctcagggctcgcgggtgaccgaaaggatcatgaactagtgacctggaaagggtactagatggaaacttgagaaaggactgcttattgataacagctaaggtattcctggaagcagagtaaataaagctcatggcccaccagctagaaagatttcctgaagaggtagtctgattggcttaactcgtattcttgccatgagaaaaagaatgtgataagttattcaacttatgaaattcaagttacatgtgaattctgccaggcaatacaaggacctgtggaatatgagtgatgacaaaccctttctatgtactgcgcctggatgtggccagcgttttaccaacgaggatcatttggctgtccataaacataaacatgagatgacactgaaatttggtccagcacgtaatgacagtgtcattgtggctgatcagaccccaacaccaacaagattcttgaaaaactgtgaagaagtgggtttgtttaatgagttggcgagtccatttgagaatgaattcaagaaagcttcagaagatgacattaaaaaaatgcctctagatttatcccctcttgcaacacctatcataagaagcaaaattgaggagccttctgttgtagaaacaactcaccaggatagtcctttacctcacccagagtctactaccagtgatgagaaggaagtaccattggcacaaactgcacagcccacatcagctattgttcgtccagcatcattacaggttcccaatgtgctgcttacaagttctgactcaagtgtaattattcagcaggcagtaccttcaccaacctcaagtactgtaatcacccaggcaccatcctctaacaggccaattgtccctgtaccaggcccatttcctcttctgttacatcttcctaatggacaaaccatgcctgttgctattcctgcatcaattacaagttctaatgtgcatgttccagctgcagtcccactcgttcgaccagtcaccatggtgcctagtgttccaggaatcccaggtccttcctctccccaaccagtacagtcagaagcaaaaatgagattaaaagctgctttgacccagcaacatcctccagttaccaatggtgatactgtcaaaggtcatggtagcggattggttaggactcagtcagaggaatctcgaccgcagtcattacaacagccagccacatccactacagaaactccggcttctccagctcacacaactccacagacccaaagtacaagtggtcgtcggagaagagcagctaacgaagatcctgatgaaaaaaggagaaagtttttagagcgaaatagagcagcagcttcaagatgccgacaaaaaaggaaagtctgggttcagtctttagagaagaaagctgaagacttgagttcattaaatggtcagctgcagtgaatatattgctcgtgaaaggtgccagattgacagctttggaaactgaaggactctaattatccacagaccagagtgaagtcaccctgctgagaaatgaagtggcacagctgaaacagcttcttctggctcataaagattgccctgtaaccgccatgcagaagaaatctggctatcatacaaatatttcttcagctctattccataaggcagtgggcacccagatgtttccatatgcatggttgtgccttcttttgacctattgcagctgctgataaagatgatagttcagaagacatttcagtgccgagtagtccacatacagaagctatacagcatagttcggtcagcacatccaatggagtcagttcaacctccaaggcagaagctgtagccacttcagtcctcacccagatggcggaccagagtacagagcctgctctttcacagatcgttatggctccttcctcccagtcacagccctcaggaagttgattaaaaacctgcagtacaacagttttagatactcattagtgacttcaaagggaaatcaaggaaagaccagtttccatttatgcgaaatctgtggttgtaaattt

SEQ ID NO: 104078 - DNA, 1115 bp, Homo sapiens
  Payload ID: 461
  Gene Symbol: ATF2
  Gene Name: activating transcription factor 2
  ENST ID: ENST00000435004
  CDS Start-End: 1-797
aatacaaggacctgtggaatatgagtgatgacaaaccctttctatgtactgcgcctggatgtggccagcgttttaccaacgaggatcatttggctgtccataaacataaacatgagatgacactgaaatttggtccagcacgtaatgacagtgtcattgtggctgatcagaccccaacaccaacaagattcttgaaaaactgtgaagaagtgggtttgtttaatgagttggcgagtccatttgagaatgaattcaagaaagcttcagaagatgacattaaaaaaatgcctctagatttatcccctcttgcaacacctatcataagaagcaaaattgaggagccttctgttgtagaaacaactcaccaggatagtcctttacctcacccagagtctactaccagtgatgagaaggaagtaccattggcacaaactgcacagcccacatcagctattgttcgtccagcttctccagctcacacaactccacagacccaaagtacaagtggtcgtcggagaagagcagctaacgaagatcctgatgaaaaaaggagaaagtttttagagcgaaatagagcagcagcttcaagatgccgacaaaaaaggaaagtctgggttcagtctttagagaagaaagctgaagacttgagttcattaaatggtcagctgcagctgctgataaagatgatagttcagaagacatttcagtgccgagtagtccacatacagaagctatacagcatagttcggtcagcacatccaatggagtcagttcaacctccaaggcagaagctgtagccacttcagtcctcacccagatggcggaccagagtacagagcctgctctttcacagatcgttatggctccttcctcccagtcacagccctcaggaagttgattaaaaacctgcagtacaacagttttagatactcattagtgacttcaaagggaaatcaaggaaagaccagtttccatttatgcgaaatctgtggttgtaaattttttttttttacttgaaattaaatttggctctaaagttggtgtagcagcagttgatcagactgaaaaacggtttttagtctctggaaaaagactgattttgctttttttataaa

SEQ ID NO: 104079 - DNA, 4132 bp, Homo sapiens
  Payload ID: 461
  Gene Symbol: ATF2
  Gene Name: activating transcription factor 2
  Uniprot ID: P15336
  ENST ID: ENST00000426833
  CDS Start-End: 314-1777
gttgtcagtccgatctcgcgagagaggacggaagcctgtgggagcccgtggcctttaaagtgccgttcagccttttcctccaggggtgctttgtaaacacggctgtgctcagggctcgcgggtgaccgaaaggatcatgaactagtgacctggaaagggtactagatggaaacttgagaaaggactgcttattgataacagctaaggtattcctggaagcagagtaaataaagctcatggcccaccagctagaaagatttcctgaagaggtagtctgattggcttaactcggcaatacaaggacctgtggaatatgagtgatgacaaaccctttctatgtactgcgcctggatgtggccagcgttttaccaacgaggatcatttggctgtccataaacataaacatgagatgacactgaaatttggtccagcacgtaatgacagtgtcattgtggctgatcagaccccaacaccaacaagattcttgaaaaactgtgaagaagtgggtttgtttaatgagttggcgagtccatttgagaatgaattcaagaaagcttcagaagatgacattaaaaaaatgcctctagatttatcccctcttgcaacacctatcataagaagcaaaattgaggagccttctgttgtagaaacaactcaccaggatagtcctttacctcacccagagtctactaccagtgatgagaaggaagtaccattggcacaaactgcacagcccacatcagctattgttcgtccagcatcattacaggttcccaatgtgctgcttacaagttctgactcaagtgtaattattcagcaggcagtaccttcaccaacctcaagtactgtaatcacccaggcaccatcctctaacaggccaattgtccctgtaccaggcccatttcctcttctgttacatcttcctaatggacaaaccatgcctgttgctattcctgcatcaattacaagttctaatgtgcatgttccagctgcagtcccactcgttcgaccagtcaccatggtgcctagtgttccaggaatcccaggtccttcctctccccaaccagtacagtcagaagcaaaaatgagattaaaagctgctttgacccagcaacatcctccagttaccaatggtgatactgtcaaaggtcatggtagcggattggttaggactcagtcagaggaatctcgaccgcagtcattacaacagccagccacatccactacagaaactccggcttctccagctcacacaactccacagacccaaagtacaagtggtcgtcggagaagagcagctaacgaagatcctgatgaaaaaaggagaaagtttttagagcgaaatagagcagcagcttcaagatgccgacaaaaaaggaaagtctgggttcagtctttagagaagaaagctgaagacttgagttcattaaatggtcagctgcagagtgaagtcaccctgctgagaaatgaagtggcacagctgaaacagcttcttctggctcataaagattgccctgtaaccgccatgcagaagaaatctggctatcatactgctgataaagatgatagttcagaagacatttcagtgccgagtagtccacatacagaagctatacagcatagttcggtcagcacatccaatggagtcagttcaacctccaaggcagaagctgtagccacttcagtcctcacccagatggcggaccagagtacagagcctgctctttcacagatcgttatggctccttcctcccagtcacagccctcaggaagttgattaaaaacctgcagtacaacagttttagatactcattagtgacttcaaagggaaatcaaggaaagaccagtttccatttatgcgaaatctgtggttgtaaattttttttttttacttgaaattaaatttggctctaaagttggtgtagcagcagttgatcagactgaaaaacggtttttagtctctggaaaaagactgattttgctttttttataaatattattagatttattaatttttctgtgctcaatgtgtaaattgtattataattcattgtgatttatttcacttttaatttgctggtgttttaataaatgggggtgttactgaatctttcttcccacttccatttcttttgaccaccccttaaccctcaactgtgacggtagtagtattatcatttataccaaagttttgcatagtccctgttgactttgtaatgttaacggagtcataaaagcactaggcaagagaaagatagaaatttgcttttaatctttttgccttttattttgcacattatgcaaaaggaaaaacattaaagaacacttttttttaagtgagtgaaaacatggtaaagacatacagtgcttttatgcacattgttaagctaaatcaaggtcatttataatcattttccttttttatttaagattttaagtaaacaaattttagaattttcagcatttcaaaaatgattttatttttcaagtcttaaattcaatattttacacctatgttttgaggctaaaaatatgaaattatataatgtatgatacagggttatcaaatatctaataatttttgaaattagctcttgtttttggtttttttgttgttgtttttacagatttcaggttacaaactgcaaagtttatgcataattaagtatggtatggttgccagaaaagcctaaaattactacttagaaaatttaagactgtttacccccattgtcttgtacttgcgagctaacttgtactattcttgtgaaagcactgtcatcttttagtagcaaattttgataatgtttctcgtggaaaaaaaaatcagtatctatctttagaacaatgtaattataatgtgggaagtgtgcatgaatgagagagagtgtgtgtgtatctgtgtgtgtgtgcgcgtgtgtgtgtgtcttttaatagtttatgccagcaatctttgcttgaatgtttaacgatgccttcagtgtgatgctggccaatagatgattgcagtttaaaatgtcattattgtgcaggcttggataactaacattccatgatgtagcttgtttctgatgagatgattgtaggtacatttttctcattatccaatcatctgtgggatacttagttttctaatgtgccattatctatttttattctgcagttatgttcaaaatacagtacatattttaaaatagaataaattgttaaacataaaattttaaaagtagtagatgtgcgtaagaaaactttgtaaaatagttatgagtcctacccagtagcaacttctggcattcaagcaggattccactatgtaaatatctgtaatgcatttataataagttgtgtagtttgtcctgcatccatactacactatttgctaaagtctcagtgccatctcctaatgagactgacattttaaaagtctgtatggaatatccttgataattcaaggaaatatccctcctgcctaagttccaaactgggaaacattcaaattatataaatgacatttcaggactttaagtatgaagataatgggaattttattgttttgctttttaaaatgagagcatttttatttgataattttttttaaatttttaatttttaactaatttcattattttaaagtaatcagtttttcaaatcatgattttgatatcattattctaaggagttatctcaaaggcacaaaatatgaattctgcaagaaggctattttttattgtagtttgaatgggttaggaaaagcctcaatttttcactcttaagtccttcagtacatttttctttcatcttattacttatgcaagttaaggttctttggtaacagaattcttgcaactgtaaaataaaactacatagatgtaagaagtcatgtaaacggttaacaagcttaccaaggttagcaaaactttcattgtaaatcagtctgtactgagcaaataaaaatcattattagttgtataaacacaaattccattttgactttcaggatgtcatactacttctgtacctagcattttcagtccttatatttgcaatgttacacaaactgtactattttcttttatgtgcagtttgcatgagtaaaccatcagagaataaattctatctttaaattatgttc

SEQ ID NO: 104080 - DNA, 1896 bp, Homo sapiens
  Payload ID: 461
  Gene Symbol: ATF2
  Gene Name: activating transcription factor 2
  ENST ID: ENST00000415955
  CDS Start-End: 298-429
gtgggagcccgtggcctttaaagtgccgttcagccttttcctccaggggtgctttgtaaacacggctgtgctcagggctcgcgggtgaccgaaaggatcatgaactagtgacctggaaagggtactagatggaaacttgagaaaggactgcttattgataacagctaaggtattcctggaagcagagtaaataaagctcatggcccaccagctagaaagatttcctgaagaggtagtctgattggcttaactcgtattcttgccatgagaaaaagaatgtgataagttattcaacttatgaaattcaagttacatgtgaattctgccaggcaatacaaggacctgtggaatatgagtgatgacaaaccctttctatgtactgcgcctggatgtggccagatcagaccccaacaccaacaagattcttgaaaaactgtgaagaagtgggtttgtttaatgagttggcgagtccatttgagaatgaattcaagaaagcttcagaagatgacattaaaaaaatgcctctagatttatcccctcttgcaacacctatcataagaagcaaaattgaggagccttctgttgtagaaacaactcaccaggatagtcctttacctcacccagagtctactaccagtgatgagaaggaagtaccattggcacaaactgcacagcccacatcagctattgttcgtccagcatcattacaggttcccaatgtgctgcttacaagttctgactcaagtgtaattattcagcaggcagtaccttcaccaacctcaagtactgtaatcacccaggcaccatcctctaacaggccaattgtccctgtaccaggcccatttcctcttctgttacatcttcctaatggacaaaccatgcctgttgctattcctgcatcaattacaagttctaatgtgcatgttccagctgcagtcccactcgttcgaccagtcaccatggtgcctagtgttccaggaatcccaggtccttcctctccccaaccagtacagtcagaagcaaaaatgagattaaaagctgctttgacccagcaacatcctccagttaccaatggtgatactgtcaaaggtcatggtagcggattggttaggactcagtcagaggaatctcgaccgcagtcattacaacagccagccacatccactacagaaactccggcttctccagctcacacaactccacagacccaaagtacaagtggtcgtcggagaagagcagctaacgaagatcctgatgaaaaaaggagaaagtttttagagcgaaatagagcagcagcttcaagatgccgacaaaaaaggaaagtctgggttcagtctttagagaagaaagctgaagacttgagttcattaaatggtcagctgcagtgaatatattgctcgtgaaaggtgccagattgacagctttggaaactgaaggactctaattatccacagaccagagtgaagtcaccctgctgagaaatgaagtggcacagctgaaacagcttcttctggctcataaagattgccctgtaaccgccatgcagaagaaatctggctatcatactgctgataaagatgatagttcagaagacatttcagtgccgagtagtccacatacagaagctatacagcatagttcggtcagcacatccaatggagtcagttcaacctccaaggcagaagctgtagccacttcagtcctcacccagatggcggaccagagtacagagcctgctctttcacagatcgttatggctccttcctcccagtcacagccctcaggaagttgattaaaaacctgcagtacaacagttttagatactcattagtgacttcaaagggaaatcaaggaaagaccagtttccatttatgcgaaatctgtggttgtaaattt

SEQ ID NO: 104081 - DNA, 1966 bp, Homo sapiens
  Payload ID: 461
  Gene Symbol: ATF2
  Gene Name: activating transcription factor 2
  ENST ID: ENST00000421438
  CDS Start-End: 298-1011
gtgggagcccgtggcctttaaagtgccgttcagccttttcctccaggggtgctttgtaaacacggctgtgctcagggctcgcgggtgaccgaaaggatcatgaactagtgacctggaaagggtactagatggaaacttgagaaaggactgcttattgataacagctaaggtattcctggaagcagagtaaataaagctcatggcccaccagctagaaagatttcctgaagaggtagtctgattggcttaactcgtattcttgccatgagaaaaagaatgtgataagttattcaacttatgaaattcaagttacatgtgaattctgccaggcaatacaaggacctgtggaatatgagtgatgacaaaccctttctatgtactgcgcctggatgtggccagcgttttaccaacgaggatcatttggctgtccataaacataaacatgagatgacactgaaatttggtccagcacgtaatgacagtgtcattgtggctgatcagaccccaacaccaacaagattcttgaaaaactgtgaagaagtgggtttgtttaatgagttggcgagtccatttgagaatgaattcaagaaagcttcagaagatgacattaaaaaaatgcctctagatttatcccctcttgcaacacctatcataagaagcaaaattgaggagccttctgttgtagaaacaactcaccaggatagtcctttacctcacccagagtctactaccagtgatgagaaggaagtaccattggcacaaactgcacagcccacatcagctattgttcgtccagcatcattacaggttcccaatgtgctgcttacaagttctgactcaagtgtaattattcagcaggcagtaccttcaccaacctcaagtactgtaatcacccaggcaccatcctctaacaggccaattgtctcgttcgaccagtcaccatggtgcctagtgttccaggaatcccaggtccttcctctccccaaccagtacagtcagaagcaaaaatgagattaaaagctgctttgacccagcaacatcctccagttaccaatggtgatactgtcaaaggtcatggtagcggattggttaggactcagtcagaggaatctcgaccgcagtcattacaacagccagccacatccactacagaaactccggcttctccagctcacacaactccacagacccaaagtacaagtggtcgtcggagaagagcagctaacgaagatcctgatgaaaaaaggagaaagtttttagagcgaaatagagcagcagcttcaagatgccgacaaaaaaggaaagtctgggttcagtctttagagaagaaagctgaagacttgagttcattaaatggtcagctgcagtgaatatattgctcgtgaaaggtgccagattgacagctttggaaactgaaggactctaattatccacagaccagagtgaagtcaccctgctgagaaatgaagtggcacagctgaaacagcttcttctggctcataaagattgccctgtaaccgccatgcagaagaaatctggctatcatacaaatatttcttcagctctattccataaggcagtgggcacccagatgtttccatatgcatggttgtgccttcttttgacctattgcagctgctgataaagatgatagttcagaagacatttcagtgccgagtagtccacatacagaagctatacagcatagttcggtcagcacatccaatggagtcagttcaacctccaaggcagaagctgtagccacttcagtcctcacccagatggcggaccagagtacagagcctgctctttcacagatcgttatggctccttcctcccagtcacagccctcaggaagttgattaaaaacctgcagtacaacagttttagatactcattagtgacttcaaagggaaatcaaggaaagaccagtttccatttatgcgaaatctgtggttgtaaattt

SEQ ID NO: 104082 - DNA, 1989 bp, Homo sapiens
  Payload ID: 461
  Gene Symbol: ATF2
  Gene Name: activating transcription factor 2
  ENST ID: ENST00000428760
  CDS Start-End: 263-1450
gtgggagcccgtggcctttaaagtgccgttcagccttttcctccaggggtgctttgtaaacacggctgtgctcagggctcgcgggtgaccgaaaggatcatgaactagtgacctggaaagggtactagatggaaacttgagaaaggactgcttattgataacagctaaggtattcctggaagcagagtaaataaagctcatggcccaccagctagaaagtattcttgccatgagaaaaagaatgtgataagttattcaacttatgaaattcaagttacatgtgaattctgccaggcaatacaaggacctgtggaatatgagtgatgacaaaccctttctatgtactgcgcctggatgtggccagcgttttaccaacgaggatcatttggctgtccataaacataaacatgagatgacactgaaatttggtccagcacgtaatgacagtgtcattgtggctgatcagaccccaacaccaacaagattcttgaaaaactgtgaagaagtgggtttgtttaatgagttggcgagtccatttgagaatgaattcaagaaagcttcagaagatgacattaaaaaaatgcctctagatttatcccctcttgcaacacctatcataagaagcaaaattgaggagccttctgttgtagaaacaactcaccaggatagtcctttacctcacccagagtctactaccagtgatgagaaggaagtaccattggcacaaactgcacagcccacatcagctattgttcgtccagcatcattacaggttcccaatgtgctgcttacaagttctgactcaagtgtaattattcagcaggcagtaccttcaccaacctcaagtactgtaatcacccaggcaccatcctctaacaggccaattgtccctgtaccaggcccatttcctcttctgttacatcttcctaatggacaaaccatgcctgttgctattcctgcatcaattacaagttctaatgtgcatgttccagctgcagtcccactcgttcgaccagtcaccatggtgcctagtgttccaggaatcccaggtccttcctctccccaaccagtacagtcagaagcaaaaatgagattaaaagctgctttgacccagcaacatcctccagttaccaatggtgatactgtcaaaggtcatggtagcggattggttaggactcagtcagaggaatctcgaccgcagtcattacaacagccagccacatccactacagaaactccggcttctccagctcacacaactccacagacccaaagtacaagtggtcgtcggagaagagcagctaacgaagatcctgatgaaaaaaggagaaagtttttagagcgaaatagagcagcagcttcaagatgccgacaaaaaaggaaagtctgggttcagtctttagagaagaaagctgaagacttgagttcattaaatggtcagctgcagtgaatatattgctcgtgaaaggtgccagattgacagctttggaaactgaaggactctaattatccacagaccagagtgaagtcaccctgctgagaaatgaagtggcacagctgaaacagcttcttctggctcataaagattgccctgtaaccgccatgcagaagaaatctggctatcatactgctgataaagatgatagttcagaagacatttcagtgccgagtagtccacatacagaagctatacagcatagttcggtcagcacatccaatggagtcagttcaacctccaaggcagaagctgtagccacttcagtcctcacccagatggcggaccagagtacagagcctgctctttcacagatcgttatggctccttcctcccagtcacagccctcaggaagttgattaaaaacctgcagtacaacagttttagatactcattagtgacttcaaagggaaatcaaggaaagaccagtttccatttatgcgaaatctgtggttgtaaattttttttttttacttgaaattaaatttggctct

SEQ ID NO: 104083 - DNA, 784 bp, Homo sapiens
  Payload ID: 461
  Gene Symbol: ATF2
  Gene Name: activating transcription factor 2
  ENST ID: ENST00000435231
  CDS Start-End: 262-393
tgggagcccgtggcctttaaagtgccgttcagccttttcctccaggggtgctttgtaaacacggctgtgctcagggctcgcgggtgaccgaaaggatcatgaactagtgacctggaaagggtactagatggaaacttgagaaaggactgcttattgataacagctaaggtattcctggaagcagagtaaataaagctcatggcccaccagctagaaagtattcttgccatgagaaaaagaatgtgataagttattcaacttatgaaattcaagttacatgtgaattctgccaggcaatacaaggacctgtggaatatgagtgatgacaaaccctttctatgtactgcgcctggatgtggccagatcagaccccaacaccaacaagattcttgaaaaactgtgaagaagtgggtttgtttaatgagttggcgagtccatttgagaatgaattcaagaaagcttcagaagatgacattaaaaaagaagtaccattggcacaaactgcacagcccacatcagctattgttcgtccagcatcattacaggttcccaatgtgctgcttacaagttctgactcaagtgtaattattcagcaggcagtaccttcaccaacctcaagtactgtaatcacccaggcaccatcctctaacaggccaattgtccctgtaccaggcccatttcctcttctgttacatcttcctaatggacaaaccatgcctgttgctattcctgcatcaattacaagttctaatgtgcatgttccagctgcagtcccactcgttcg

SEQ ID NO: 104084 - DNA, 883 bp, Homo sapiens
  Payload ID: 461
  Gene Symbol: ATF2
  Gene Name: activating transcription factor 2
  ENST ID: ENST00000437522
  CDS Start-End: 317-883
gatgcccgtcccctctacccgccctgccgaagacccgccttcttctccttaagcctgacggaatcacctgactcggaggcgctccctcagaaggaagggtactagatggaaacttgagaaaggactgcttattgataacagctaaggtattcctggaagcagagtaaataaagctcatggcccaccagctagaaagtattcttgccatgagaaaaagaatgtgataagttattcaacttatgaaattcaagttacatgtgaattctgccaggcaatacaaggacctgtggaatatgagtgatgacaaaccctttctatgtactgcgcctggatgtggccagatcagaccccaacaccaacaagattcttgaaaaactgtgaagaagtgggtttgtttaatgagttggcgagtccatttgagaatgaattcaagaaagcttcagaagatgacattaaaaaaatgcctctagatttatcccctcttgcaacacctatcataagaagcaaaattgaggagccttctgttgtagaaacaactcaccaggatagtcctttacctcacccagagtctactaccagtgatgagaaggaagtaccattggcacaaactgcacagcccacatcagctattgttcgtccagcatcattacaggttcccaatgtgctgcttacaagttctgactcaagtgtaattattcagcaggcagtaccttcaccaacctcaagtactgtaatcacccaggcaccatcctctaacaggccaattgtccctgtaccaggcccatttcctcttctgttacatcttcctaatggacaaaccatgcctgttgctattcctgcatcaattacaagttctaatgtgcatgttccagctgcagtccca

SEQ ID NO: 104085 - DNA, 1325 bp, Homo sapiens
  Payload ID: 461
  Gene Symbol: ATF2
  Gene Name: activating transcription factor 2
  ENST ID: ENST00000538946
  CDS Start-End: 15-1004
attacaggttcccaatggctgcttacaagttccaaattattcagcaggcagtaccttcaccaacctcaagtactgtaatcacccaggcaccatcctctaacaggccaattgtccctgtaccaggcccatttcctcttctgttacatcttcctaatggacaaaccatgcctgttgctattcctgcatcaattacaagttctaatgtgcatgttccagctgcagtcccactcgttcgaccagtcaccatggtgcctagtgttccaggaatcccaggtccttcctctccccaaccagtacagtcagaagcaaaaatgagattaaaagctgctttgacccagcaacatcctccagttaccaatggtgatactgtcaaaggtcatggtagcggattggttaggactcagtcagaggaatctcgaccgcagtcattacaacagccagccacatccactacagaaactccggcttctccagctcacacaactccacagacccaaagtacaagtggtcgtcggagaagagcagctaacgaagatcctgatgaaaaaaggagaaagtttttagagcgaaatagagcagcagcttcaagatgccgacaaaaaaggaaagtctgggttcagtctttagagaagaaagctgaagacttgagttcattaaatggtcagctgcagagtgaagtcaccctgctgagaaatgaagtggcacagctgaaacagcttcttctggctcataaagattgccctgtaaccgccatgcagaagaaatctggctatcatactgctgataaagatgatagttcagaagacatttcagtgccgagtagtccacatacagaagctatacagcatagttcggtcagcacatccaatggagtcagttcaacctccaaggcagaagctgtagccacttcagtcctcacccagatggcggaccagagtacagagcctgctctttcacagatcgttatggctccttcctcccagtcacagccctcaggaagttgattaaaaacctgcagtacaacagttttagatactcattagtgacttcaaagggaaatcaaggaaagaccagtttccatttatgcgaaatctgtggttgtaaattttttttttttacttgaaattaaatttggctctaaagttggtgtagcagcagttgatcagactgaaaaacggtttttagtctctggaaaaagactgattttgctttttttataaatattattagatttattaatttttctgtgctcaatgtgtaaattgtattataattcattgtgatttatttcacttttaatttgctggtgttttaataaatggggg

SEQ ID NO: 104086 - DNA, 482 bp, Homo sapiens
  Payload ID: 462
  Gene Symbol: ATF3
  Gene Name: activating transcription factor 3
  Uniprot ID: P18847
  ENST ID: ENST00000336937
  CDS Start-End: 1-321
atgatgcttcaacacccaggccaggtctctgcctcggaagaagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaactcccaaggcccttttgggtccagaagacctgcatatgggctgttgactcatgcaaatgaggtatctgaactgcagcttcagtattagcagagccacaggccgcctctgtggcatcaccagggtttctctgaagaagagggtctgcattttcctaaacccagtgctgctctcccatctcccatcttcctctcgcagcttgatgagccccggtgtgtcccag

SEQ ID NO: 104087 - DNA, 2033 bp, Homo sapiens
  Payload ID: 462
  Gene Symbol: ATF3
  Gene Name: activating transcription factor 3
  Uniprot ID: P18847
  ENST ID: ENST00000341491
  CDS Start-End: 266-811
attacgtcagcctgggactggcaacacggagtaaacgaccgcgccgccagcctgagggctataaaaggggtgatgcaacgctctccaagccacagtcgcacgcagccaggcgcgcactgcacagctctcttctctcgccgccgcccgagcgcacccttcagcccgcgcgccggccgtgagtcctcggtgctcgcccgccggccagacaaacagcccgcccgaccccgtcccgaccctggccgccccgagcggagcctggagcaaaatgatgcttcaacacccaggccaggtctctgcctcggaagtgagtgcttctgccatcgtcccctgcctgtcccctcctgggtcactggtgtttgaggattttgctaacctgacgccctttgtcaaggaagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaagagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaagcagtcgtggtatgggggcgactggggagtcctcattgaatcctcattttatacccaaaaccctgaagccattggagagctgtcttcctgtgtacctctagaatcccagcagcagagaaccatcaaggcgggagggcctgcagtgattcagcaggcccttcccattctgccccagagtgggtcttggaccagggcaagtgcatctttgcctcaactccaggatttaggccttaacacactggccattcttatgttccagatggcccccagctggtgtcctgcccgcctttcatctggattctacaaaaaaccaggatgcccaccgttaggattcaggcagcagtgtctgtacctcgggtgggagggatggggccatctccttcaccgtggctaccattgtcactcgtaggggatgtggagtgagaacagcatttagtgaagttgtgcaacggccagggttgtgctttctagcaaatatgctgttatgtccagaaattgtgtgtgcaagaaaactaggcaatgtactcttccgatgtttgtgtcacacaacactgatgtgacttttatatgctttttctcagatctggtttctaagagttttggggggcggggctgtcaccacgtgcagtatctcaagatattcaggtggccagaagagcttgtcagcaagaggaggacagaattctcccagcgttaacacaaaatccatgggcagtatgatggcaggtcctctgttgcaaactcagttccaaagtcacaggaagaaagcagaaagttcaacttccaaagggttaggactctccactcaatgtcttaggtcaggagttgtgtctaggctggaagagccaaagaatattccattttcctttccttgtggttgaaaaccacagtcagtggagagatgtttggaaaccacagtcagtggagcctgggtggtacccaggctttagcattattggatgtcaatagcattgtttttgtcatgtagctgttttaagaaatctggcccagggtgtttgcagctgtgagaagtcactcacactggccacaaggacgctggctactgtctattaaaattctgatgtttctgtgaaattctcagagtgtttaattgtactcaatggtatcattacaattttctgtaagagaaaatattacttatttatcctagtattcctaacctgtcagaataataaatattggaaccaagacatggtaaaca

SEQ ID NO: 104088 - DNA, 680 bp, Homo sapiens
  Payload ID: 462
  Gene Symbol: ATF3
  Gene Name: activating transcription factor 3
  ENST ID: ENST00000366981
  CDS Start-End: 155-680
ggcggaggtggggttagcttcagttgaccaaccatgccttgaggataaattggatgggatcagatgggaagatgtgacaagaagagaaatcctcctctatataggatgctctgctgtttcctaaggattttcagcaccttgccccaaaatcaaaatgatgcttcaacacccaggccaggtctctgcctcggaagtgagtgcttctgccatcgtcccctgcctgtcccctcctgggtcactggtgtttgaggattttgctaacctgacgccctttgtcaaggaagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaagagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaag

SEQ ID NO: 104089 - DNA, 858 bp, Homo sapiens
  Payload ID: 462
  Gene Symbol: ATF3
  Gene Name: activating transcription factor 3
  Uniprot ID: P18847
  ENST ID: ENST00000366983
  CDS Start-End: 1-408
atgatgcttcaacacccaggccaggtctctgcctcggaagtgagtgcttctgccatcgtcccctgcctgtcccctcctgggtcactggtgtttgaggattttgctaacctgacgccctttgtcaaggaagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaactcccaaggcccttttgggtccagaagacctgcatatgggctgttgactcatgcaaatgaggtatctgaactgcagcttcagtattagcagagccacaggccgcctctgtggcatcaccagggtttctctgaagaagagggtctgcattttcctaaacccagtgctgctctcccatctcccatcttcctctcgcagcttgatgagccccggtgtgtcccaggtacacccctgcatccaggcagcagcccaggccaccccctcctcactggcccttggctcctttcttgatgcctctgttgcttgtcccccaggagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaa

SEQ ID NO: 104090 - DNA, 516 bp, Homo sapiens
  Payload ID: 462
  Gene Symbol: ATF3
  Gene Name: activating transcription factor 3
  ENST ID: ENST00000366985
  CDS Start-End: 1-460
cgagcggagcctggagcaaaatgatgcttcaacacccaggccagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaagagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaagcagtcgtggtatgggggcgactggggagtcctcattgaatcctcattttataccc

SEQ ID NO: 104091 - DNA, 1917 bp, Homo sapiens
  Payload ID: 462
  Gene Symbol: ATF3
  Gene Name: activating transcription factor 3
  Uniprot ID: P18847
  ENST ID: ENST00000366987
  CDS Start-End: 155-700
ggcggaggtggggttagcttcagttgaccaaccatgccttgaggataaattggatgggatcagatgggaagatgtgacaagaagagaaatcctcctctatataggatgctctgctgtttcctaaggattttcagcaccttgccccaaaatcaaaatgatgcttcaacacccaggccaggtctctgcctcggaagtgagtgcttctgccatcgtcccctgcctgtcccctcctgggtcactggtgtttgaggattttgctaacctgacgccctttgtcaaggaagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaagagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaagcagtcgtggtatgggggcgactggggagtcctcattgaatcctcattttatacccaaaaccctgaagccattggagagctgtcttcctgtgtacctctagaatcccagcagcagagaaccatcaaggcgggagggcctgcagtgattcagcaggcccttcccattctgccccagagtgggtcttggaccagggcaagtgcatctttgcctcaactccaggatttaggccttaacacactggccattcttatgttccagatggcccccagctggtgtcctgcccgcctttcatctggattctacaaaaaaccaggatgcccaccgttaggattcaggcagcagtgtctgtacctcgggtgggagggatggggccatctccttcaccgtggctaccattgtcactcgtaggggatgtggagtgagaacagcatttagtgaagttgtgcaacggccagggttgtgctttctagcaaatatgctgttatgtccagaaattgtgtgtgcaagaaaactaggcaatgtactcttccgatgtttgtgtcacacaacactgatgtgacttttatatgctttttctcagatctggtttctaagagttttggggggcggggctgtcaccacgtgcagtatctcaagatattcaggtggccagaagagcttgtcagcaagaggaggacagaattctcccagcgttaacacaaaatccatgggcagtatgatggcaggtcctctgttgcaaactcagttccaaagtcacaggaagaaagcagaaagttcaacttccaaagggttaggactctccactcaatgtcttaggtcaggagttgtgtctaggctggaagagccaaagaatattccattttcctttccttgtggttgaaaaccacagtcagtggagagatgtttggaaaccacagtcagtggagcctgggtggtacccaggctttagcattattggatgtcaatagcattgtttttgtcatgtagctgttttaagaaatctggcccagggtgtttgcagctgtgagaagtcactcacactggccacaaggacgctggctactgtctattaaaattctgatgtttctgtgaaattctcagagtgtttaattgtactcaatggtatcattacaattttctgtaagagaaaatattacttatttatcctagtattcctaacctgtcagaataataaatattggaaccaagacatggt

SEQ ID NO: 104092 - DNA, 767 bp, Homo sapiens
  Payload ID: 462
  Gene Symbol: ATF3
  Gene Name: activating transcription factor 3
  Uniprot ID: P18847
  ENST ID: ENST00000464547
  CDS Start-End: 1-408
atgatgcttcaacacccaggccaggtctctgcctcggaagtgagtgcttctgccatcgtcccctgcctgtcccctcctgggtcactggtgtttgaggattttgctaacctgacgccctttgtcaaggaagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaactcccaaggcccttttgggtccagaagacctgcatatgggctgttgactcatgcaaatgaggtatctgaactgcagcttcagtattagcagagccacaggccgcctctgtggcatcaccagggtttctctgaagaagagggtctgcattttcctaaacccagtgctgctctcccatctcccatcttcctctcgcagcttgatgagccccggtgtgtcccaggagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaa

SEQ ID NO: 104093 - DNA, 581 bp, Homo sapiens
  Payload ID: 462
  Gene Symbol: ATF3
  Gene Name: activating transcription factor 3
  Uniprot ID: P18847
  ENST ID: ENST00000613104
  CDS Start-End: 16-390
cacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaagagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaagcagtcgtggtatgggggcgactggggagtcctcattgaatcctcattttatacccaaaaccctgaagccattggagagctgtcttcctgtgtacctctagaatcccagcagcagagaaccatcaaggcgggagggcctgcagtgattcagcaggcccttcccattctgccccagagtgggtcttggacca

SEQ ID NO: 104094 - DNA, 2031 bp, Homo sapiens
  Payload ID: 462
  Gene Symbol: ATF3
  Gene Name: activating transcription factor 3
  Uniprot ID: P18847
  ENST ID: ENST00000613954
  CDS Start-End: 440-814
tccgctccgttcggccggttctcccgggaagctattaatagcattacgtcagcctgggactggcaacacggagtaaacgaccgcgccgccagcctgagggctataaaaggggtgatgcaacgctctccaagccacagtcgcacgcagccaggcgcgcactgcacagctctcttctctcgccgccgcccgagcgcacccttcagcccgcgcgccggccgtgagtcctcggtgctcgcccgccggccagacaaacagcccgcccgaccccgtcccgaccctggccgccccgagcggagcctggagcaaaatgagtgcttctgccatcgtcccctgcctgtcccctcctgggtcactggtgtttgaggattttgctaacctgacgccctttgtcaaggaagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaagagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaagcagtcgtggtatgggggcgactggggagtcctcattgaatcctcattttatacccaaaaccctgaagccattggagagctgtcttcctgtgtacctctagaatcccagcagcagagaaccatcaaggcgggagggcctgcagtgattcagcaggcccttcccattctgccccagagtgggtcttggaccagggcaagtgcatctttgcctcaactccaggatttaggccttaacacactggccattcttatgttccagatggcccccagctggtgtcctgcccgcctttcatctggattctacaaaaaaccaggatgcccaccgttaggattcaggcagcagtgtctgtacctcgggtgggagggatggggccatctccttcaccgtggctaccattgtcactcgtaggggatgtggagtgagaacagcatttagtgaagttgtgcaacggccagggttgtgctttctagcaaatatgctgttatgtccagaaattgtgtgtgcaagaaaactaggcaatgtactcttccgatgtttgtgtcacacaacactgatgtgacttttatatgctttttctcagatctggtttctaagagttttggggggcggggctgtcaccacgtgcagtatctcaagatattcaggtggccagaagagcttgtcagcaagaggaggacagaattctcccagcgttaacacaaaatccatgggcagtatgatggcaggtcctctgttgcaaactcagttccaaagtcacaggaagaaagcagaaagttcaacttccaaagggttaggactctccactcaatgtcttaggtcaggagttgtgtctaggctggaagagccaaagaatattccattttcctttccttgtggttgaaaaccacagtcagtggagagatgtttggaaaccacagtcagtggagcctgggtggtacccaggctttagcattattggatgtcaatagcattgtttttgtcatgtagctgttttaagaaatctggcccagggtgtttgcagctgtgagaagtcactcacactggccacaaggacgctggctactgtctattaaaattctgatgtttctgtgaaattctcagagtgtttaattgtactcaatggtatcattacaattttctgtaagagaaaatattacttatttatcctagtattcctaacctgtcagaataataaatattggaaccaagacatggt

SEQ ID NO: 104095 - DNA, 2019 bp, Homo sapiens
  Payload ID: 463
  Gene Symbol: ATF4
  Gene Name: activating transcription factor 4
  Uniprot ID: P18848
  ENST ID: ENST00000337304
  CDS Start-End: 883-1938
tttctactttgcccgcccacagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgtgagtaccggggcgggtcgtccagctgtgctcctggggccggcgcgggttttggattggtggggtgcggcctggggccagggcggtgccgccaagggggaagcgatttaacgagcgcccgggacgcgtggtctttgcttgggtgtccccgagacgctcgcgtgcctgggatcgggaaagcgtagtcgggtgcccggactgcttccccaggagccctacagccctcggaccccgagccccgcaagggtcccaggggtcttggctgttgccccacgaaacgtggcaggaaccaagatggcggcggcagggcggcggcgcgggcgtgagtcaagggcgggcggtgggcggggcgcggccgccctggccgtatttggacgtggggacggagcgctttcctcttggcggccggtggaagaatcccctggtctccgtgagcgtccattttgtggaacctgagttgcaagcagggaggggcaaatacaactgccctgttcccgattctctagatggccgatctagagaagtcccgcctcataagtggaaggatgaaattctcagaacagctaacctctaatgggagttggcttctgattctcattcaggcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtagggaaa

SEQ ID NO: 104096 - DNA, 1419 bp, Homo sapiens
  Payload ID: 463
  Gene Symbol: ATF4
  Gene Name: activating transcription factor 4
  Uniprot ID: P18848
  ENST ID: ENST00000396680
  CDS Start-End: 281-1336
tttctactttgcccgcccacagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtagggaaagt

SEQ ID NO: 104097 - DNA, 1910 bp, Homo sapiens
  Payload ID: 463
  Gene Symbol: ATF4
  Gene Name: activating transcription factor 4
  Uniprot ID: P18848
  ENST ID: ENST00000404241
  CDS Start-End: 774-1829
aggtggacaggcccggcgcgccctctcgaggccccttcaacctcccgggggcagcagcgccgtgtcggctatgaatggggcctctggaaaactcaggcttggaacagcacctcgcgcgataacctggcgtcctcggccttcacaataaaaactcttcgccggaaaacgacctttccccgcccactgcgctgacaccggaagcgaggcgtgtctgggagatcactccgcgctccggcggcgaaggaaagaacggactctgatcatagaagcctagtaaagtagtacacctctctcctttcgtgaggccataagaacaaactccttttctcgtcacagctacgccctgggcataaacggttggggcgtcaaagggagggagggaagggagcgggcgggaggagacggtcacgtggtcgcggcggaaggatgcgtctgtgctgcgtccccatagagacgaagtctataaagggccggcgggcggccacggcagccatttctactttgcccgcccacagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtagggaaa

SEQ ID NO: 104098 - DNA, 2069 bp, Homo sapiens
  Payload ID: 464
  Gene Symbol: ATF5
  Gene Name: activating transcription factor 5
  Uniprot ID: Q9Y2D1
  ENST ID: ENST00000423777
  CDS Start-End: 378-1226
atccgggagggccgtgctccgccacccagtatatatctgtccccagtccccggggccgcctcattccctgtcctcggatcacagtctcttctcactacagtgtcgccgcctctgcctgcgtagccccggccatggctctgtagcctcgacccctttgtgcccccggcccgtctccgcgctcaccacgcctgcgctctccgctcccaccttctttcttcagccgaggccgccgccgcctctccttgctgcagccatggagtcttccactttcgccttggtgcctgtcttcgcccacctgagcatcctccagagcctcgtgccagctgctggtgcagcctctcctgttgccatcagtgcccagcacctgtgctacagccatgtcactcctggcgaccctggggctggagctggacagggccctgctcccagctagtgggctgggatggctcgtagactatgggaaactccccccggcccctgcccccctggctccctatgaggtccttgggggagccctggagggcgggcttccagtggggggagagcccctggcaggtgatggcttctctgactggatgactgagcgagttgatttcacagctctcctccctctggagcctcccttaccccccggcaccctcccccaaccttccccaaccccacctgacctggaagctatggcctccctcctcaagaaggagctggaacagatggaagacttcttcctagatgccccgcccctcccaccaccctccccgccgccactaccaccaccaccactaccaccagccccctccctccccctgtccctcccctcctttgacctcccccagccccctgtcttggatactctggacttgctggccatctactgccgcaacgaggccgggcaggaggaagtggggatgccgcctctgcccccgccacagcagccccctcctccttctccacctcaaccttctcgcctggccccctacccacatcctgccaccacccgaggggaccgcaagcaaaagaagagagaccagaacaagtcggcggctctgaggtaccgccagcggaagcgggcagagggtgaggccctggagggcgagtgccaggggctggaggcacggaatcgcgagctgaaggaacgggcagagtccgtggagcgcgagatccagtacgtcaaggacctgctcatcgaggtttacaaggcccggagccagaggacccgtagctgctagaagggcaggggtgtggcttctgggggctggtcttcagctctggcgccttcatccccctgcctctaccttcattccaaacccctctcggccgggtgcagtggcttatgcttgtaatcccagcactttgggaggccaaggcaggaggatcgtttgaggccaggaggtcaataccagcctgggcaacatagtaagaccctgtctctattaaaaaaaaaaaatcaacccttcttccccaccaaaccacccaactcctctctactcttatccttttatcctctgtctctgcttatcacctctcttgcgtatttctggatctccttccctcctttctcgtccaaatcatgaaatgtttggccttagtcaatgtctatgcccgtcacataacagccgaggcaccgaggcccacagggaagcagctgggagcttggaaacctggtctcttgaatttcaaacctggtttcttacaggtggttgtctggggtgggtggagtggcgacaggatagagctgaaggactatgcaaatgaggaagtaagtcagggcgggctttgagaaggggacccatatcctacaggcaaaaagcaggctaggtgaccttgggacactacgctaagggagggaggctaaaggcggccaggtttgcagtgcgggaagatgagcaggccagtgggaggaggggcagggcagggctgtagttggtgactgggtgttcattttagctctaagaaaaaaaatcagtgtttcgtgaaggtgttggagaggggctgtgtctgggtgagggatggcggggtactgatttttttgggaggttatgagcaaaaataaaacgaaacatttcctctgg

SEQ ID NO: 104099 - DNA, 722 bp, Homo sapiens
  Payload ID: 464
  Gene Symbol: ATF5
  Gene Name: activating transcription factor 5
  ENST ID: ENST00000596658
  CDS Start-End: 334-722
ggcagagcgaggagtgggatttgagtggataacattgctgaagggctgcggcctggggcagttcccctgggaactggtttgggatggaagctaggaaggcagtggggccaaaaggaaatattttagaggaaggggcgtggctggaagaaaatgtccctgggattgagtttttccttgaggcgaaatattctgaggtggatgggaggggcctaaggtcttccactttcgccttggtgcctgtcttcgcccacctgagcatcctccagagcctcgtgccagctgctggtgcagcctctcctgttgccatcagtgcccagcacctgtgctacagccatgtcactcctggcgaccctggggctggagctggacagggccctgctcccagctagtgggctgggatggctcgtagactatgggaaactccccccggcccctgcccccctggctccctatgaggtccttgggggagccctggagggcgggcttccagtggggggagagcccctggcaggtgatggcttctctgactggatgactgagcgagttgatttcacagctctcctccctctggagcctcccttaccccccggcaccctcccccaaccttccccaaccccacctgacctggaagctatggcctccctcctcaagaaggagctggaacagatggaagacttcttcctagatgccccgcccctcccaccaccctccccgccgccact

SEQ ID NO: 104100 - DNA, 1637 bp, Homo sapiens
  Payload ID: 464
  Gene Symbol: ATF5
  Gene Name: activating transcription factor 5
  Uniprot ID: Q9Y2D1
  ENST ID: ENST00000595125
  CDS Start-End: 583-1431
atttgggagagtgctgtgactcatgctggactctaacccacgagggtttctcagagtcagcagctgggggatgaagaagtgaaaagtgactggcaggaaattctgcaagcaaggaaagggaaagagaaatgaactggtgcaggtctgcgggaagagaatgaggctggatcctcaaaatcacaggaggaagcaggcccagacctcagaggcagaaagagaaagaaaccagagcttagagtcaggaggaggaaaccagaccccggagccacaaggagagggctggatccccggctcagagggaagagtgtcgccgcctctgcctgcgtagccccggccatggctctgtagcctcgacccctttgtgcccccggcccgtctccgcgctcaccacgcctgcgctctccgctcccaccttctttcttcagccgaggccgccgccgcctctccttgctgcagccatggagtcttccactttcgccttggtgcctgtcttcgcccacctgagcatcctccagagcctcgtgccagctgctggtgcagcctctcctgttgccatcagtgcccagcacctgtgctacagccatgtcactcctggcgaccctggggctggagctggacagggccctgctcccagctagtgggctgggatggctcgtagactatgggaaactccccccggcccctgcccccctggctccctatgaggtccttgggggagccctggagggcgggcttccagtggggggagagcccctggcaggtgatggcttctctgactggatgactgagcgagttgatttcacagctctcctccctctggagcctcccttaccccccggcaccctcccccaaccttccccaaccccacctgacctggaagctatggcctccctcctcaagaaggagctggaacagatggaagacttcttcctagatgccccgcccctcccaccaccctccccgccgccactaccaccaccaccactaccaccagccccctccctccccctgtccctcccctcctttgacctcccccagccccctgtcttggatactctggacttgctggccatctactgccgcaacgaggccgggcaggaggaagtggggatgccgcctctgcccccgccacagcagccccctcctccttctccacctcaaccttctcgcctggccccctacccacatcctgccaccacccgaggggaccgcaagcaaaagaagagagaccagaacaagtcggcggctctgaggtaccgccagcggaagcgggcagagggtgaggccctggagggcgagtgccaggggctggaggcacggaatcgcgagctgaaggaacgggcagagtccgtggagcgcgagatccagtacgtcaaggacctgctcatcgaggtttacaaggcccggagccagaggacccgtagctgctagaagggcaggggtgtggcttctgggggctggtcttcagctctggcgccttcatccccctgcctctaccttcattccaaacccctctcggccgggtgcagtggcttatgcttgtaatcccagcactttgggaggccaaggcaggaggatcgtttgaggccaggaggtcaataccagcctgggcaacatagtaagaccctgtctctatt

SEQ ID NO: 104101 - DNA, 828 bp, Homo sapiens
  Payload ID: 464
  Gene Symbol: ATF5
  Gene Name: activating transcription factor 5
  ENST ID: ENST00000597227
  CDS Start-End: 464-828
cacagtctcttctcactacagtgtcgccgcctctgcctgcgtagccccggccatggctctgtagcctcgacccctttgtgcccccggcccgtctccgcgctcaccacgcctgcgctctccgctcccaccttctttcttcagccgaggccgccgccgcctctccttgctgcagccatggatagcccaccagtgccccgtagtgaaagagctgcggaccctgaatggccgcacatgcgcattgatccccaagagggcggaggtgtaaaggcaattggaccgctcgggcgacgtagcatgcgccttggccctcggcgcagagccgcgtgtggacgggtggcgttcgggtcttccactttcgccttggtgcctgtcttcgcccacctgagcatcctccagagcctcgtgccagctgctggtgcagcctctcctgttgccatcagtgcccagcacctgtgctacagccatgtcactcctggcgaccctggggctggagctggacagggccctgctcccagctagtgggctgggatggctcgtagactatgggaaactccccccggcccctgcccccctggctccctatgaggtccttgggggagccctggagggcgggcttccagtggggggagagcccctggcaggtgatggcttctctgactggatgactgagcgagttgatttcacagctctcctccctctggagcctcccttaccccccggcaccctcccccaaccttccccaaccccacctgacctggaagctatggcctccctcctcaagaaggagctggaacagatggaagacttcttcctagatgccccgcccct

SEQ ID NO: 104102 - DNA, 682 bp, Homo sapiens
  Payload ID: 464
  Gene Symbol: ATF5
  Gene Name: activating transcription factor 5
  ENST ID: ENST00000600336
  CDS Start-End: 304-570
cggatcacagtctcttctcactacagtgtcgccgcctctgcctgcgtagccccggccatggctctgtagcctcgacccctttgtgcccccggcccgtctccgcgctcaccacgcctgcgctctccgctcccaccttctttcttcagccgaggccgccgccgcctctccttgctgcagccatggagtcttccactttcgccttggtgcctgtcttcgcccacctgagcatcctccagagcctcgtgccagctgctggtgcagcctctcctgttgccatcagtgcccagcacctgtgctacagccatgtcactcctggcgaccctggggctggagctggacagggccctgctcccagctagtgggctgggatggctcgtagactatgggaaactccccccggcccctgcccccctggctccctatgaggtccttgggggagccctggagggcgggcttccagtggggggagagcccctggcaggtaagggcaggtggaaggtggagctggggagtggagggcaggggaagatgggggaggaagaactcatccatgtattcaataaatattgagtgcctacaatgtgccaggcactgttttaggtgctgaggatacggctgggaacaagaagaacatggtctgtgccttccagcagctcacactgtggggagtagaccagagata

SEQ ID NO: 104103 - DNA, 7496 bp, Homo sapiens
  Payload ID: 465
  Gene Symbol: ATF6
  Gene Name: activating transcription factor 6
  Uniprot ID: P18850
  ENST ID: ENST00000367942
  CDS Start-End: 68-2080
ttttgtccgcctgccgccgccgtcccagatattaatcacggagttccagggagaaggaacttgtgaaatgggggagccggctggggttgccggcaccatggagtcaccttttagcccgggactctttcacaggctggatgaagattgggattctgctctctttgctgaactcggttatttcacagacactgatgagctgcaattggaagcagcaaatgagacgtatgaaaacaattttgataatcttgattttgatttggatttgatgccttgggagtcagacatttgggacatcaacaaccaaatctgtacagttaaagatattaaggcagaacctcagccactttctccagcctcctcaagttattcagtctcgtctcctcggtcagtggactcttattcttcaactcagcatgttcctgaggagttggatttgtcttctagttctcagatgtctcccctttccttatatggtgaaaactctaatagtctctcttcagcggagccactgaaggaagataagcctgtcactggtcctaggaacaagactgaaaatggactgactccaaagaaaaaaattcaggtgaattcaaaaccttcaattcagcccaagcctttattgcttccagcagcacccaagactcaaacaaactccagtgttccagcaaaaaccatcattattcagacagtaccaacgcttatgccattggcaaagcagcaaccaattatcagtttacaacctgcacccactaaaggccagacggttttgctgtctcagcctactgtggtacaacttcaagcacctggagttctgccctctgctcagccagtccttgctgttgctgggggagtcacacagctccctaatcacgtggtgaatgtggtaccagccccttcagcgaatagcccagtgaatggaaaactttccgtgactaaacctgtcctacaaagtaccatgagaaatgtcggttcagatattgctgtgctaaggagacagcaacgtatgataaaaaatcgagaatccgcttgtcagtctcgcaagaagaagaaagaatatatgctagggttagaggcgagattaaaggctgccctctcagaaaacgagcaactgaagaaagaaaatggaacactgaagcggcagctggatgaagttgtgtcagagaaccagaggcttaaagtccctagtccaaagcgaagagttgtctgtgtgatgatagtattggcatttataatactgaactatggacctatgagcatgttggaacaggattccaggagaatgaaccctagtgtgagccctgcaaatcaaaggaggcaccttctaggattttctgctaaagaggcacaggacacatcagatggtattatccagaaaaacagctacagatatgatcattctgtttcaaatgacaaagccctgatggtgctaactgaagaaccattgctttacattcctccacctccttgtcagcccctaattaacacaacagagtctctcaggttaaatcatgaacttcgaggatgggttcatagacatgaagtagaaaggaccaagtcaagaagaatgacaaataatcaacagaaaacccgtattcttcagggtgctctggaacagggctcaaattctcagctgatggctgttcaatacacagaaaccactagtagtatcagcaggaactcagggagtgagctacaagtgtattatgcttcacccagaagttatcaagacttttttgaagccatccgcagaaggggagacacattttatgttgtgtcatttcgaagggatcacctgctgttaccagctaccacccataacaagaccacaagaccaaaaatgtcaattgtgttaccagcaataaacataaatgagaatgtgatcaatgggcaggactacgaagtgatgatgcagattgactgtcaggtgatggacaccaggatcctccatatcaaaagttcgtcagttcctccttacctccgagatcagcagaggaatcaaaccaacaccttctttggctcccctcccgcagccacagaggcaacccacgttgtcagcaccatccctgagtcattacaatagcaccctgcagctatgctggaaaactgagcgtgggaccctgccagactgaagagcaggtgagcaaaatgctgctttctgccttggtggcaggcagagaactgtctcgtactagaattcaaggaggaaagaagaagaaataaaagaagctgctccatttttcatcatctacccatctatttggaaagcactggaattcagatgcaagagaacaatgtttcttcagtggcaaatgtagccctgcatcctccagtgttacctggtgtagatttttttttctgtacctttctaaacctctcttccctctgtgatggttttgtgtttaaacagtcatcttcttttaaataatatccacctctcctttttgccatttcacttattgattcataaagtgaattttatttaaagctatgccacacatgcatgttcaaatggtttccactgattcgatttttcattcatttaatgcaaacccattctggatattgtgcttatttgagaaaacacatttcaaaaccagaaaagccaaaaacactccaaaaacaagcaaaacaatttggagctttagataaaaggaaaaactcccagttggtaaagtttatctttacttaggatttgtggctcacacctaaacaaagggggtcagggagtgggtacaaatttgagaaaatagaagggtaagggaagggccagtggtggggtttggagagaggagatagctccattaatacacatgtttaaaagatggaaagttcacgcctgtaatcccagcactttgggaggccgaggcgggtggatcacgaggtcaggagatcaagaccatcccggctaaaacggtgaaaccccgtctctactaaaaatacaaaaaattagccgggcgtagtgacgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagatggaaagttcgatgtgactgcagtatgagattaaagccacaactattgtttattttggggactctaggccaccaagtattagcacacatacttatgttttctctactaatctggtccaggtcctcatggaccacaggacaaagctttcattttcattcattcttctattgaaattataccaaattcagctgaggaatatggaagtaactttagacttaaacaagacaaaagttttttcactgaagaattgacaagtatttgctccttaaaacaacgcagattagtgaacgtggattcctgctgagggagtgcatcccataatatggcaataattttcagtttctccaacgaaaagatagtgaaggaattaaatcttttgtcctcccatggttaaaaaaaaaaaaaaagctgtgttcatttttactgtactatgcctcttttttcaccatagtagacaattatgtttcatttgatgaattcatagaactggatctcatacagcgatgtcctctctaatgttctacctttcagtttctaaagtgagtcttcctccctctcctacaaaacttttcaattttttgatgtaactcatctacaaatactgtttcttaccccagttgacttgcctttgtcagatttcttcttgttccacactatagcaatcaatttctcttcttccttacaagaaagggaacgagaaattgtagcaacctctcaaggattatatgcagctagttagttttctgcctgtgaaattaggtctggctcctaaataattttaaagaaccatcagcacttctaactctctggacaggtgcctctttgtccaagctagttaaatgctttccaaggaaatcagttcaacttttgtgagcggggaaaagcagggctttattgttgtgttacctgggagtctggagtttgaaaagtgctaattaaccttcctctttttccacattacaaacctttttaagcagcgcagcactccccttagatttggctatcctgggtgattttcagacaagaaccattttctctggggaccattcttctgctgggtgccaaggaatataaggcaaatgcccagaagaccttcaggtgactgggcagtcttatcatgggatatttcttctggccctgccccttcccattctgtaatgtgaattagccacaccagaggctgtgaccatggctagtagacagtggcaacatagtcatccccaagatgctaatcttctgctggaactgtcatacgttatcatggtcaatgtaaacctggtttgtgtggggtgattataaatagagtttccctcctctctgtgacagaatcacaggagaaggacccatctcgtggccttcttgttcttagcgcttcacttttacttcatccctcgattcccagctttttctatcatcattttgccaactcctcagatgcaagactttggttatgtcatactcaccaacgttagtccctctcttccaggtgaaaaggtgggtagcggttgggagggagtctccactgaagagcaggaaggtggtagcagggccggcagctctgccacagagctaggggtgcctgtaaggtgccgcctagagcagcctgggagctttgccttcttttgtctctcactagcccttctactctttgtcattgcctgttcttgagtggatctttgaaatgaggggacaggattctcctaagggtagagtttcaggaaatgagtgaaaggcaattgacaaatgcaaagaagtagtcactttttaaattgctggcaaagctataattaatccctaggcacaattgtagtttttattttaatgtttgtatgcacaaggccctttaggaaatgagaagttgccatgccagattaatttttttttttttttttggtgggattgccttttgggggttgcagccagaaattgtgggtaatgtgtgtatttttttatttattaaattttaaacaggattgtgcaagcttatgagacaattagataaactcatggaggaggcaggtcctcctgttattagatgattttgtgctcttggggctgacaataatacactcttgggaagtgatggtagagactgatgggaatagtctttctgcctggttgcaagtcccaaatttttaagggttaatggaagtaagtggatgtttcctcatgttaactactgaatcagatgttaggagcttgtccctttggggttgacttatgcccagcagtacagggacacagcttcattagagtgttagtgtaaactaactccaaagttaggagttaatgtgaaaggatcatccttgaaacaaatctgctgtttgccatgcttgtagtacagaaacttcacatggagttttgggtgggatttgtgttttcacaagtaaaaaatccctcacgattataaaactcagagcatcatctaatttttttttttaatgactacaagttccagcacaaaactggcatttctttgccatttcttgccagtaagaagttgacacggaggtatttgaaagcaatgttatgtgagtcattcttaagtgttccaagtaagtttagaaacagaaaaggaacttgggattcaaattgatttttcaaatcatttttaaagagacatcatcctgactaaatcttagcctgaaccttcctcccctgtgtgtattccccggtagtcaccgcagcgagatgctggtgagactgccgtggtggcatttagcatcgttaaaactggaaaactctcaagctctttgccactttcctactattttttgattcttgccattttaccaagcttaggttgtgaaacttgacagaaatgtattacaggaaaaacttataattgtatttgactttctaacacattgcaaagtttcaaagtgactttcactttcaacaacatattagaagtaaccacttttgctttcacagcctgaagagttagagcctgatctgatgccccctttcactctgaagtcatgggaaattttccagccatgaaagccctctttccactgcatactgatgggctgactcagcttccttcagccgactgagatcttttcatactattggctatttcataccaattaacctcttaaataagattgtgaattgccaaaattgatagacacttattaccacctgtggactccatattccttaccacaaatgttattttcatcagtcctgagtcattttaacttacagaaattaggattgttgctgctaatatgaataccaattataacttttagaaacaagaataaagcctaaaagagaatgaaatataagaaatgttcgttcccacccctaataacatttggaagtgaatattcccattttcttccacccacagggattgggattgatttttaatttcctaggaaacaatactagactacccaaaaagatgttgccagaatccaaaaggaactatgctcgtaaaagaaatgcagttttctcctacctaaaaaaaagaaagtaaagtgtgttctgttcttatctttttaatgactaagctttaaacagtttattttgggtaagactagaactttcggccatttgttctaatatgtgtgttattagatgcaatagaatttatgaaaagaagaatgacaaaggtatctgattagaaaatttgatcttacgcatgaatccatgtcatggccagccactgtcacatagtgggtgccattctcaacatattggtttgctaactttaagcattagggatttagcacactaaaatacttttaattatattaggtttggtaactaaggagtaaataaatcataatttatcatttgccaaggccaacaaacaacactattgtgctgtttgctctcaatgaagttgaataaaccaggaggcttggcatatcccctttatgttaatcccagctagagattagtaggttgactttcacagcaattgtatattgatccattttaactcatccttgccataatttccaggccagtcaccaggacagaggagatgatggggaaacagagctttagatgaaaactactatgcactactagccttagaggcactggtttcctgttaccactttggcaagtatggatggtctaagtccagtagggcttcatccatggagccattagaactgaggggggagtgttagagatgccatttcaccaggatctttttgctcaggttgtacccatgccaattgaagaacgtgttaaagatgaggaggagagatgtaccattctctcccttaataatgatgttggtttgcaaaacctaaagaaataataacaacagactatttcatactttcaagcaagtctttatactacctgttatttctctaaaattcaaataaagaatttttaaactta

SEQ ID NO: 104104 - DNA, 2620 bp, Homo sapiens
  Payload ID: 466
  Gene Symbol: ATF6B
  Gene Name: activating transcription factor 6 beta
  Uniprot ID: Q99941
  ENST ID: ENST00000293709
  CDS Start-End: 34-2145
aaccgtctcctggttggggggtgggggggaaagatggcggagctgatgctgctcagcgagattgctgacccgacgcgtttcttcaccgacaacctgcttagcccggaggactggggtctgcagaacagcaccttgtattctggcctagatgaagtggccgaggagcagacgcagctcttccgttgcccggagcaggatgtcccgtttgacggcagctccctggacgtggggatggatgtcagcccctctgagcccccatgggaactcctgccgatcttcccagatcttcaggtgaagtctgagccatcttccccctgctcttcctcctccctcagctccgagtcatcgcgtctctccacagagccatccagcgaggctcttggggtaggggaggtgctccatgtgaagacagagtccttggcacccccactgtgtctcctgggagatgacccaacatcctcatttgaaaccgtccagatcaacgttatccccacctctgatgattcctcagatgtccagaccaagatagaacctgtctctccatgttcttccgtcaactctgaggcctccctgctctcagccgactcctccagccaggcttttataggagaggaggtcctggaagtgaagacagagtccctgtccccttcaggatgcctcctgtgggatgtcccagccccctcacttggagctgtccagatcagcatgggcccatcccttgatggctcctcaggcaaagccctgcccacccggaagccgccactgcagcccaaacctgtagtgctaaccactgtcccaatgccatccagagctgtgcctcccagcaccacagtccttctgcagtccctcgtccagccacccccagtgtccccagttgtcctcatccagggtgctattcgagtccagcctgaagggccggctccctctctaccacggcctgagaggaagagcatcgttcccgctcctatgcctggaaactcctgcccgcctgaagtggatgcaaagctgctgaagcggcagcagcgaatgatcaagaaccgggagtcagcctgccagtcccggagaaagaagaaagagtatctgcagggactggaggctcggctgcaagcagtactggctgacaaccagcagctccgccgagagaatgctgccctccggcggcggctggaggccctgctggctgaaaacagcgagctcaagttagggtctggaaacaggaaggtggtctgcatcatggtcttccttctcttcattgccttcaactttggacctgtcagcatcagtgagcctccttcagctcccatctctcctcggatgaacaagggggagcctcaaccccggagacacttgctggggttctcagagcaagagccagttcagggagttgaacctctccaggggtcctcccagggccctaaggagccccagcccagccccacagaccagcccagtttcagcaacctgacagccttccctgggggcgccaaggagctactactaagagacctagaccagctcttcctctcctctgattgccggcacttcaaccgcactgagtccctgaggcttgctgacgagttgagtggctgggtccagcgccaccagagaggccggaggaagatccctcagagggcccaggagagacagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccgaagggaccacctgctgctcccagccatcagccacaacaagacctcccggcccaagatgtccctggtgatgcctgccatggcccccaatgagaccctgtcaggccgtggggccccgggggactatgaggagatgatgcagatcgagtgtgaggtcatggacaccagggtgattcacatcaagacctccacagtgcccccctcgctccgaaaacagccatccccaaccccaggcaatgccacaggtggccccttgccagtctctgcagccagccaggcccaccaggcctcccaccagcccctctacctcaatcatccctgacctctgccattcacactgacttagaacggggggagggggtaccaggtggccaggtgggactgtttcaaatttccctgatccccaggcttggggcaattggtaaaggaaagagcaggtgtgggggttaagcacttatttgaggtgggggtgttcacctctcttctcatcccttttcagaatatagggctcctctcattcctgtgaacccccagtcccggcttctttgtttgaggggattgtgtgaggttcagttgtggggtgggtggtgagctgctgcatattttttattttgtttctctagtgttatggcagtggaggtgggaatttagtccccaggtgggacaagggaagttttttcattttggagctagttactgggagtaagggagggtggggtgggggggagttcaggtttatgtgtgtgcatttcttttttattattattaaataaacaacttggagggagttgaaggaa

SEQ ID NO: 104105 - DNA, 2624 bp, Homo sapiens
  Payload ID: 466
  Gene Symbol: ATF6B
  Gene Name: activating transcription factor 6 beta
  Uniprot ID: Q99941
  ENST ID: ENST00000375201
  CDS Start-End: 47-2149
ggcgggccttgggaaccgtctcctggttggggggtgggggggaaagatggcggagctgatgctgctcagcgagattgctgacccgacgcgtttcttcaccgacaacctgcttagcccggaggactgggacagcaccttgtattctggcctagatgaagtggccgaggagcagacgcagctcttccgttgcccggagcaggatgtcccgtttgacggcagctccctggacgtggggatggatgtcagcccctctgagcccccatgggaactcctgccgatcttcccagatcttcaggtgaagtctgagccatcttccccctgctcttcctcctccctcagctccgagtcatcgcgtctctccacagagccatccagcgaggctcttggggtaggggaggtgctccatgtgaagacagagtccttggcacccccactgtgtctcctgggagatgacccaacatcctcatttgaaaccgtccagatcaacgttatccccacctctgatgattcctcagatgtccagaccaagatagaacctgtctctccatgttcttccgtcaactctgaggcctccctgctctcagccgactcctccagccaggcttttataggagaggaggtcctggaagtgaagacagagtccctgtccccttcaggatgcctcctgtgggatgtcccagccccctcacttggagctgtccagatcagcatgggcccatcccttgatggctcctcaggcaaagccctgcccacccggaagccgccactgcagcccaaacctgtagtgctaaccactgtcccaatgccatccagagctgtgcctcccagcaccacagtccttctgcagtccctcgtccagccacccccagtgtccccagttgtcctcatccagggtgctattcgagtccagcctgaagggccggctccctctctaccacggcctgagaggaagagcatcgttcccgctcctatgcctggaaactcctgcccgcctgaagtggatgcaaagctgctgaagcggcagcagcgaatgatcaagaaccgggagtcagcctgccagtcccggagaaagaagaaagagtatctgcagggactggaggctcggctgcaagcagtactggctgacaaccagcagctccgccgagagaatgctgccctccggcggcggctggaggccctgctggctgaaaacagcgagctcaagttagggtctggaaacaggaaggtggtctgcatcatggtcttccttctcttcattgccttcaactttggacctgtcagcatcagtgagcctccttcagctcccatctctcctcggatgaacaagggggagcctcaaccccggagacacttgctggggttctcagagcaagagccagttcagggagttgaacctctccaggggtcctcccagggccctaaggagccccagcccagccccacagaccagcccagtttcagcaacctgacagccttccctgggggcgccaaggagctactactaagagacctagaccagctcttcctctcctctgattgccggcacttcaaccgcactgagtccctgaggcttgctgacgagttgagtggctgggtccagcgccaccagagaggccggaggaagatccctcagagggcccaggagagacagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccgaagggaccacctgctgctcccagccatcagccacaacaagacctcccggcccaagatgtccctggtgatgcctgccatggcccccaatgagaccctgtcaggccgtggggccccgggggactatgaggagatgatgcagatcgagtgtgaggtcatggacaccagggtgattcacatcaagacctccacagtgcccccctcgctccgaaaacagccatccccaaccccaggcaatgccacaggtggccccttgccagtctctgcagccagccaggcccaccaggcctcccaccagcccctctacctcaatcatccctgacctctgccattcacactgacttagaacggggggagggggtaccaggtggccaggtgggactgtttcaaatttccctgatccccaggcttggggcaattggtaaaggaaagagcaggtgtgggggttaagcacttatttgaggtgggggtgttcacctctcttctcatcccttttcagaatatagggctcctctcattcctgtgaacccccagtcctggcttctttgtttgaggggattgtgtgaggttcagttgtggggtgggtggtgagctgctgcatattttttattttgtttctctagtgttatggcagtggaggtgggaatttagtccccaggtgggacaagggaagttttttcattttggagctagttactgggagtaagggagggtggggtgggggggagttcaggtttatgtgtgtgcatttcttttttattattattaaataaacaacttggagggagttgaaggaa

SEQ ID NO: 104106 - DNA, 2620 bp, Homo sapiens
  Payload ID: 466
  Gene Symbol: ATF6B
  Gene Name: activating transcription factor 6 beta
  Uniprot ID: Q99941
  ENST ID: ENST00000375203
  CDS Start-End: 34-2145
aaccgtctcctggttggggggtgggggggaaagatggcggagctgatgctgctcagcgagattgctgacccgacgcgtttcttcaccgacaacctgcttagcccggaggactggggtctgcagaacagcaccttgtattctggcctagatgaagtggccgaggagcagacgcagctcttccgttgcccggagcaggatgtcccgtttgacggcagctccctggacgtggggatggatgtcagcccctctgagcccccatgggaactcctgccgatcttcccagatcttcaggtgaagtctgagccatcttccccctgctcttcctcctccctcagctccgagtcatcgcgtctctccacagagccatccagcgaggctcttggggtaggggaggtgctccatgtgaagacagagtccttggcacccccactgtgtctcctgggagatgacccaacatcctcatttgaaaccgtccagatcaacgttatccccacctctgatgattcctcagatgtccagaccaagatagaacctgtctctccatgttcttccgtcaactctgaggcctccctgctctcagccgactcctccagccaggcttttataggagaggaggtcctggaagtgaagacagagtccctgtccccttcaggatgcctcctgtgggatgtcccagccccctcacttggagctgtccagatcagcatgggcccatcccttgatggctcctcaggcaaagccctgcccacccggaagccgccactgcagcccaaacctgtagtgctaaccactgtcccaatgccatccagagctgtgcctcccagcaccacagtccttctgcagtccctcgtccagccacccccagtgtccccagttgtcctcatccagggtgctattcgagtccagcctgaagggccggctccctctctaccacggcctgagaggaagagcatcgttcccgctcctatgcctggaaactcctgcccgcctgaagtggatgcaaagctgctgaagcggcagcagcgaatgatcaagaaccgggagtcagcctgccagtcccggagaaagaagaaagagtatctgcagggactggaggctcggctgcaagcagtactggctgacaaccagcagctccgccgagagaatgctgccctccggcggcggctggaggccctgctggctgaaaacagcgagctcaagttagggtctggaaacaggaaggtggtctgcatcatggtcttccttctcttcattgccttcaactttggacctgtcagcatcagtgagcctccttcagctcccatctctcctcggatgaacaagggggagcctcaaccccggagacacttgctggggttctcagagcaagagccagttcagggagttgaacctctccaggggtcctcccagggccctaaggagccccagcccagccccacagaccagcccagtttcagcaacctgacagccttccctgggggcgccaaggagctactactaagagacctagaccagctcttcctctcctctgattgccggcacttcaaccgcactgagtccctgaggcttgctgacgagttgagtggctgggtccagcgccaccagagaggccggaggaagatccctcagagggcccaggagagacagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccgaagggaccacctgctgctcccagccatcagccacaacaagacctcccggcccaagatgtccctggtgatgcctgccatggcccccaatgagaccctgtcaggccgtggggccccgggggactatgaggagatgatgcagatcgagtgtgaggtcatggacaccagggtgattcacatcaagacctccacagtgcccccctcgctccgaaaacagccatccccaaccccaggcaatgccacaggtggccccttgccagtctctgcagccagccaggcccaccaggcctcccaccagcccctctacctcaatcatccctgacctctgccattcacactgacttagaacggggggagggggtaccaggtggccaggtgggactgtttcaaatttccctgatccccaggcttggggcaattggtaaaggaaagagcaggtgtgggggttaagcacttatttgaggtgggggtgttcacctctcttctcatcccttttcagaatatagggctcctctcattcctgtgaacccccagtcctggcttctttgtttgaggggattgtgtgaggttcagttgtggggtgggtggtgagctgctgcatattttttattttgtttctctagtgttatggcagtggaggtgggaatttagtccccaggtgggacaagggaagttttttcattttggagctagttactgggagtaagggagggtggggtgggggggagttcaggtttatgtgtgtgcatttcttttttattattattaaataaacaacttggagggagttgaaggaa

SEQ ID NO: 104107 - DNA, 2624 bp, Homo sapiens
  Payload ID: 466
  Gene Symbol: ATF6B
  Gene Name: activating transcription factor 6 beta
  Uniprot ID: Q99941
  ENST ID: ENST00000383156
  CDS Start-End: 47-2149
ggcgggccttgggaaccgtctcctggttggggggtgggggggaaagatggcggagctgatgctgctcagcgagattgctgacccgacgcgtttcttcaccgacaacctgcttagcccggaggactgggacagcaccttgtattctggcctagatgaagtggccgaggagcagacgcagctcttccgttgcccggagcaggatgtcccgtttgacggcagctccctggacgtggggatggatgtcagcccctctgagcccccatgggaactcctgccgatcttcccagatcttcaggtgaagtctgagccatcttccccctgctcttcctcctccctcagctccgagtcatcgcgtctctccacagagccatccagcgaggctcttggggtaggggaggtgctccatgtgaagacagagtccttggcacccccactgtgtctcctgggagatgacccaacatcctcatttgaaaccgtccagatcaacgttatccccacctctgatgattcctcagatgtccagaccaagatagaacctgtctctccatgttcttccgtcaactctgaggcctccctgctctcagccgactcctccagccaggcttttataggagaggaggtcctggaagtgaagacagagtccctgtccccttcaggatgcctcctgtgggatgtcccagccccctcacttggagctgtccagatcagcatgggcccatcccttgatggctcctcaggcaaagccctgcccacccggaagccgccactgcagcccaaacctgtagtgctaaccactgtcccaatgccatccagagctgtgcctcccagcaccacagtccttctgcagtccctcgtccagccacccccagtgtccccagttgtcctcatccagggtgctattcgagtccagcctgaagggccggctccctctctaccacggcctgagaggaagagcatcgttcccgctcctatgcctggaaactcctgcccgcctgaagtggatgcaaagctgctgaagcggcagcagcgaatgatcaagaaccgggagtcagcctgccagtcccggagaaagaagaaagagtatctgcagggactggaggctcggctgcaagcagtactggctgacaaccagcagctccgccgagagaatgctgccctccggcggcggctggaggccctgctggctgaaaacagcgagctcaagttagggtctggaaacaggaaggtggtctgcatcatggtcttccttctcttcattgccttcaactttggacctgtcagcatcagtgagcctccttcagctcccatctctcctcggatgaacaagggggagcctcaaccccggagacacttgctggggttctcagagcaagagccagttcagggagttgaacctctccaggggtcctcccagggccctaaggagccccagcccagccccacagaccagcccagtttcagcaacctgacagccttccctgggggcgccaaggagctactactaagagacctagaccagctcttcctctcctctgattgccggcacttcaaccgcactgagtccctgaggcttgctgacgagttgagtggctgggtccagcgccaccagagaggccggaggaagatccctcagagggcccaggagagacagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccgaagggaccacctgctgctcccagccatcagccacaacaagacctcccggcccaagatgtccctggtgatgcctgccatggcccccaatgagaccctgtcaggccgtggggccccgggggactatgaggagatgatgcagatcgagtgtgaggtcatggacaccagggtgattcacatcaagacctccacagtgcccccctcgctccgaaaacagccatccccaaccccaggcaatgccacaggtggccccttgccagtctctgcagccagccaggcccaccaggcctcccaccagcccctctacctcaatcatccctgacctctgccattcacactgacttagaacggggggagggggtaccaggtggccaggtgggactgtttcaaatttccctgatccccaggcttggggcaattggtaaaggaaagagcaggtgtgggggttaagcacttatttgaggtgggggtgttcacctctcttctcatcccttttcagaatatagggctcctctcattcctgtgaacccccagtcccggcttctttgtttgaggggattgtgtgaggttcagttgtggggtgggtggtgagctgctgcatattttttattttgtttctctagtgttatggcagtggaggtgggaatttagtccccaggtgggacaagggaagttttttcattttggagctagttactgggagtaagggagggtggggtgggggggagttcaggtttatgtgtgtgcatttcttttttattattattaaataaacaacttggagggagttgaaggaa

SEQ ID NO: 104108 - DNA, 425 bp, Homo sapiens
  Payload ID: 466
  Gene Symbol: ATF6B
  Gene Name: activating transcription factor 6 beta
  ENST ID: ENST00000436157
  CDS Start-End: 1-425
ccagcccagccccacagaccagcccagtttcagcaacctgacagccttccctgggggcgccaaggagctactactaagagacctagaccagctcttcctctcctctgattgccggcacttcaaccgcactgagtccctgaggcttgctgacgagttgagtggctgggtccagcgccaccagagaggccggaggaagatccctcagagggcccaggagagacagtccttagatacttctccttccagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccg

SEQ ID NO: 104109 - DNA, 2624 bp, Homo sapiens
  Payload ID: 466
  Gene Symbol: ATF6B
  Gene Name: activating transcription factor 6 beta
  Uniprot ID: Q99941
  ENST ID: ENST00000439240
  CDS Start-End: 47-2149
ggcgggccttgggaaccgtctcctggttgtggggtgggggggaaagatggcggagctgatgctgctcagcgagattgctgacccgacgcgtttcttcaccgacaacctgcttagcccggaggactgggacagcaccttgtattctggcctagatgaagtggccgaggagcagacgcagctcttccgttgcccggagcaggatgtcccgtttgacggcagctccctggacgtggggatggatgtcagcccctctgagcccccatgggaactcctgccgatcttcccagatcttcaggtgaagtctgagccatcttccccctgctcttcctcctccctcagctccgagtcatcgcgtctctccacagagccatccagcgaggctcttggggtaggggaggtgctccatgtgaagacagagtccttggcacccccactgtgtctcctgggagatgacccaacatcctcatttgaaaccgtccagatcaacgttatccccacctctgatgattcctcagatgtccagaccaagatagaacctgtctctccatgttcttccgtcaactctgaggcctccctgctctcagccgactcctccagccaggcttttataggagaggaggtcctggaagtgaagacagagtccctgtccccttcaggatgcctcctgtgggatgtcccagccccctcacttggagctgtccagatcagcatgggcccatcccttgatggctcctcaggcaaagccctgcccacccggaagccgccactgcagcccaaacctgtagtgctaaccactgtcccaatgccatccagagctgtgcctcccagcaccacagtccttctgcagtccctcgtccagccacccccagtgtccccagttgtcctcatccagggtgctattcgagtccagcctgaagggccggctccctctctaccacggcctgagaggaagagcatcgttcccgctcctatgcctggaaactcctgcccgcctgaagtggatgcaaagctgctgaagcggcagcagcgaatgatcaagaaccgggagtcagcctgccagtcccggagaaagaagaaagagtatctgcagggactggaggctcggctgcaagcagtactggctgacaaccagcagctccgccgagagaatgctgccctccggcggcggctggaggccctgctggctgaaaacagcgagctcaagttagggtctggaaacaggaaggtggtctgcatcatggtcttccttctcttcattgccttcaactttggacctgtcagcatcagtgagcctccttcagctcccatctctcctcggatgaacaagggggagcctcaaccccggagacacttgctggggttctcagagcaagagccagttcagggagttgaacctctccaggggtcctcccagggccctaaggagccccagcccagccccacagaccagcccagtttcagcaacctgacagccttccctgggggcgccaaggagctactactaagagacctagaccagctcttcctctcctctgattgccggcacttcaaccgcactgagtccctgaggcttgctgacgagttgagtggctgggtccagcgccaccagagaggccggaggaagatccctcagagggcccaggagagacagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccgaagggaccacctgctgctcccagccatcagccacaacaagacctcccggcccaagatgtccctggtgatgcctgccatggcccccaatgagaccctgtcaggccgtggggccccgggggactatgaggagatgatgcagatcgagtgtgaggtcatggacaccagggtgattcacatcaagacctccacagtgcccccctcgctccgaaaacagccatccccaaccccaggcaatgccacaggtggccccttgccagtctctgcagccagccaggcccaccaggcctcccaccagcccctctacctcaatcatccctgacctctgccattcacactgacttagaacggggggagggggtaccaggtggccaggtgggactgtttcaaatttccctgatccccaggcttggggcaattggtaaaggaaagagcaggtgtgggggttaagcacttatttgaggtgggggtgttcacctctcttctcatcccttttcagaatatagggctcctctcattcctgtgaacccccagtcctggcttctttgtttgaggggattgtgtgaggttcagttgtggggtgggtggtgagctgctgcatattttttattttgtttctctagtgttatggcagtggaggtgggaatttagtccccaggtgggacaagggaagttttttcattttggagctagttactgggagtaagggagggtggggtgggggggagttcaggtttatgtgtgtgcatttcttttttattattattaaataaacaacttggagggagttgaaggaa

SEQ ID NO: 104110 - DNA, 425 bp, Homo sapiens; identical to SEQ ID NO: 104108
  Payload ID: 466
  Gene Symbol: ATF6B
  Gene Name: activating transcription factor 6 beta
  ENST ID: ENST00000453203
  CDS Start-End: 1-425

SEQ ID NO: 104111 - DNA, 2624 bp, Homo sapiens
  Payload ID: 466
  Gene Symbol: ATF6B
  Gene Name: activating transcription factor 6 beta
  Uniprot ID: Q99941
  ENST ID: ENST00000435768
  CDS Start-End: 47-2149
ggcgggccttgggaaccgtctcctggttggggggtgggggggaaagatggcggagctgatgctgctcagcgagattgctgacccgacgcgtttcttcaccgacaacctgcttagcccggaggactgggacagcaccttgtattctggcctagatgaagtggccgaggagcagacgcagctcttccgttgcccggagcaggatgtcccgtttgacggcagctccctggacgtggggatggatgtcagcccctctgagcccccatgggaactcctgccgatcttcccagatcttcaggtgaagtctgagccatcttccccctgctcttcctcctccctcagctccgagtcatcgcgtctctccacagagccatccagcgaggctcttggggtaggggaggtgctccatgtgaagacagagtccttggcacccccactgtgtctcctgggagatgacccaacatcctcatttgaaaccgtccagatcaacgttatccccacctctgatgattcctcagatgtccagaccaagatagaacctgtctctccatgttcttccgtcaactctgaggcctccctgctctcagccgactcctccagccaggcttttataggagaggaggtcctggaagtgaagacagagtccctgtcgccttcaggatgcctcctgtgggatgtcccagccccctcacttggagctgtccagatcagcatgggcccatcccttgatggctcctcaggcaaagccctgcccacccggaagccgccactgcagcccaaacctgtagtgctaaccactgtcccaatgccatccagagctgtgcctcccagcaccacagtccttctgcagtccctcgtccagccacccccagtgtccccagttgtcctcatccagggtgctattcgagtccagcctgaagggccggctccctctctaccacggcctgagaggaagagcatcgttcccgctcctatgcctggaaactcctgcccgcctgaagtggatgcaaagctgctgaagcggcagcagcgaatgatcaagaaccgggagtcagcctgccagtcccggagaaagaagaaagagtatctgcagggactggaggctcggctgcaagcagtactggctgacaaccagcagctccgccgagagaatgctgccctccggcggcggctggaggccctgctggctgaaaacagcgagctcaagttagggtctggaaacaggaaggtggtctgcatcatggtcttccttctcttcattgccttcaactttggacctgtcagcatcagtgagcctccttcagctcccatctctcctcggatgaacaagggggagcctcaaccccggagacacttgctggggttctcagagcaagagccagttcagggagttgaacctctccaggggtcctcccagggccctaaggagccccagcccagccccacagaccagcccagtttcagcaacctgacagccttccctgggggcgccaaggagctactactaagagacctagaccagctcttcctctcctctgattgccggcacttcaaccgcactgagtccctgaggcttgctgacgagttgagtggctgggtccagcgccaccagagaggccggaggaagatccctcagagggcccaggagagacagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccgaagggaccacctgctgctcccagccatcagccacaacaagacctcccggcccaagatgtccctggtgatgcctgccatggcccccaatgagaccctgtcaggccgtggggccccgggggactatgaggagatgatgcagatcgagtgtgaggtcatggacaccagggtgattcacatcaagacctccacagtgcccccctcgctccgaaaacagccatccccaaccccaggcaatgccacaggtggccccttgccagtctctgcagccagccaggcccaccaggcctcccaccagcccctctacctcaatcatccctgacctctgccattcacactgacttagaacggggggagggggtaccaggtggccaggtgggactgtttcaaatttccctgatccccaggcttggggcaattggtaaaggaaagagcaggtgtgggggttaagcacttatttgaggtgggggtgttcacctctcttctcatcccttttcagaatatagggctcctctcattcctgtgaacccccagtcctggcttctttgtttgaggggattgtgtgaggttcagttgtggggtgggtggtgagctgctgcatattttttattttgtttctctagtgttatggcagtggaggtgggaatttagtccccaggtggaacaagggaagttttttcattttggagctagttactgggagtaagggagggtggggtgggggggagttcaggtttatgtgtgtgcatttcttttttattattattaaataaacaacttggagggagttgaaggaa

SEQ ID NO: 104112 - DNA, 425 bp, Homo sapiens; identical to SEQ ID NO: 104108
  Payload ID: 466
  Gene Symbol: ATF6B
  Gene Name: activating transcription factor 6 beta
  ENST ID: ENST00000417614
  CDS Start-End: 1-425

SEQ ID NO: 104113 - DNA, 2620 bp, Homo sapiens
  Payload ID: 466
  Gene Symbol: ATF6B
  Gene Name: activating transcription factor 6 beta
  Uniprot ID: Q99941
  ENST ID: ENST00000427136
  CDS Start-End: 34-2145
aaccgtctcctggttgtggggtgggggggaaagatggcggagctgatgctgctcagcgagattgctgacccgacgcgtttcttcaccgacaacctgcttagcccggaggactggggtctgcagaacagcaccttgtattctggcctagatgaagtggccgaggagcagacgcagctcttccgttgcccggagcaggatgtcccgtttgacggcagctccctggacgtggggatggatgtcagcccctctgagcccccatgggaactcctgccgatcttcccagatcttcaggtgaagtctgagccatcttccccctgctcttcctcctccctcagctccgagtcatcgcgtctctccacagagccatccagcgaggctcttggggtaggggaggtgctccatgtgaagacagagtccttggcacccccactgtgtctcctgggagatgacccaacatcctcatttgaaaccgtccagatcaacgttatccccacctctgatgattcctcagatgtccagaccaagatagaacctgtctctccatgttcttccgtcaactctgaggcctccctgctctcagccgactcctccagccaggcttttataggagaggaggtcctggaagtgaagacagagtccctgtccccttcaggatgcctcctgtgggatgtcccagccccctcacttggagctgtccagatcagcatgggcccatcccttgatggctcctcaggcaaagccctgcccacccggaagccgccactgcagcccaaacctgtagtgctaaccactgtcccaatgccatccagagctgtgcctcccagcaccacagtccttctgcagtccctcgtccagccacccccagtgtccccagttgtcctcatccagggtgctattcgagtccagcctgaagggccggctccctctctaccacggcctgagaggaagagcatcgttcccgctcctatgcctggaaactcctgcccgcctgaagtggatgcaaagctgctgaagcggcagcagcgaatgatcaagaaccgggagtcagcctgccagtcccggagaaagaagaaagagtatctgcagggactggaggctcggctgcaagcagtactggctgacaaccagcagctccgccgagagaatgctgccctccggcggcggctggaggccctgctggctgaaaacagcgagctcaagttagggtctggaaacaggaaggtggtctgcatcatggtcttccttctcttcattgccttcaactttggacctgtcagcatcagtgagcctccttcagctcccatctctcctcggatgaacaagggggagcctcaaccccggagacacttgctggggttctcagagcaagagccagttcagggagttgaacctctccaggggtcctcccagggccctaaggagccccagcccagccccacagaccagcccagtttcagcaacctgacagccttccctgggggcgccaaggagctactactaagagacctagaccagctcttcctctcctctgattgccggcacttcaaccgcactgagtccctgaggcttgctgacgagttgagtggctgggtccagcgccaccagagaggccggaggaagatccctcagagggcccaggagagacagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccgaagggaccacctgctgctcccagccatcagccacaacaagacctcccggcccaagatgtccctggtgatgcctgccatggcccccaatgagaccctgtcaggccgtggggccccgggggactatgaggagatgatgcagatcgagtgtgaggtcatggacaccagggtgattcacatcaagacctccacagtgcccccctcgctccgaaaacagccatccccaaccccaggcaatgccacaggtggccccttgccagtctctgcagccagccaggcccaccaggcctcccaccagcccctctacctcaatcatccctgacctctgccattcacactgacttagaacggggggagggggtaccaggtggccaggtgggactgtttcaaatttccctgatccccaggcttggggcaattggtaaaggaaagagcaggtgtgggggttaagcacttatttgaggtgggggtgttcacctctcttctcatcccttttcagaatatagggctcctctcattcctgtgaacccccagtcctggcttctttgtttgaggggattgtgtgaggttcagttgtggggtgggtggtgagctgctgcatattttttattttgtttctctagtgttatggcagtggaggtgggaatttagtccccaggtgggacaagggaagttttttcattttggagctagttactgggagtaagggagggtggggtgggggggagttcaggtttatgtgtgtgcatttcttttttattattattaaataaacaacttggagggagttgaaggaa

SEQ ID NO: 104114 - DNA, 2620 bp, Homo sapiens
  Payload ID: 466
  Gene Symbol: ATF6B
  Gene Name: activating transcription factor 6 beta
  Uniprot ID: Q99941
  ENST ID: ENST00000425571
  CDS Start-End: 34-2145
aaccgtctcctggttggggggtgggggggaaagatggcggagctgatgctgctcagcgagattgctgacccgacgcgtttcttcaccgacaacctgcttagcccggaggactggggtctgcagaacagcaccttgtattctggcctagatgaagtggccgaggagcagacgcagctcttccgttgcccggagcaggatgtcccgtttgacggcagctccctggacgtggggatggatgtcagcccctctgagcccccatgggaactcctgccgatcttcccagatcttcaggtgaagtctgagccatcttccccctgctcttcctcctccctcagctccgagtcatcgcgtctctccacagagccatccagcgaggctcttggggtaggggaggtgctccatgtgaagacagagtccttggcacccccactgtgtctcctgggagatgacccaacatcctcatttgaaaccgtccagatcaacgttatccccacctctgatgattcctcagatgtccagaccaagatagaacctgtctctccatgttcttccgtcaactctgaggcctccctgctctcagccgactcctccagccaggcttttataggagaggaggtcctggaagtgaagacagagtccctgtcgccttcaggatgcctcctgtgggatgtcccagccccctcacttggagctgtccagatcagcatgggcccatcccttgatggctcctcaggcaaagccctgcccacccggaagccgccactgcagcccaaacctgtagtgctaaccactgtcccaatgccatccagagctgtgcctcccagcaccacagtccttctgcagtccctcgtccagccacccccagtgtccccagttgtcctcatccagggtgctattcgagtccagcctgaagggccggctccctctctaccacggcctgagaggaagagcatcgttcccgctcctatgcctggaaactcctgcccgcctgaagtggatgcaaagctgctgaagcggcagcagcgaatgatcaagaaccgggagtcagcctgccagtcccggagaaagaagaaagagtatctgcagggactggaggctcggctgcaagcagtactggctgacaaccagcagctccgccgagagaatgctgccctccggcggcggctggaggccctgctggctgaaaacagcgagctcaagttagggtctggaaacaggaaggtggtctgcatcatggtcttccttctcttcattgccttcaactttggacctgtcagcatcagtgagcctccttcagctcccatctctcctcggatgaacaagggggagcctcaaccccggagacacttgctggggttctcagagcaagagccagttcagggagttgaacctctccaggggtcctcccagggccctaaggagccccagcccagccccacagaccagcccagtttcagcaacctgacagccttccctgggggcgccaaggagctactactaagagacctagaccagctcttcctctcctctgattgccggcacttcaaccgcactgagtccctgaggcttgctgacgagttgagtggctgggtccagcgccaccagagaggccggaggaagatccctcagagggcccaggagagacagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccgaagggaccacctgctgctcccagccatcagccacaacaagacctcccggcccaagatgtccctggtgatgcctgccatggcccccaatgagaccctgtcaggccgtggggccccgggggactatgaggagatgatgcagatcgagtgtgaggtcatggacaccagggtgattcacatcaagacctccacagtgcccccctcgctccgaaaacagccatccccaaccccaggcaatgccacaggtggccccttgccagtctctgcagccagccaggcccaccaggcctcccaccagcccctctacctcaatcatccctgacctctgccattcacactgacttagaacggggggagggggtaccaggtggccaggtgggactgtttcaaatttccctgatccccaggcttggggcaattggtaaaggaaagagcaggtgtgggggttaagcacttatttgaggtgggggtgttcacctctcttctcatcccttttcagaatatagggctcctctcattcctgtgaacccccagtcctggcttctttgtttgaggggattgtgtgaggttcagttgtggggtgggtggtgagctgctgcatattttttattttgtttctctagtgttatggcagtggaggtgggaatttagtccccaggtggaacaagggaagttttttcattttggagctagttactgggagtaagggagggtggggtgggggggagttcaggtttatgtgtgtgcatttcttttttattattattaaataaacaacttggagggagttgaaggaa

SEQ ID NO: 104115 - DNA, 425 bp, Homo sapiens; identical to SEQ ID NO: 104108
  Payload ID: 466
  Gene Symbol: ATF6B
  Gene Name: activating transcription factor 6 beta
  ENST ID: ENST00000413319
  CDS Start-End: 1-425

SEQ ID NO: 104116 - DNA, 5218 bp, Homo sapiens
  Payload ID: 467
  Gene Symbol: ATF7
  Gene Name: activating transcription factor 7
  Uniprot ID: P17544
  ENST ID: ENST00000456903
  CDS Start-End: 72-1523
ctttggggggaaggcggggccagaggcttgaagtgtggggagaacttggtctcctctctgctatatgaaatatgggagacgacagaccgtttgtgtgcaatgccccgggctgtggacagagatttacaaacgaggaccacctggcagttcataaacacaagcatgagatgacattgaaatttggcccagcccgaactgactcagtcatcattgcagatcaaacgcctactccaactagattcctgaagaactgtgaggaggtgggactcttcaatgaactagctagctcctttgaacatgaattcaagaaagctgcagatgaggatgagaaaaaggctgctgctgggccccttgacatgtctctgccttccacaccagacatcaaaatcaaagaagaagagccagtggaggtagactcatccccacctgatagccctgcctctagtccctgttccccaccactgaaggagaaggaggttaccccaaagcctgttctgatctctacccccacacccaccattgtacgtcctggctccctgcctctccacttgggctatgatccacttcatccaacccttccctccccaacctctgtcatcacacaggctccaccatccaacaggcaaatggggtctcccactggctccctccctcttgtcatgcatcttgctaatggacagaccatgcctgtgttgccagggcctccagtacagatgccgtctgttatatcgctggccagacctgtgtccatggtgcccaacattcctggtatccctggcccaccagttaacagtagtggctccatttctccctctggccaccctataccatcagaagccaagatgagactgaaagccaccctaactcaccaagtctcctcaatcaatggtggttgtggaatggtggtgggtactgccagcaccatggtgacagcccgcccagagcagagccagattctcatccagcaccctgatgccccatcccctgcccagccacaggtctcaccagctcagcccacccctagtactggggggcgacggcggcgcacagtagatgaagatccagatgagcgacggcagcgctttctggagcgcaaccgggctgcagcctcccgctgccgccaaaagcgaaagctgtgggtgtcctccctagagaagaaggccgaagaactcacttctcagaacattcagctgagtaatgaagtcacattactacgcaatgaggtggcccagttgaaacagctactgttagctcataaagactgcccagtcactgcactacagaaaaagactcaaggctatttagaaagccccaaggaaagctcagagccaacgggttctccagcccctgtgattcagcacagctcagcaacagcccctagcaatggcctcagtgttcgctctgcagctgaagctgtggccacctcggtcctcactcagatggccagccaaaggacagaactgagcatgccgatacaatcgcatgtaatcatgaccccacagtcccagtctgcgggcagatgatgcctcctctggtggagaggtcctcagccagagctcgcccgcccaagagccaagagagatgtcatcttatcccctcccatctgccttggacatggcaatatgggtggggggaattgtgtgttgtgagtaatggacagatatggggctttttagccatgtggtcatgtacgtttgacacctgtgctgggggcctcccagccccggagcctcatagatcatcccccagggtggggtttctgatgcatccacagccaaaggcctttccagatggtccgaacaatcacccctgccccatgcacgtgtatctgtctcttttaacactaacccttggcacttctaggtttggggtttctcagttccctctcttcccactaagccgtggctgttacctttttgttccttaccagcatgccacttcctgccagatagagggaggctagatttgatgacatattacccgctgacccagccccagccaccccatggactcaggactcaggtctcccatagctgcttatttacccgtttcctttttcctcttccttaattctagttaaaacattcacttacggagaatgtaaggttacctttgatgtatgaagtagcagtattttccagtttttccataagctttattccttctctctacctgccaccaaaaagaaagaaaccctcaagagttctaattctttttcatctatttgcagagctatttgggtacctcattttgtcccttgactttagtgtagtggtggggtctttcccaccaccccactaagccttggcaacctcattttgtggccttattattaaagattgcttggtagtgaaaagggaagggcccagaatctgactggctgattctgtctcctcccctccctccttctttagtttaaccatcagggcagacaggaacaaagtatttcaaagcttgttccatcaagttagggattaatcgattcctttatgttttataagagtttaccggccaaagcatattgtcatctttggtcatttttctgctcctgcttctctctcttcattcccctatcaacattaccgcccctgtctctcttctgtaactacttcagactcagccctcctggaggctgtcatgtaggggactctcgagttcctttgttctaccccatctctccccctcacacatctgtctgcttttctgagctagagtcttctgttcacaagtgcccatcaccgtctggactatcttctttctctttcaccaggttcctagcttagccactaggtcttccaggtcctccagagtttcttcaacccatttcttctctcttctctttacatgcagtgctccaggatcttgaagcgtcatagccaagatgctgagtgggtttacttgagtataagattgaaaggagggaggaagaggagagggaaagtgcagaactggtcccagcaaaggaccccaggttctggcctgggaaattggtgactattgctctcaaccattcttactttgaagagttgggttgcagagggagcaattcatctctcttgtccctcttccacgttaaggcttctcatctccccttggctctgaactatgcagtttctaccaggaccataggaagcaattcagagccagaggcctgtggatagataggtcagctttaattgcctttccgtatgaaacccttccagttgtcccagagccactttctgccatctgtgcaagccaagaatgtccttctctccatctttcctacctccatcttaaacatacatacaaaataactgccagcttcctttcttattttgtctccaaaattgactgtcacaggggaatgagaaaatgttctaagctacaagattcccgtttccttaaagtgatatcctgtcctagtgaaccagtcaggtaacaggttctgctgcatttgttttaaatttcccctcctgcttttcagagctggtgctgaacaggccacacccctaaagacaaaggagagaaaacacggttttctcatcctctaccatcaggtacccaacaggaataggccctgaagtgattcagactagcaaatgttatggcagatggtcaggacgcaggttaccacatccagggacttcacttttgcctttaaaaattcacagccgtaacttgtgctcaggacttcccctttagctggctgctccctgggattttctcctgctttagagttttgtttcatttttttattgtcttgatttcccagtagcagccttgccctaaagcttgactgagtttatggctcctaaggagctttcctaagactcttgactatttttcttcccccttcagtcaagtgtttttacagttaagaattaatttgtaactgcatacatgccctgccagtctgtccctgtgttgggtggctaatttatgtagcgggtcttttttatttcttagcccccatgactaattatctagtcctaacttcatttttatcagtgggaagatgtgtacgggacctcagtgaggagcactgccagaaccacagtaacaaaatggcactgaaataaggaagcagcaggtcagaaccccctagatagttcttgagttggttctcagtctcactaaggaggcagaataattgctgccctgaaacttctctgatagtcaaaggtaacttcacttaccttgttattgctaccagccatgtggtcactctccccaaatctttgtcttccagatccatctggaccagaaccaaacatcatggaaggtgtcacttggcccttcctaaagtccatggcgtttctagaggcctaagggaggacactttcagaaaggagctgagtgtatggtgggtgtcctgaattcgttcatgtgaatacaggactcaggcttcccaccccactccaatgtgagtgctcgatacacaagcactctagctagctgccacgtacccaaggccacagagggaggggacagaaccaggtcttctggtctgctcactttctgccccattcccctaacagaaagtttgcttagagttgaaaagtctaagaaagcctcccacaatactagagaggccaacaaaaaaaaagtcatgccccctttacttactcttttgctgctggttatgcatctcaaatctgacttccttagccttcacctccctccttggccctaagcattagaccatgtactctaagtagtggttaaagagggactgagcaaactgaacctcctctcgctcacttctctatccctgttctgttggttttggctcctttcttgattcactgccctctagcaccacccatcctggtagatggagtgcttaaccccaaccgtgccctatgtacagcctgaaccaccaaacagacaccaaaaaaattcttcctgtggtttctggggctcccctgctccacactgagaggctccttaaaggtgctagcccctgatacagctatccccgccagttttctccttttttcataacttccttcccatccccaaatcattaatttttcattaatattgtacattatatacacaggaaggaaatacattattttttttaaatttcataaccagcctgtttagattccagtcttcctagctatatcacatatgccttgttgatatgctctttctgctttctttagacttaatgtttgacgggggtgggggtgtctggaagaacaggaaaggtggggatcctaaggcagat

SEQ ID NO: 104117 - DNA, 6680 bp, Homo sapiens
  Payload ID: 467
  Gene Symbol: ATF7
  Gene Name: activating transcription factor 7
  Uniprot ID: P17544
  ENST ID: ENST00000420353
  CDS Start-End: 151-1602
tcgcgagagttgagcgcgcctggccggacgggaggaaagtatccgttccgccaaggggggaaaggaggagctggagacagattgtaggaccgagcgcgggcaggcgggaggcaacggagctaccagccgctcctctctgctatatgaaatatgggagacgacagaccgtttgtgtgcaatgccccgggctgtggacagagatttacaaacgaggaccacctggcagttcataaacacaagcatgagatgacattgaaatttggcccagcccgaactgactcagtcatcattgcagatcaaacgcctactccaactagattcctgaagaactgtgaggaggtgggactcttcaatgaactagctagctcctttgaacatgaattcaagaaagctgcagatgaggatgagaaaaaggctgctgctgggccccttgacatgtctctgccttccacaccagacatcaaaatcaaagaagaagagccagtggaggtagactcatccccacctgatagccctgcctctagtccctgttccccaccactgaaggagaaggaggttaccccaaagcctgttctgatctctacccccacacccaccattgtacgtcctggctccctgcctctccacttgggctatgatccacttcatccaacccttccctccccaacctctgtcatcacacaggctccaccatccaacaggcaaatggggtctcccactggctccctccctcttgtcatgcatcttgctaatggacagaccatgcctgtgttgccagggcctccagtacagatgccgtctgttatatcgctggccagacctgtgtccatggtgcccaacattcctggtatccctggcccaccagttaacagtagtggctccatttctccctctggccaccctataccatcagaagccaagatgagactgaaagccaccctaactcaccaagtctcctcaatcaatggtggttgtggaatggtggtgggtactgccagcaccatggtgacagcccgcccagagcagagccagattctcatccagcaccctgatgccccatcccctgcccagccacaggtctcaccagctcagcccacccctagtactggggggcgacggcggcgcacagtagatgaagatccagatgagcgacggcagcgctttctggagcgcaaccgggctgcagcctcccgctgccgccaaaagcgaaagctgtgggtgtcctccctagagaagaaggccgaagaactcacttctcagaacattcagctgagtaatgaagtcacattactacgcaatgaggtggcccagttgaaacagctactgttagctcataaagactgcccagtcactgcactacagaaaaagactcaaggctatttagaaagccccaaggaaagctcagagccaacgggttctccagcccctgtgattcagcacagctcagcaacagcccctagcaatggcctcagtgttcgctctgcagctgaagctgtggccacctcggtcctcactcagatggccagccaaaggacagaactgagcatgccgatacaatcgcatgtaatcatgaccccacagtcccagtctgcgggcagatgatgcctcctctggtggagaggtcctcagccagagctcgcccgcccaagagccaagagagatgtcatcttatcccctcccatctgccttggacatggcaatatgggtggggggaattgtgtgttgtgagtaatggacagatatggggctttttagccatgtggtcatgtacgtttgacacctgtgctgggggcctcccagccccggagcctcatagatcatcccccagggtggggtttctgatgcatccacagccaaaggcctttccagatggtccgaacaatcacccctgccccatgcacgtgtatctgtctcttttaacactaacccttggcacttctaggtttggggtttctcagttccctctcttcccactaagccgtggctgttacctttttgttccttaccagcatgccacttcctgccagatagagggaggctagatttgatgacatattacccgctgacccagccccagccaccccatggactcaggactcaggtctcccatagctgcttatttacccgtttcctttttcctcttccttaattctagttaaaacattcacttacggagaatgtaaggttacctttgatgtatgaagtagcagtattttccagtttttccataagctttattccttctctctacctgccaccaaaaagaaagaaaccctcaagagttctaattctttttcatctatttgcagagctatttgggtacctcattttgtcccttgactttagtgtagtggtggggtctttcccaccaccccactaagccttggcaacctcattttgtggccttattattaaagattgcttggtagtgaaaagggaagggcccagaatctgactggctgattctgtctcctcccctccctccttctttagtttaaccatcagggcagacaggaacaaagtatttcaaagcttgttccatcaagttagggattaatcgattcctttatgttttataagagtttaccggccaaagcatattgtcatctttggtcatttttctgctcctgcttctctctcttcattcccctatcaacattaccgcccctgtctctcttctgtaactacttcagactcagccctcctggaggctgtcatgtaggggactctcgagttcctttgttctaccccatctctccccctcacacatctgtctgcttttctgagctagagtcttctgttcacaagtgcccatcaccgtctggactatcttctttctctttcaccaggttcctagcttagccactaggtcttccaggtcctccagagtttcttcaacccatttcttctctcttctctttacatgcagtgctccaggatcttgaagcgtcatagccaagatgctgagtgggtttacttgagtataagattgaaaggagggaggaagaggagagggaaagtgcagaactggtcccagcaaaggaccccaggttctggcctgggaaattggtgactattgctctcaaccattcttactttgaagagttgggttgcagagggagcaattcatctctcttgtccctcttccacgttaaggcttctcatctccccttggctctgaactatgcagtttctaccaggaccataggaagcaattcagagccagaggcctgtggatagataggtcagctttaattgcctttccgtatgaaacccttccagttgtcccagagccactttctgccatctgtgcaagccaagaatgtccttctctccatctttcctacctccatcttaaacatacatacaaaataactgccagcttcctttcttattttgtctccaaaattgactgtcacaggggaatgagaaaatgttctaagctacaagattcccgtttccttaaagtgatatcctgtcctagtgaaccagtcaggtaacaggttctgctgcatttgttttaaatttcccctcctgcttttcagagctggtgctgaacaggccacacccctaaagacaaaggagagaaaacacggttttctcatcctctaccatcaggtacccaacaggaataggccctgaagtgattcagactagcaaatgttatggcagatggtcaggacgcaggttaccacatccagggacttcacttttgcctttaaaaattcacagccgtaacttgtgctcaggacttcccctttagctggctgctccctgggattttctcctgctttagagttttgtttcatttttttattgtcttgatttcccagtagcagccttgccctaaagcttgactgagtttatggctcctaaggagctttcctaagactcttgactatttttcttcccccttcagtcaagtgtttttacagttaagaattaatttgtaactgcatacatgccctgccagtctgtccctgtgttgggtggctaatttatgtagcgggtcttttttatttcttagcccccatgactaattatctagtcctaacttcatttttatcagtgggaagatgtgtacgggacctcagtgaggagcactgccagaaccacagtaacaaaatggcactgaaataaggaagcagcaggtcagaaccccctagatagttcttgagttggttctcagtctcactaaggaggcagaataattgctgccctgaaacttctctgatagtcaaaggtaacttcacttaccttgttattgctaccagccatgtggtcactctccccaaatctttgtcttccagatccatctggaccagaaccaaacatcatggaaggtgtcacttggcccttcctaaagtccatggcgtttctagaggcctaagggaggacactttcagaaaggagctgagtgtatggtgggtgtcctgaattcgttcatgtgaatacaggactcaggcttcccaccccactccaatgtgagtgctcgatacacaagcactctagctagctgccacgtacccaaggccacagagggaggggacagaaccaggtcttctggtctgctcactttctgccccattcccctaacagaaagtttgcttagagttgaaaagtctaagaaagcctcccacaatactagagaggccaacaaaaaaaaagtcatgccccctttacttactcttttgctgctggttatgcatctcaaatctgacttccttagccttcacctccctccttggccctaagcattagaccatgtactctaagtagtggttaaagagggactgagcaaactgaacctcctctcgctcacttctctatccctgttctgttggttttggctcctttcttgattcactgccctctagcaccacccatcctggtagatggagtgcttaaccccaaccgtgccctatgtacagcctgaaccaccaaacagacaccaaaaaaattcttcctgtggtttctggggctcccctgctccacactgagaggctccttaaaggtgctagcccctgatacagctatccccgccagttttctccttttttcataacttccttcccatccccaaatcattaatttttcattaatattgtacattatatacacaggaaggaaatacattattttttttaaatttcataaccagcctgtttagattccagtcttcctagctatatcacatatgccttgttgatatgctctttctgctttctttagacttaatgtttgacgggggtgggggtgtctggaagaacaggaaaggtggggatcctaaggcagattaaaggactccctccaccccactacagcctcccataactctagtcatccctctcatagtacaggactgatttctctgtgtctgtttgtacacacaaatgtgcatacagacataaattcccccaccccataccaaggtggttacctagcaggaatgagcgtaggtggctgctggccaccattaccaccgtctgcatcagctgtgttgtctctctttggggtaaagtcctaccccagaatgagaaaaggctggggagagtagggcaggttaaaggagcttatgtcctctgtagatgtaggtttgtatcatagctactagggtttatttttttaatggggggctaatagcacagagttatctcaccagcagtagctactggtgagtgatgttttagctgtaagaagtggctatgagcaatagtttcactgactttaccttagggcagtgccacagtaatctgggaacttgttagaaatacacattctcaggccccatcccagacttattgaatcacagactctgggggcagggtttaaaagcactccaagtgattctaatgcacactaaaggttgagaaccatttcttagggataagctgggaaatttttacaggtgtggaggatatttcaaatacatcttttgcctttgcactaacatgctttcatttctttcagtctcttcctccattccctttaaagtcttccccatcatatcactgatctcaaaagctagatttgtcttcattttagtcgtatccctaaaaccatgcattggtctggacaggagttgtcccatattcccttgcagactggtcactccatgttctctgttacagtaaggaccagccaagcttcagctgtcccattcctccccctacaacacacacacctttcaggcagggaggagatgagcttccagccccaagagtggaggctgccacatcctaacatagtatctattgaaaaggaagcagtgtgtatctatgattatatctctgttcatctatatatttttgacatgtagcaacacctctccatcttatcaaggaactcaactcggtctgggtctccccagtgcccagtggtggcctttgacaggtaggaggatgcagtgctgcaggctattttgttttttgttacaaaactgtcttttcccttttcccctccacctgattcagcatgatccctgtgagctggttctcacaatctcctgggactgggctgaggcaggggcttcgctctattctccctaaccatactgtcttcctttcccccttgccacttagcagttatccccccagctatgccttctccctccctcccttgccctggcatatattgtgccttatttatgctgcaaatataacattaaactatcaagtgaa

SEQ ID NO: 104118 - DNA, 473 bp, Homo sapiens
  Payload ID: 467
  Gene Symbol: ATF7
  Gene Name: activating transcription factor 7
  ENST ID: ENST00000551480
  CDS Start-End: 239-473
agaggcttgaagtgtggggagaacttggtctcctctctgctatatgaaatatgggagacgacagaccgtttgtgtgcaatgccccgggctgtggacagatcaaacgcctactccaactagattcctgaagaactgtgaggaggtgggactcttcaatgaactagctagctcctttgaacatgaattcaagaaagctgcagatgaggatgagaaaaaggctgctgctgggccccttgacatgtctctgccttccacaccagacatcaaaatcaaagaagaagagccagtggaggtagactcatccccacctgatagccctgcctctagtccctgttccccaccactgaaggagaaggaggttaccccaaagcctgttctgatctctacccccacacccaccattgtacgtcctggctccctgcctctccacttgggctatgatccacttcatccaacccttccctccccaacct

SEQ ID NO: 104119 - DNA, 1892 bp, Homo sapiens
  Payload ID: 467
  Gene Symbol: ATF7
  Gene Name: activating transcription factor 7
  Uniprot ID: P17544
  ENST ID: ENST00000548446
  CDS Start-End: 114-1598
agtatccgttccgccaaggggggaaaggaggagctggagacagattgtaggaccgagcgcgggcaggcgggaggcaacggagctaccagccgctcctctctgctatatgaaatatgggagacgacagaccgtttgtgtgcaatgccccgggctgtggacagagatttacaaacgaggaccacctggcagttcataaacacaagcatgagatgacattgaaatttggcccagcccgaactgactcagtcatcattgcagatcaaacgcctactccaactagattcctgaagaactgtgaggaggtgggactcttcaatgaactagctagctcctttgaacatgaattcaagaaagctgcagatgaggatgagaaaaaggcaagaagcaggactgttgccaaaaaactggtggctgctgctgggccccttgacatgtctctgccttccacaccagacatcaaaatcaaagaagaagagccagtggaggtagactcatccccacctgatagccctgcctctagtccctgttccccaccactgaaggagaaggaggttaccccaaagcctgttctgatctctacccccacacccaccattgtacgtcctggctccctgcctctccacttgggctatgatccacttcatccaacccttccctccccaacctctgtcatcacacaggctccaccatccaacaggcaaatggggtctcccactggctccctccctcttgtcatgcatcttgctaatggacagaccatgcctgtgttgccagggcctccagtacagatgccgtctgttatatcgctggccagacctgtgtccatggtgcccaacattcctggtatccctggcccaccagttaacagtagtggctccatttctccctctggccaccctataccatcagaagccaagatgagactgaaagccaccctaactcaccaagtctcctcaatcaatggtggttgtggaatggtggtgggtactgccagcaccatggtgacagcccgcccagagcagagccagattctcatccagcaccctgatgccccatcccctgcccagccacaggtctcaccagctcagcccacccctagtactggggggcgacggcggcgcacagtagatgaagatccagatgagcgacggcagcgctttctggagcgcaaccgggctgcagcctcccgctgccgccaaaagcgaaagctgtgggtgtcctccctagagaagaaggccgaagaactcacttctcagaacattcagctgagtaatgaagtcacattactacgcaatgaggtggcccagttgaaacagctactgttagctcataaagactgcccagtcactgcactacagaaaaagactcaaggctatttagaaagccccaaggaaagctcagagccaacgggttctccagcccctgtgattcagcacagctcagcaacagcccctagcaatggcctcagtgttcgctctgcagctgaagctgtggccacctcggtcctcactcagatggccagccaaaggacagaactgagcatgccgatacaatcgcatgtaatcatgaccccacagtcccagtctgcgggcagatgatgcctcctctggtggagaggtcctcagccagagctcgcccgcccaagagccaagagagatgtcatcttatcccctcccatctgccttggacatggcaatatgggtggggggaattgtgtgttgcaaatctgagtagcctccaagaggcacacaagcagaggatgggctgtgttgccctgactgccagccccaggcacagaggaccaggcctggtcatcctcacagactctgaccctggctcttcccactcctcttccactccaggacatcctacttaacccctcctgacatgag

SEQ ID NO: 104120 - DNA, 774 bp, Homo sapiens
  Payload ID: 467
  Gene Symbol: ATF7
  Gene Name: activating transcription factor 7
  Uniprot ID: P17544
  ENST ID: ENST00000548118
  CDS Start-End: 68-421
ggggggaaggcggggccagaggcttgaagtgtggggagaacttggtctcctctctgctatatgaaatatgggagacgacagaccgtttgtgtgcaatgccccgggctgtggacagagatttacaaacgaggaccacctggcagttcataaacacaagcatgagatgacattgaaatttggcccagcccgaactgactcagtcatcattgcagatcaaacgcctactccaactagattcctgaagaactgtgaggaggtgggactcttcaatgaactagctagctcctttgaacatgaattcaagaaagctgcagatgaggatgagaaaaaggcaagaagcaggactgttgccaaaaaactggtggtattcagacctaggctatttttattgtgctttgggataattttcttaattggttaaaacacaaaatcatgggcttagtagagtaaaaccagtaaaaccagatagtagtcactaatcccagtcagccattcaggtctttaggagttccagatgatggatcagcacaagtctgtcgtcaccgaaaattagtcctcttgttcttccaggggagtattagtttaataatcggttttttaaaaaatatttatattataaatatgttgaagatgttaaaaggtgataaattactcagattttgttggataacatatttgttgccaaattccactcttttctgagctgatcagacttctcagctacactgtttttttgaatcagcaagtcaataaacatttatcaaatttccactc

SEQ ID NO: 104121 - DNA, 860 bp, Homo sapiens
  Payload ID: 467
  Gene Symbol: ATF7
  Gene Name: activating transcription factor 7
  Uniprot ID: P17544
  ENST ID: ENST00000591397
  CDS Start-End: 154-507
ttctcgcgagagttgagcgcgcctggccggacgggaggaaagtatccgttccgccaaggggggaaaggaggagctggagacagattgtaggaccgagcgcgggcaggcgggaggcaacggagctaccagccgctcctctctgctatatgaaatatgggagacgacagaccgtttgtgtgcaatgccccgggctgtggacagagatttacaaacgaggaccacctggcagttcataaacacaagcatgagatgacattgaaatttggcccagcccgaactgactcagtcatcattgcagatcaaacgcctactccaactagattcctgaagaactgtgaggaggtgggactcttcaatgaactagctagctcctttgaacatgaattcaagaaagctgcagatgaggatgagaaaaaggcaagaagcaggactgttgccaaaaaactggtggtattcagacctaggctatttttattgtgctttgggataattttcttaattggttaaaacacaaaatcatgggcttagtagagtaaaaccagtaaaaccagatagtagtcactaatcccagtcagccattcaggtctttaggagttccagatgatggatcagcacaagtctgtcgtcaccgaaaattagtcctcttgttcttccaggggagtattagtttaataatcggttttttaaaaaatatttatattataaatatgttgaagatgttaaaaggtgataaattactcagattttgttggataacatatttgttgccaaattccactcttttctgagctgatcagacttctcagctacactgtttttttgaatcagcaagtcaataaacatttatcaaatttccactc

SEQ ID NO: 104122 - DNA, 531 bp, Homo sapiens
  Payload ID: 467
  Gene Symbol: ATF7
  Gene Name: activating transcription factor 7
  ENST ID: ENST00000588232
  CDS Start-End: 295-531
gttccgccaaggggggaaaggaggagctggagacagattgtaggaccgagcgcgggcaggcgggaggcaacggagctaccagccgctcctctctgctatatgaaatatgggagacgacagaccgtttgtgtgcaatgccccgggctgtggacagatcaaacgcctactccaactagattcctgaagaactgtgaggaggtgggactcttcaatgaactagctagctcctttgaacatgaattcaagaaagctgcagatgaggatgagaaaaaggctgctgctgggccccttgacatgtctctgccttccacaccagacatcaaaatcaaagaagaagagccagtggaggtagactcatccccacctgatagccctgcctctagtccctgttccccaccactgaaggagaaggaggttaccccaaagcctgttctgatctctacccccacacccaccattgtacgtcctggctccctgcctctccacttgggctatgatccacttcatccaacccttccctccccaacctct

SEQ ID NO: 104123 - DNA, 531 bp, Homo sapiens
  Payload ID: 467
  Gene Symbol: ATF7
  Gene Name: activating transcription factor 7
  ENST ID: ENST00000588078
  CDS Start-End: 43-531
gaagtgtggggagaacttggtctcctctctgctatatgaaatatgggagacgacagaccgtttgtgtgcaatgccccgggctgtggacagagatttacaaacgaggaccacctggcagttcataaacacaagcatgagatgacattgaaatttggcccagcccgaactgactcagtcatcattgcagatcaaacgcctactccaactagattcctgaagaactgtgaggaggtgggactcttcaatgaactagctagctcctttgaacatgaattcaagaaagctgcagatgaggatgagaaaaaggcaagaagcaggactgttgccaaaaaactggtggctgctgctgggccccttgacatgtctctgccttccacaccagacatcaaaatcaaagaagaagagccagtggaggtagactcatccccacctgatagccctgcctctagtccctgttccccaccactgaaggagaaggaggttaccccaaagcctgttctgatctctacccccacacccaccattgtacgt

SEQ ID NO: 104124 - DNA, 8878 bp, Homo sapiens
  Payload ID: 468
  Gene Symbol: ATF7IP
  Gene Name: activating transcription factor 7 interacting protein
  Uniprot ID: Q6VMQ6
  ENST ID: ENST00000261168
  CDS Start-End: 204-4016
aatttgcataacggccccggcgcgtgcaagggagaagcgggtttgtttttgaatctgcggaggcggcggcggtggcagcggcggcgcggcgactgaagcgcgcgaaaagctgaggcggcaacgtcggggacggctgcgcgggacggctctgtaggaaggaacttggttccccctccctcagcttccgccccaaaagattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggtgattccacctctggtgatcccacctctagcgagccctcctctagtgatgctgcctctggtgatgcaacctctggtgatgccccttctggtgatgtgtcccctggtgatgccacctctggtgatgccactgctgatgatctctcctctggtgatcccacctctagtgatcccatcccaggtgaaccggtccctgttgaacccatttctggtgattgtgccgctgatgatatagcctctagtgaaataacttctgttgatctggcttctggagcaccagcttccactgatccagcctctgatgatctggcctctggtgatctatcctctagtgaactggcctctgatgatctggccactggtgaactggcctctgatgagctgacttctgaatcaacctttgatcgtacctttgaaccaaagtctgtaccagtttgtgaaccagttcctgaaattgacaatatagaaccaagtagcaataaagatgatgattttcttgaaaaaaatggagctgatgaaaaattagagcaaattcagagtaaagactcattggatgagaaaaataaagctgataataatattgatgctaatgaagaaactctagaaacagatgatacaactatttgttcagatcgacctcctgaaaatgaaaagaaggtagaggaagatattatcacagagcttgctcttggagaagatgctatatctagcagtatggaaattgaccaaggtgaaaagaatgaagatgaaacttctgcagatcttgtagaaacgattaatgaaaatgttattgaagataacaaaagtgagaatatcttagaaaatacagactctatggagacagatgaaatcattcctattttggaaaagcttgcaccttctgaggatgaacttacttgcttttctaaaacatctctccttccaatcgatgagacaaatccagatttggaagagaaaatggaaagttcttttggttcaccatctaaacaagaaagtagtgagagtttgccaaaagaagcctttctggtcctctctgatgaagaggatatttcgggtgaaaaagatgagtctgaagttatatcgcaaaatgaaacgtgctctccagcagaagtagaaagtaatgaaaaggacaacaaacctgaggaagaagagcaagtaatacatgaagatgatgaaagaccttctgagaaaaatgaattttctagacgaaaacgttctaaatcagaagacatggacaatgtacagtctaaacgtcgtcgatatatggaagaagaatatgaggcagaatttcaagtaaagattacagccaaaggagacattaaccagaaacttcaaaaggttatacagtggttgctggaagaaaaattgtgtgcgctgcagtgtgctgtatttgataagactttggcagaattgaaaacacgagtggaaaagattgaatgtaacaagaggcataaaacagttctcactgaactacaggccaagatagccaggttaaccaaacgctttgaagcagccaaagaagatcttaagaaaagacatgaacatccacccaacccaccagtatcaccaggaaaaactgtaaatgatgtcaacagcaataataacatgtcttacagaaatgcaggcacagtgagacagatgctggagtccaaaagaaatgtaagcgagagtgcaccaccatcctttcaaactcctgtgaatacagtatcttcaaccaatcttgtcactcctccagcagttgtcagtagtcaacctaaattgcagactccagtgacttcgggttccctcacagcaacgtcagttcttcctgcacccaatacagctactgtagttgctactactcaggtgcctagtggaaatccccagcctacaatctctttacagcctttgccagtgattttgcatgtacctgttgcagtatcctcccagcctcagcttctacagagccatccagggactttggtgactaatcaaccatctggcaatgttgaattcatttctgtgcaaagcccacctacagtgagtggtcttaccaaaaatccagtatccttgccatccttgccaaatcccactaaaccaaacaacgttccttctgtgcccagtcctagtattcaaaggaaccctactgccagtgctgcaccattgggaacaacacttgctgtgcaggctgttccaacagcacactctattgtacaagccacaaggacttctttacccacagtgggcccatcaggactctatagtccatcaactaatcgaggtcctatacagatgaaaattccaatttctgcatttagtacttcgtctgctgcagaacagaacagcaataccaccccaagaattgaaaaccagacaaacaaaacaatagatgcttctgtcagtaagaaagcagctgatagcacatcacagtgtggaaaagccactggcagtgattcaagtggtgtcattgatctcacaatggatgatgaagagagtggagcttcacaagaccccaaaaaactaaatcacactcctgtatcaaccatgagttcttctcagcctgtgtcacgaccattgcaacccatacaaccagcaccgcctcttcaaccatctggggtgccaacaagtggaccatctcagaccaccatacacttactacctacagctccaactaccgtgaatgtaacacatcgtccagtaactcaggtgaccacaagactccctgtaccaagagctcctgcaaaccaccaggtggtttatacaactcttcctgcaccaccagctcaggctcccttgcgaggaactgttatgcaggctcctgctgttcggcaggtcaatccccaaaatagtgttacagttcgagtgcctcaaacaaccacatatgttgtaaacaatggactaaccctgggatcaacaggacctcagctcacagtgcatcaccgaccaccacaagtgcatactgagcccccacgccccgtgcacccagcacccttaccagaagctccacaaccacagcgtctgcccccagaagctgccagcacatctctgcctcagaagccacacttgaagttagcacgcgttcagagtcaaaatggcatagtactgtcatggagtgtcctggaggtggatcgaagctgtgccactgttgatagctaccatctctatgcttaccatgaggaacccagtgccactgtgccctcacaatggaaaaagattggggaagtcaaggcacttcccttgcccatggcatgtactctcacccagtttgtatctggtagcaaatactactttgcagtacgagccaaggatatttatggacgttttgggcctttctgtgatcctcagtcaacagatgtgatctcttctacccagagcagttaaaccttggagcctttatattttcctcttttaaaatttccaccttttggtcttgtttttaatcttgtgcatgataccccatgtaaaatccaccttgtgcaagatttcttggacagatgtgtgtatacactacatttgtttataaccagaagcaaaataaactcagcccacaaagctagaatcttttcctggacagtttaggctttggggtttggaaatgtaaatgtgtaccttgctttagttttgaggctggggaatatgtgtgggtgtttatgtgtgtttttccttatgtaggtgttattgcattggagtctcccattttcattctcaaatttacctcttaaagtacgaagtaagtagatcaaaggatttgagatgtgtaactggcatgattctgcttttgaaggatctatagtatcattttagttaagtgggtcaaacagaatcaaaacaaaacccaaagaaataaataaaaaacaaaatggctaaatagtttaaaataggttaattcgaacacaggaaaggatctatttgttgtttcttttgtctggtctcctgagttgttaattaggtgaaaaaagatctgcaatggccccctccctttcctaatctggcttttacatttattttgtgccttaaagattaactacaaagataaacatggccaaaaataaataaataaatatggccatatgtccgttgttgcttagtcttcccttgcagccttttacccttgatttctccttcatctctaccaaatatagcacaactcctcaagtaattttttttttttaagatggagttttgctcttgttgcccaggctagagtgcggtggcacaatcttggctcactgcaacctctgcctcctgggttcaagcaattcttctgtctcagccccagagtagctgggattacaggcacctgtcaccatgcccggctaatttttgtatttttagtagagatggggtttcaccatgttggccaggctggtcttgaactcctgacctcaggtgatccacccgcctcggcctcccagagtgctgcgattacagttgtgagccactgtatccagcctactcaagtgatttttaaaccaaggtgtgtgtatgtacatggatgtgtatgtacacacacacacaggtgcatgcatagtctcatcttagccgggcatggtggcgacaatcacatttaactccaaaaatttgacgtgctattttcttctaaaactatagatgcttttatttttggtcactatttaactttgtgtaaagtggaccaagagaaaaccatattgtggaagacagtttttcacacattttagtatccgtgttgcacactgtgttagagattatgaaaaccattctagttcagtttatcacccaaagctatcacccaacactaactccttagtattctttcaaaggaagcaaatagtaagattacaatatagaatgagctaaaatatcaaggggaaagcttcatttcctctttattctctttatcgtccttcccattttaaccttttaactttgttttgatggtgccaagttgagtctgatgtacccattgttagctttggatagaatttaaagtatatcccagaattagctgggcatgttggtgcatgcctgtaatcccagctactcaggaggcaaggctggagaatcgcttgaacccgggaggcggaggttgcagtgagctgagattgcgccattgcactccatcctgggagacaagagcgaaactctgcctcaaaaaaaaaagaatttaaagtatatcctttgaggtcattttatgtaacaattagatataacctcctgtgtatctctctgttcctcttcaaagttattaaaattcagcttaggtcatggatttttaatatgagggccagctgtactggtgtcaggtaggtgttttgggtgtagataatttaggactggagggctgagttaagttttaggaggagaatgtggttgagaatattttgaaaggaatttatggagtttgtgaaataacttcgaagtcctcttcctttacaatatttgaattcatatttgtaccttctcaaaatagtgattcatttttcctagaattacaggagggagctcttttactaatgttgttttgtttgcaactttgatggcttataataggaagtattctagttgtaaagaaaactctttagagacttttgactggtcagtatactgaggtgtgagatttgattcatgatgaagaaagcctatagattgccaaaaaattaattctccaaaccacctttcactctcagaaaatgagaccacaaaggagtatgctataaatcaaatttgccaaccaattatgtagatattactcattctaggactaatgatgatggtaaagaagttgccagtgttatggcaatgaaaatttcagaaaggaggagttgatgatcttctagatgtatatgaacacctgtctatatctgcatgtatatgttttgacctgcagtggttgcaatgttgatatgtgttcaagattattcctgtctacaaaactgaaggcccatgttcaaattgttctttattgggtgtttttatggtcacgtggtaacaattttcttacctaacctacaaaaggttctcttgatgaacatttttatttatatttactaatcttttttaaaaaaagctttcatagcattatataatcagatgaagaaagcccagtagaataaaaaaaaaattcattagcctagcctatattatgttttctgtcaaaggaaaacaaattctcaaataggaattctaaaaatatttactaaagtaaaataactacttaaaatgttttattccagttggaaggaaggtacagggagaaatcgcaattatttaggggagaagtatatttattataagatggtgtcctcaaattagcctaccatggcacgtaggggcagcagctatattagatttactagaggtgctaagttagaacactaggcttttattgaggcaggttttaatattgatagatgctttttgtttggtttgtttcttctgggagagaatggaggacttaagtagaagtagctactgataacagactttctagtagcagtttccactccacggttacctttttagtttcatagtatcttttcacaaagtattacaaataagctagattctcccagtttgggaatgcaagtttgctacatttttagcctggcaatatttgtgtaggtattgccttattggaaattctggaaacctgatactgcaacctgcaatgtaggatgtttgtatggcatttaaaggtaatggtgatgtttattattctatactttgcattctgtgagagtaattttcactctgtcttaagtgtgagtaagcctcttctaaaaatcttgttcttgccaagaaatttataaatcacatacgaagacgtctgttgctaacagttaactttatgaggtaactatatccttctatttctctggactcatttttaaaaaatatgccgaatactgcatactgtttaaggtagtatataagtttatgagagaagtggagagctttcttccttgaaaagtcggtatttgttgagataccatttgcctcacagagaggtgttccccactcccatccccattgccagataataaatattttgagaaaagtgacctaaaacagctgaaatcttaggtgcatctgtctgcagacctccttaagcaggctgtatcttacaattcccttactgcactgggtaagtgttaacttagtttttgttgtttgctcttttgctttaaatattctccaaattaccatttatgcaacatggttagggttaatactgcatggtattcatttatcttgtttcatgaactttccagtactgtacaaggtcaacaaagtaatgcctgtggtatcctcatctctcacttttttactctgtgattttagcacagtaaggtactgcaaagaccttccttccaaatgttctccttgactttatttcttgggccaattcagtatcctcaacatcctaagattttgttgttttatcactgacctgtggttggcctgttttattctaatttccagaaaagtcaagtcccagtatttgcaatatcaaataactctaaaaccgatgtgtgattctaccttccttactatttttactgggcaaatgccctatttttttaattattattatttttaacttttgggacacacaaaaatcagcaattctcatgaagcgtttgttagtgtggcagacttgtctaattcctgaaactcattcatccccttgagccagccaatggggaggaataggataatgcaaacacatgttttgttttctcattttcaaataatttaccatgttaaaataaacttttctttgttttttatttgtagagtcagctaagtacccatatttaaatgccgtctttattatttttttgaggtctttgtttttgtctgtttttgttttgttttgttttgtaaataaggtaactgggcaatcaaacaccttttggggattctggctttagtattttatcagccattttaaaattaaatataaaaatcctttgtaagaaacttgcatcctaatttttctttattgcaattgaaagtgtaaataataagacaatgtaagtaagaccttcctaatgtctaatacaaactgggctccagcaagtggccctatttttattagggttttgaaggtttgtgtgtgtgtgtgcgtgcgtgtgtgtgtttttcttttttaaatgtatagtagagtggtgtctgtataagtgttacctgtagtggggttttgtccagcaagcctgaaatttatactttgaaataaaactactgggtttttaacattc

SEQ ID NO: 104125 - DNA, 1727 bp, Homo sapiens
  Payload ID: 468
  Gene Symbol: ATF7IP
  Gene Name: activating transcription factor 7 interacting protein
  ENST ID: ENST00000396279
  CDS Start-End: 182-1727
aaggtaaccaaaactaagaaattgatgttaggtaatttgcccagtctcacacagtaggtttcctgggagagttggaattcaaatctgtgaatctgtctacagtctacagagttcatgttcttaattgggttattaaaagtgatgaatttttttaaaggaatgcttacttttaatattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggtgattccacctctggtgatcccacctctagcgagccctcctctagtgatgctgcctctggtgatgcaacctctggtgatgccccttctggtgatgtgtcccctggtgatgccacctctggtgatgccactgctgatgatctctcctctggtgatcccacctctagtgatcccatcccaggtgaaccggtccctgttgaacccatttctggtgattgtgccgctgatgatatagcctctagtgaaataacttctgttgatctggcttctggagcaccagcttccactgatccagcctctgatgatctggcctctggtgatctatcctctagtgaactggcctctgatgatctggccactggtgaactggcctctgatgagctgacttctgaatcaacctttgatcgtacctttgaaccaaagtctgtaccagtttgtgaaccagttcctgaaattgacaatatagaaccaagtagcaataaagatgatgattttcttgaaaaaaatggagctgatgaaaaattagagcaaattcagagtaaagactcattggatgagaaaaataaagctgataataatattgatgctaatgaagaaactctagaaacagatgatacaactatttgttcagatcgacctcctgaaaatgaaaagaaggtagaggaagatattatcacagagcttgctcttggagaagatgctatatctagcagtatggaaattgaccaaggtgaaaagaatgaagatgaaacttctgcagatcttgtagaaacgattaatgaaaatgttattgaagataacaaaagtgagaatatcttagaaaatacagactctatggagacagatgaaatcattcctattttggaaaagcttgcaccttctgaggatgaacttacttgcttttctaaaacatctctccttccaatcgatgagacaaatccagatttggaagagaaaatggaaagttcttttggttcaccatctaaacaagaaagtagtgagagtttgccaaaagaagcctttctggtcctctctgatgaagaggatatttcgggtgaaaaagatgagtctgaagttatatcgcaaaatgaaa

SEQ ID NO: 104126 - DNA, 555 bp, Homo sapiens
  Payload ID: 468
  Gene Symbol: ATF7IP
  Gene Name: activating transcription factor 7 interacting protein
  ENST ID: ENST00000428217
  CDS Start-End: 180-555
aggtgttggtattagtccctttttaagggaggacagactattacaagataaagctgtaattgataaagaagttggcctggtgtggtggctcacacctgtaatcccagcactttgggaggccgaggcaggtggatcacgaggtcagaagatcaagaccatcctggctaacacgattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgc

SEQ ID NO: 104127 - DNA, 619 bp, Homo sapiens
  Payload ID: 468
  Gene Symbol: ATF7IP
  Gene Name: activating transcription factor 7 interacting protein
  ENST ID: ENST00000535738
  CDS Start-End: 1-346
cactcctgtatcaaccatgagttcttctcagcctgtgtcacgaccattgcaacccatacaaccagcaccgcctcttcaaccatctggggtgccaacaagtggaccatctcagaccaccatacacttactacctacagctccaactaccgtgaatgtaacacatcgtccagtaactcaggtgaccacaagactccctgtaccaagagctcctgcaaaccaccaggtggtttatacaactcttcctgcaccaccagctcaggctcccttgcgaggaactgttatgcaggctcctgctgttcggcaggtcaatccccaaaatagagagttaaacagagaaaattgttgatgtatactagttgatttgtgctctgagtgttgtctttaatttaactttatttatggcctgtattagtatagtacacaatttgatattggtatattctctactctattaagaaacaccttacctagttagagtgggaatggtcaattgtgatttaccccagatgatggaaatcatggtaaaggatagccttcaatgagagtcttaaagatatggaaagtggctgagaaaagaagggaaaatgttaaagaaagcttgtagtttcttgtatatatc

SEQ ID NO: 104128 - DNA, 580 bp, Homo sapiens
  Payload ID: 468
  Gene Symbol: ATF7IP
  Gene Name: activating transcription factor 7 interacting protein
  ENST ID: ENST00000542508
  CDS Start-End: 484-580
agaatctcaagctgaattggcttccagcaagtaggctaggcttattattttatgcgcttcagccaaagaccagcaggaacacctttgtaattgaaaaagttaggtttactatttgctgcagggaggaaataatgttcactatggggaaactgtaaggcacatcaatcagtaagaggatgttagaaaaaacctagtataggatttgagtatagtataggttgggttattttggggagagattaaggaagtagatccttatcgtggattgggtgacatcagaaagtgggggcacttctattcttgggtatctcaataaattttatctatatagggaggacagactattacaagataaagctgtaattgataaagaagttggcctggtgtggtggctcacacctgtaatcccagcactttgggaggccgaggcaggtggatcacgaggtcagaagatcaagaccatcctggctaacacgattcagaatggacagtttagaagaacctcagaaaaaagtctttaaggctcgaaaaacgatgagagtgagtgatcgtcagcaacttgaagcagtgtacaaggtca

SEQ ID NO: 104129 - DNA, 550 bp, Homo sapiens
  Payload ID: 468
  Gene Symbol: ATF7IP
  Gene Name: activating transcription factor 7 interacting protein
  ENST ID: ENST00000534828
  CDS Start-End: 95-550
ttcttctttttttctcaagagaatatttgacctgatgtaattcttggatctctgaggtcttctacacagaagtatatttagagagcaattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggt

SEQ ID NO: 104130 - DNA, 573 bp, Homo sapiens
  Payload ID: 468
  Gene Symbol: ATF7IP
  Gene Name: activating transcription factor 7 interacting protein
  ENST ID: ENST00000539057
  CDS Start-End: 44-573
aaactaagagtatggctgcagcaagctccctcttggattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggtgattccacctctggtgatcccacctctagcgagccctcctctagtgatgctgcctctggtgatgcaacctctgg

SEQ ID NO: 104131 - DNA, 4847 bp, Homo sapiens
  Payload ID: 468
  Gene Symbol: ATF7IP
  Gene Name: activating transcription factor 7 interacting protein
  Uniprot ID: Q6VMQ6
  ENST ID: ENST00000544627
  CDS Start-End: 321-4157
gacgggattcacaggcattatgttacaaaactggcttgctgccttctgttttctttttctgtgtcctgtgtagctgcattgtttgttgcagtatatgcattagctgttgtctatgttcagtttcctgcaggctgacaaagtgggaggggctttgtttgttacatagctgagttttcactgtgtgagttcttgagtgcacattgcagccatcttaattacacttttgtgcaactgagactgtgcagctgtctcaaaatggctgctaacctagtctttgtagctgcttaggcagcaagtatgtcagtgaggagacttgtcacatgcatcaggaccagagattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggtgattccacctctggtgatcccacctctagcgagccctcctctagtgatgctgcctctggtgatgcaacctctggtgatgccccttctggtgatgtgtcccctggtgatgccacctctggtgatgccactgctgatgatctctcctctggtgatcccacctctagtgatcccatcccaggtgaaccggtccctgttgaacccatttctggtgattgtgccgctgatgatatagcctctagtgaaataacttctgttgatctggcttctggagcaccagcttccactgatccagcctctgatgatctggcctctggtgatctatcctctagtgaactggcctctgatgatctggccactggtgaactggcctctgatgagctgacttctgaatcaacctttgatcgtacctttgaaccaaagtctgtaccagtttgtgaaccagttcctgaaattgacaatatagaaccaagtagcaataaagatgatgattttcttgaaaaaaatggagctgatgaaaaattagagcaaattcagagtaaagactcattggatgagaaaaataaagctgataataatattgatgctaatgaagaaactctagaaacagatgatacaactatttgttcagatcgacctcctgaaaatgaaaagaaggtagaggaagatattatcacagagcttgctcttggagaagatgctatatctagcagtatggaaattgaccaaggtgaaaagaatgaagatgaaacttctgcagatcttgtagaaacgattaatgaaaatgttattgaagataacaaaagtgagaatatcttagaaaatacagactctatggagacagatgaaatcattcctattttggaaaagcttgcaccttctgaggatgaacttacttgcttttctaaaacatctctccttccaatcgatgagacaaatccagatttggaagagaaaatggaaagttcttttggttcaccatctaaacaagaaagtagtgagagtttgccaaaagaagcctttctggtcctctctgatgaagaggatatttcgggtgaaaaagatgagtctgaagttatatcgcaaaatgaaacgtgctctccagcagaagtagaaagtaatgaaaaggacaacaaacctgaggaagaagagcaagtaatacatgaagatgatgaaagaccttctgagaaaaatgaattttctagacgaaaacgttctaaatcagaagacatggacaatgtacagtctaaacgtcgtcgatatatggaagaagaatatgaggcagaatttcaagtaaagattacagccaaaggagacattaaccagaaacttcaaaaggttatacagtggttgctggaagaaaaattgtgtgcgctgcagtgtgctgtatttgataagactttggcagaattgaaaacacgagtggaaaagattgaatgtaacaagaggcataaaacagttctcactgaactacaggccaagatagccaggttaaccaaacgctttgaagcagccaaagaagatcttaagaaaagacatgaacatccacccaacccaccagtatcaccaggaaaaactgtaaatgatgtcaacagcaataataacatgtcttacagaaatgcaggcacagtgagacagatgctggagtccaaaagaaatgtaagcgagagtgcaccaccatcctttcaaactcctgtgaatacagtatcttcaaccaatcttgtcactcctccagcagttgtcagtagtcaacctaaattgcagactccagtgacttcgggttccctcacagcaacgtcagttcttcctgcacccaatacagctactgtagttgctactactcaggtgcctagtggaaatccccagcctacaatctctttacagcctttgccagtgattttgcatgtacctgttgcagtatcctcccagcctcagcttctacagagccatccagggactttggtgactaatcaaccatctggcaatgttgaattcatttctgtgcaaagcccacctacagtgagtggtcttaccaaaaatccagtatccttgccatccttgccaaatcccactaaaccaaacaacgttccttctgtgcccagtcctagtattcaaaggaaccctactgccagtgctgcaccattgggaacaacacttgctgtgcaggctgttccaacagcacactctattgtacaagccacaaggacttctttacccacagtgggcccatcaggactctatagtccatcaactaatcgaggtcctatacagatgaaaattccaatttctgcatttagtacttcgtctgctgcagaacagaacagcaataccaccccaagaattgaaaaccagacaaacaaaacaatagatgcttctgtcagtaagaaagcagctgatagcacatcacagtgtggaaaagccactggcagtgattcaagtggtgtcattgatctcacaatggatgatgaagagagtggagcttcacaagaccccaaaaaactaaatcacactcctgtatcaaccatgagttcttctcagcctgtgtcacgaccattgcaacccatacaaccagcaccgcctcttcaaccatctggggtgccaacaagtggaccatctcagaccaccatacacttactacctacagctccaactaccgtgaatgtaacacatcgtccagtaactcaggtgaccacaagactccctgtaccaagagctcctgcaaaccaccaggtggtttatacaactcttcctgcaccaccagctcaggctcccttgcgaggaactgttatgcaggctcctgctgttcggcaggtcaatccccaaaatagtgttacagttcgagtgcctcaaacaaccacatatgttgtaaacaatggactaaccctgggatcaacaggacctcagctcacagtgcatcaccgaccaccacaagtgcatactgagcccccacgccccgtgcacccagcacccttaccagaagctccacaaccacagcgtctgcccccagaagctgccagcacatctctgcctcagaagccacacttgaagttagcacgcgttcagagtcaaaatggcatagtactgtcatggagtgtcctggaggtggatcgaagctgtgccactgttgatagctaccatctctatgcttaccatgaggaacccagtgccactgtgccctcacaatggaaaaagattggggaagtcaaggcacttcccttgcccatggcatgtactctcacccagtttgtatctggtagcaaatactactttgcagtacgagccaaggatatttatggacgttttgggcctttctgtgatcctcagtcaacagatgtgatctcttctacccagagcagttaaaccttggagcctttatattttcctcttttaaaatttccaccttttggtcttgtttttaatcttgtgcatgataccccatgtaaaatccaccttgtgcaagatttcttggacagatgtgtgtatacactacatttgtttataaccagaagcaaaataaactcagcccacaaagctagaatcttttcctggacagtttaggctttggggtttggaaatgtaaatgtgtaccttgctttagttttgaggctggggaatatgtgtgggtgtttatgtgtgtttttccttatgtaggtgttattgcattggagtctcccattttcattctcaaatttacctcttaaagtacgaagtaagtagatcaaaggatttgagatgtgtaactggcatgattctgcttttgaaggatctatagtatcattttagttaagtgggtcaaacagaatcaaaacaaaacccaaagaaataaataaaaaacaaaatggctaaatagtttaaaataggttaattcgaacacaggaaaggatctatttgttgtttcttttgtctggtctcctgagttgttaattaggtgaaaaaagatctgcaatggccccctccctttcctaatctggcttttacatttattttgtgccttaaagattaactacaaagataaacatggccaaaaataaataaataaatatggccata

SEQ ID NO: 104132 - DNA, 558 bp, Homo sapiens
  Payload ID: 468
  Gene Symbol: ATF7IP
  Gene Name: activating transcription factor 7 interacting protein
  ENST ID: ENST00000538511
  CDS Start-End: 270-558
atctgcggaggcggcggcggtggcagcggcggcgcggcgactgaagcgcgcgaaaagctgaggcggcaacgtcggggacggctgcgcgggacggctctgtaggaaggaacttggttccccctccctcagcttccgccccaaaagcagaagtagaaagtaatgaaaaggacaacaaacctgaggaagaagagcaagtaatacatgaagatgatgaaagaccttctgagaaaaatgaattttctagacgaaaacgttctaaatcagaagacatggacaatgtacagtctaaacgtcgtcgatatatggaagaagaatatgaggcagaatttcaagtaaagattacagccaaaggagacattaaccagaaacttcaaaaggttatacagtggttgctggaagaaaaattgtgtgcgctgcagtgtgctgtatttgataagactttggcagaattgaaaacacgagtggaaaagattgaatgtaacaagaggcataaaacagttctcactgaactacaggccaagatagccaggttaaccaaacgctttgaagcagccaaag

SEQ ID NO: 104133 - DNA, 570 bp, Homo sapiens
  Payload ID: 468
  Gene Symbol: ATF7IP
  Gene Name: activating transcription factor 7 interacting protein
  ENST ID: ENST00000541056
  CDS Start-End: 63-570
agtttctgttgctgtgaaagaactgataagatggctgcagggggctccctttgggattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggtgattccacctctggtgatcccacctctagcgagccctcctctagtgatgctg

SEQ ID NO: 104134 - DNA, 571 bp, Homo sapiens
  Payload ID: 468
  Gene Symbol: ATF7IP
  Gene Name: activating transcription factor 7 interacting protein
  ENST ID: ENST00000536279
  CDS Start-End: 304-571
gatgttaggtaatttgcccagtctcacacagtaggtttcctgggagagttggaattcaaatctgtgaatctgtctacagtctacagagttcatgttcttaattgggttattaaaagtgatgaatttttttaaaggaatgcttacttttaatggaggacagactattacaagataaagctgtaattgataaagaagttggcctggtgtggtggctcacacctgtaatcccagcactttgggaggccgaggcaggtggatcacgaggtcagaagatcaagaccatcctggctaacacgattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaagg

SEQ ID NO: 104135 - DNA, 4887 bp, Homo sapiens
  Payload ID: 468
  Gene Symbol: ATF7IP
  Gene Name: activating transcription factor 7 interacting protein
  Uniprot ID: Q6VMQ6
  ENST ID: ENST00000543189
  CDS Start-End: 143-3460
ggcggcggcggtggcagcggcggcgcggcgactgaagcgcgcgaaaagctgaggcggcaacgtcggggacggctgcgcgggacggctctgtaggaaggaacttggttccccctccctcagcttccgccccaaaagattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggtgattccacctctggtgatcccacctctagcgagccctcctctagtgatgctgcctctggtgatgcaacctctggtgatgccccttctggtgatgtgtcccctggtgatgccacctctggtgatgccactgctgatgatctctcctctggtgatcccacctctagtgatcccatcccaggtgaaccggtccctgttgaacccatttctggtgattgtgccgctgatgatatagcctctagtgaaataacttctgttgatctggcttctggagcaccagcttccactgatccagcctctgatgatctggcctctggtgatctatcctctagtgaactggcctctgatgatctggccactggtgaactggcctctgatgagctgacttctgaatcaacctttgatcgtacctttgaaccaaagtctgtaccagtttgtgaaccagttcctgaaattgacaatatagaaccaagtagcaataaagatgatgattttcttgaaaaaaatggagctgatgaaaaattagagcaaattcagagtaaagactcattggatgagaaaaataaagctgataataatattgatgctaatgaagaaactctagaaacagatgatacaactatttgttcagatcgacctcctgaaaatgaaaagaaggtagaggaagatattatcacagagcttgctcttggagaagatgctatatctagcagtatggaaattgaccaaggtgaaaagaatgaagatgaaacttctgcagatcttgtagaaacgattaatgaaaatgttattgaagataacaaaagtgagaatatcttagaaaatacagactctatggagacagatgaaatcattcctattttggaaaagcttgcaccttctgaggatgaacttacttgcttttctaaaacatctctccttccaatcgatgagacaaatccagatttggaagagaaaatggaaagttcttttggttcaccatctaaacaagaaagtagtgagagtttgccaaaagaagcctttctggtcctctctgatgaagaggatatttcgggtgaaaaagatgagtctgaagttatatcgcaaaatgaaacgtgctctccagaagtagaaagtaatgaaaaggacaacaaacctgaggaagaagagcaagtaatacatgaagatgatgaaagaccttctgagaaaaatgaattttctagacgaaaacgttctaaatcagaagacatggacaatgtacagtctaaacgtcgtcgatatatggaagaagaatatgaggcagaatttcaagtaaagattacagccaaaggagacattaaccagaaacttcaaaaggttatacagtggttgctggaagaaaaattgtgtgcgctgcagtgtgctgtatttgataagactttggcagaattgaaaacacgagtggaaaagattgaatgtaacaagaggcataaaacagttctcactgaactacaggccaagatagccaggttaaccaaacgctttgaagcagccaaagaagatcttaagaaaagacatgaacatccacccaacccaccagtatcaccaggaaaaactgtaaatgatgtcaacagcaataataacatgtcttacagaaatgcaggcacagtgagacagatgctggagtccaaaagaaatgtaagcgagagtgcaccaccatcctttcaaactcctgtgaatacagtatcttcaaccaatcttgtcactcctccagcagttgtcagtagtcaacctaaattgcagactccagtgacttcgggttccctcacagcaacgtcagttcttcctgcacccaatacagctactgtagttgctactactcaggtgcctagtggaaatccccagcctacaatctctttacagcctttgccagtgattttgcatgtacctgttgcagtatcctcccagcctcagcttctacagagccatccagggactttggtgactaatcaaccatctggcaatgttgaattcatttctgtgcaaagcccacctacagtgagtggtcttaccaaaaatccagtatccttgccatccttgccaaatcccactaaaccaaacaacgttccttctgtgcccagtcctagtattcaaaggaaccctactgccagtgctgcaccattgggaacaacacttgctgtgcaggctgttccaacagcacactctattgtacaagccacaaggacttctttacccacagtgggcccatcaggactctatagtccatcaactaatcgaggtcctatacagatgaaaattccaatttctgcatttagtacttcgtctgctgcagaacagaacagcaataccaccccaagaattgaaaaccagacaaacaaaacaatagatgcttctgtcagtaagaaagcagctgatagcacatcacagtgtggaaaagccactggcagtgattcaagtggtgtcattgatctcacaatggatgatgaagagagtggagcttcacaagaccccaaaaaactaaatcacactcctgtatcaaccatgagttcttctcagcctgtgtcacgaccattgcaacccatacaaccagcaccgcctcttcaaccatctggggtgccaacaagtggaccatctcagaccaccatacacttactacctacagctccaactaccgtgaatgtaacacatcgtccagtaactcaggtgaccacaagactccctgtaccaagagctcctgcaaaccaccaggtggtttatacaactcttcctgcaccaccagctcaggctcccttgcgaggaactgttatgcaggctcctgctgttcggcaggtcaatccccaaaatagtaagagatttttcttgtatatggccccaagatacatgtagttctcttcagcatttagttggaatggcatataataatgttaaattttgcaaaaatttcttataatgtcatattaaaagtattgttataagttcaagagatctgtactacaacatagaaactatagtatagttaaaatcaatgtagtatattcttgaaaatagctgatagagcagattttaagtattgtcaccacacacaaaaaaggtaagtatgtgagatcatgcatatgtcagctagatttagccattctgcagtgtatgcatatttcaaacatgttgtataccataaatatatataatttttgtcaattaaaaaatagttttcaaaaaagaaatggcagtataaccaaaactaatctattattatttttcttcccttaggagagttaaacagagaaaattgttgatgtatactagttgatttgtgctctgagtgttgtctttaatttaactttatttatggcctgtattagtatagtacacaatttgatattggtatattctctactctattaagaaacaccttacctagttagagtgggaatggtcaattgtgatttaccccagatgatggaaatcatggtaaaggatagccttcaatgagagtcttaaagatatggaaagtggctgagaaaagaagggaaaatgttaaagaaagcttgtagtttcttgtatatatcatatattagttacatacatatgttacatgcatgttacatatgtagatgacattttaaaattatatattaaccacatgtatataagcagtagtagaatatatcacataaacacaagcttatataaaaggtatatttaaactttaaagtaaagaaaaataataaaatgaactacgtatgaactcttcatcaggttaagaagtagaaatttttcagtatcctgtaagtggtcttgtattcctgtcttgactacatcccttttcctttccatcaaaggtaaccactgttcctacttttctattagtcattctgcttttctttatgattttgccaccaaaattgatatcatttaaacatactagggttctctagaggacagaactaacaggataaatagatatataaaggggagtttactaagtattaacttacatgatcacaaggtccctcaataggctgtctgcaagctgagcaaggaaagccagactgaatccccaaactgaagaatttggagtccagtgtcgaagggcaggaagcatccagcacaggagaaagatgtaggctggaaggctagccagtctctccatttcatgtttttctgcctgctttgtattcattgacagctgattagattgtgcccaccagattaaaggtggatctgccttctccagcccattttctgcctgctttgtattcattgatagctgattagattgtgcacaccagattaaaggtggatctgccttcccc

SEQ ID NO: 104136 - DNA, 575 bp, Homo sapiens
  Payload ID: 468
  Gene Symbol: ATF7IP
  Gene Name: activating transcription factor 7 interacting protein
  ENST ID: ENST00000542514
  CDS Start-End: 179-575
aaccaaaactaagaaattgatgttagggaggacagactattacaagataaagctgtaattgataaagaagttggcctggtgtggtggctcacacctgtaatcccagcactttgggaggccgaggcaggtggatcacgaggtcagaagatcaagaccatcctggctaacacgattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtg

SEQ ID NO: 104137 - DNA, 574 bp, Homo sapiens
  Payload ID: 468
  Gene Symbol: ATF7IP
  Gene Name: activating transcription factor 7 interacting protein
  ENST ID: ENST00000542991
  CDS Start-End: 398-574
agacctaatagttggcagcatagaaagcagtacaaagaattctgattctaggcattttcactttgaaatagtcattttgaagatatactctgtgtgttctgtgagcttcattgacatattgtctgacgttttttggcttttgtggtaaatgggatgtatgctgcacaaactacccaacagatgtgaaccactatttgaaaggaattttaatatgtagccaacctactgtattcttgttttttttttaatgaatatgaatcaaacaagaaatttagactcgagaaggctgacctagaagtctgcattagcttttaatgtttatacaaatgaactaagtagcagtggtttacagaagaggaagtccttttcacagtgtcaagctgcccacagattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttg

SEQ ID NO: 104138 - DNA, 4142 bp, Homo sapiens
  Payload ID: 468
  Gene Symbol: ATF7IP
  Gene Name: activating transcription factor 7 interacting protein
  Uniprot ID: Q6VMQ6
  ENST ID: ENST00000540793
  CDS Start-End: 156-3968
tagtatacaacaagcagtaggttttctatgtcttaaacattacatgaaatgtgctgcttgcatctcttctaagatcaatttgtattaagtctacaattaggtggcttctgtttcagttattaaactctctttctcttttttcttaaagattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggtgattccacctctggtgatcccacctctagcgagccctcctctagtgatgctgcctctggtgatgcaacctctggtgatgccccttctggtgatgtgtcccctggtgatgccacctctggtgatgccactgctgatgatctctcctctggtgatcccacctctagtgatcccatcccaggtgaaccggtccctgttgaacccatttctggtgattgtgccgctgatgatatagcctctagtgaaataacttctgttgatctggcttctggagcaccagcttccactgatccagcctctgatgatctggcctctggtgatctatcctctagtgaactggcctctgatgatctggccactggtgaactggcctctgatgagctgacttctgaatcaacctttgatcgtacctttgaaccaaagtctgtaccagtttgtgaaccagttcctgaaattgacaatatagaaccaagtagcaataaagatgatgattttcttgaaaaaaatggagctgatgaaaaattagagcaaattcagagtaaagactcattggatgagaaaaataaagctgataataatattgatgctaatgaagaaactctagaaacagatgatacaactatttgttcagatcgacctcctgaaaatgaaaagaaggtagaggaagatattatcacagagcttgctcttggagaagatgctatatctagcagtatggaaattgaccaaggtgaaaagaatgaagatgaaacttctgcagatcttgtagaaacgattaatgaaaatgttattgaagataacaaaagtgagaatatcttagaaaatacagactctatggagacagatgaaatcattcctattttggaaaagcttgcaccttctgaggatgaacttacttgcttttctaaaacatctctccttccaatcgatgagacaaatccagatttggaagagaaaatggaaagttcttttggttcaccatctaaacaagaaagtagtgagagtttgccaaaagaagcctttctggtcctctctgatgaagaggatatttcgggtgaaaaagatgagtctgaagttatatcgcaaaatgaaacgtgctctccagcagaagtagaaagtaatgaaaaggacaacaaacctgaggaagaagagcaagtaatacatgaagatgatgaaagaccttctgagaaaaatgaattttctagacgaaaacgttctaaatcagaagacatggacaatgtacagtctaaacgtcgtcgatatatggaagaagaatatgaggcagaatttcaagtaaagattacagccaaaggagacattaaccagaaacttcaaaaggttatacagtggttgctggaagaaaaattgtgtgcgctgcagtgtgctgtatttgataagactttggcagaattgaaaacacgagtggaaaagattgaatgtaacaagaggcataaaacagttctcactgaactacaggccaagatagccaggttaaccaaacgctttgaagcagccaaagaagatcttaagaaaagacatgaacatccacccaacccaccagtatcaccaggaaaaactgtaaatgatgtcaacagcaataataacatgtcttacagaaatgcaggcacagtgagacagatgctggagtccaaaagaaatgtaagcgagagtgcaccaccatcctttcaaactcctgtgaatacagtatcttcaaccaatcttgtcactcctccagcagttgtcagtagtcaacctaaattgcagactccagtgacttcgggttccctcacagcaacgtcagttcttcctgcacccaatacagctactgtagttgctactactcaggtgcctagtggaaatccccagcctacaatctctttacagcctttgccagtgattttgcatgtacctgttgcagtatcctcccagcctcagcttctacagagccatccagggactttggtgactaatcaaccatctggcaatgttgaattcatttctgtgcaaagcccacctacagtgagtggtcttaccaaaaatccagtatccttgccatccttgccaaatcccactaaaccaaacaacgttccttctgtgcccagtcctagtattcaaaggaaccctactgccagtgctgcaccattgggaacaacacttgctgtgcaggctgttccaacagcacactctattgtacaagccacaaggacttctttacccacagtgggcccatcaggactctatagtccatcaactaatcgaggtcctatacagatgaaaattccaatttctgcatttagtacttcgtctgctgcagaacagaacagcaataccaccccaagaattgaaaaccagacaaacaaaacaatagatgcttctgtcagtaagaaagcagctgatagcacatcacagtgtggaaaagccactggcagtgattcaagtggtgtcattgatctcacaatggatgatgaagagagtggagcttcacaagaccccaaaaaactaaatcacactcctgtatcaaccatgagttcttctcagcctgtgtcacgaccattgcaacccatacaaccagcaccgcctcttcaaccatctggggtgccaacaagtggaccatctcagaccaccatacacttactacctacagctccaactaccgtgaatgtaacacatcgtccagtaactcaggtgaccacaagactccctgtaccaagagctcctgcaaaccaccaggtggtttatacaactcttcctgcaccaccagctcaggctcccttgcgaggaactgttatgcaggctcctgctgttcggcaggtcaatccccaaaatagtgttacagttcgagtgcctcaaacaaccacatatgttgtaaacaatggactaaccctgggatcaacaggacctcagctcacagtgcatcaccgaccaccacaagtgcatactgagcccccacgccccgtgcacccagcacccttaccagaagctccacaaccacagcgtctgcccccagaagctgccagcacatctctgcctcagaagccacacttgaagttagcacgcgttcagagtcaaaatggcatagtactgtcatggagtgtcctggaggtggatcgaagctgtgccactgttgatagctaccatctctatgcttaccatgaggaacccagtgccactgtgccctcacaatggaaaaagattggggaagtcaaggcacttcccttgcccatggcatgtactctcacccagtttgtatctggtagcaaatactactttgcagtacgagccaaggatatttatggacgttttgggcctttctgtgatcctcagtcaacagatgtgatctcttctacccagagcagttaaaccttggagcctttatattttcctcttttaaaatttccaccttttggtcttgtttttaatcttgtgcatgataccccatgtaaaatccaccttgtgcaagatttcttggacagatgtgtgtatacactacatttgtttataaccagaagcaaaataaactcagcccacaaagct

SEQ ID NO: 104139 - DNA, 577 bp, Homo sapiens
  Payload ID: 468
  Gene Symbol: ATF7IP
  Gene Name: activating transcription factor 7 interacting protein
  ENST ID: ENST00000545723
  CDS Start-End: 148-577
gcggaggcggcggcggtggcagcggcggcgcggcgactgaagcgcgcgaaaagctgaggcggcaacgtcggggacggctgcgcgggacggctctgtaggaaggaacttggttccccctccctcagcttccgccccaaaagattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatttcaagtaaagattacagccaaaggagacattaaccagaaacttcaaaaggttatacagtggttgctggaagaaaaattgtgtgcgctgcagtgtgctgtatttgataagactttggcagaattgaaaacacgagtggaaaagattgaatgtaacaagaggcataaaa

SEQ ID NO: 104140 - DNA, 564 bp, Homo sapiens
  Payload ID: 468
  Gene Symbol: ATF7IP
  Gene Name: activating transcription factor 7 interacting protein
  ENST ID: ENST00000542967
  CDS Start-End: 37-564
aatgacgtcacatatgagatagaatggagattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggtgattccacctctggtgatcccacctctagcgagccctcctctagtgatgctgcctctggtgatgcaacctct

SEQ ID NO: 104141 - DNA, 572 bp, Homo sapiens
  Payload ID: 468
  Gene Symbol: ATF7IP
  Gene Name: activating transcription factor 7 interacting protein
  ENST ID: ENST00000535132
  CDS Start-End: 264-572
tttctcaagagaatatttgacctgatgtaattcttggatctctgaggtcttctacacagaagtatatttagagagcacctcattatgttgcccaggctggtcttgaactccaggggtcaagagagtttcccacttcagcctcccaaagtgctgagattacaagcatgagccaccatgtccagcctgtactgcctttcctttttcctttatgatttctacagcacttgtctgcccagaaaatattacctgttgtaagattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcag

SEQ ID NO: 104142 - DNA, 8774 bp, Homo sapiens
  Payload ID: 468
  Gene Symbol: ATF7IP
  Gene Name: activating transcription factor 7 interacting protein
  Uniprot ID: Q6VMQ6
  ENST ID: ENST00000536444
  CDS Start-End: 107-3916
gcgcgcgaaaagctgaggcggcaacgtcggggacggctgcgcgggacggctctgtaggaaggaacttggttccccctccctcagcttccgccccaaaagattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggtgattccacctctggtgatcccacctctagcgagccctcctctagtgatgctgcctctggtgatgcaacctctggtgatgccccttctggtgatgtgtcccctggtgatgccacctctggtgatgccactgctgatgatctctcctctggtgatcccacctctagtgatcccatcccaggtgaaccggtccctgttgaacccatttctggtgattgtgccgctgatgatatagcctctagtgaaataacttctgttgatctggcttctggagcaccagcttccactgatccagcctctgatgatctggcctctggtgatctatcctctagtgaactggcctctgatgatctggccactggtgaactggcctctgatgagctgacttctgaatcaacctttgatcgtacctttgaaccaaagtctgtaccagtttgtgaaccagttcctgaaattgacaatatagaaccaagtagcaataaagatgatgattttcttgaaaaaaatggagctgatgaaaaattagagcaaattcagagtaaagactcattggatgagaaaaataaagctgataataatattgatgctaatgaagaaactctagaaacagatgatacaactatttgttcagatcgacctcctgaaaatgaaaagaaggtagaggaagatattatcacagagcttgctcttggagaagatgctatatctagcagtatggaaattgaccaaggtgaaaagaatgaagatgaaacttctgcagatcttgtagaaacgattaatgaaaatgttattgaagataacaaaagtgagaatatcttagaaaatacagactctatggagacagatgaaatcattcctattttggaaaagcttgcaccttctgaggatgaacttacttgcttttctaaaacatctctccttccaatcgatgagacaaatccagatttggaagagaaaatggaaagttcttttggttcaccatctaaacaagaaagtagtgagagtttgccaaaagaagcctttctggtcctctctgatgaagaggatatttcgggtgaaaaagatgagtctgaagttatatcgcaaaatgaaacgtgctctccagaagtagaaagtaatgaaaaggacaacaaacctgaggaagaagagcaagtaatacatgaagatgatgaaagaccttctgagaaaaatgaattttctagacgaaaacgttctaaatcagaagacatggacaatgtacagtctaaacgtcgtcgatatatggaagaagaatatgaggcagaatttcaagtaaagattacagccaaaggagacattaaccagaaacttcaaaaggttatacagtggttgctggaagaaaaattgtgtgcgctgcagtgtgctgtatttgataagactttggcagaattgaaaacacgagtggaaaagattgaatgtaacaagaggcataaaacagttctcactgaactacaggccaagatagccaggttaaccaaacgctttgaagcagccaaagaagatcttaagaaaagacatgaacatccacccaacccaccagtatcaccaggaaaaactgtaaatgatgtcaacagcaataataacatgtcttacagaaatgcaggcacagtgagacagatgctggagtccaaaagaaatgtaagcgagagtgcaccaccatcctttcaaactcctgtgaatacagtatcttcaaccaatcttgtcactcctccagcagttgtcagtagtcaacctaaattgcagactccagtgacttcgggttccctcacagcaacgtcagttcttcctgcacccaatacagctactgtagttgctactactcaggtgcctagtggaaatccccagcctacaatctctttacagcctttgccagtgattttgcatgtacctgttgcagtatcctcccagcctcagcttctacagagccatccagggactttggtgactaatcaaccatctggcaatgttgaattcatttctgtgcaaagcccacctacagtgagtggtcttaccaaaaatccagtatccttgccatccttgccaaatcccactaaaccaaacaacgttccttctgtgcccagtcctagtattcaaaggaaccctactgccagtgctgcaccattgggaacaacacttgctgtgcaggctgttccaacagcacactctattgtacaagccacaaggacttctttacccacagtgggcccatcaggactctatagtccatcaactaatcgaggtcctatacagatgaaaattccaatttctgcatttagtacttcgtctgctgcagaacagaacagcaataccaccccaagaattgaaaaccagacaaacaaaacaatagatgcttctgtcagtaagaaagcagctgatagcacatcacagtgtggaaaagccactggcagtgattcaagtggtgtcattgatctcacaatggatgatgaagagagtggagcttcacaagaccccaaaaaactaaatcacactcctgtatcaaccatgagttcttctcagcctgtgtcacgaccattgcaacccatacaaccagcaccgcctcttcaaccatctggggtgccaacaagtggaccatctcagaccaccatacacttactacctacagctccaactaccgtgaatgtaacacatcgtccagtaactcaggtgaccacaagactccctgtaccaagagctcctgcaaaccaccaggtggtttatacaactcttcctgcaccaccagctcaggctcccttgcgaggaactgttatgcaggctcctgctgttcggcaggtcaatccccaaaatagtgttacagttcgagtgcctcaaacaaccacatatgttgtaaacaatggactaaccctgggatcaacaggacctcagctcacagtgcatcaccgaccaccacaagtgcatactgagcccccacgccccgtgcacccagcacccttaccagaagctccacaaccacagcgtctgcccccagaagctgccagcacatctctgcctcagaagccacacttgaagttagcacgcgttcagagtcaaaatggcatagtactgtcatggagtgtcctggaggtggatcgaagctgtgccactgttgatagctaccatctctatgcttaccatgaggaacccagtgccactgtgccctcacaatggaaaaagattggggaagtcaaggcacttcccttgcccatggcatgtactctcacccagtttgtatctggtagcaaatactactttgcagtacgagccaaggatatttatggacgttttgggcctttctgtgatcctcagtcaacagatgtgatctcttctacccagagcagttaaaccttggagcctttatattttcctcttttaaaatttccaccttttggtcttgtttttaatcttgtgcatgataccccatgtaaaatccaccttgtgcaagatttcttggacagatgtgtgtatacactacatttgtttataaccagaagcaaaataaactcagcccacaaagctagaatcttttcctggacagtttaggctttggggtttggaaatgtaaatgtgtaccttgctttagttttgaggctggggaatatgtgtgggtgtttatgtgtgtttttccttatgtaggtgttattgcattggagtctcccattttcattctcaaatttacctcttaaagtacgaagtaagtagatcaaaggatttgagatgtgtaactggcatgattctgcttttgaaggatctatagtatcattttagttaagtgggtcaaacagaatcaaaacaaaacccaaagaaataaataaaaaacaaaatggctaaatagtttaaaataggttaattcgaacacaggaaaggatctatttgttgtttcttttgtctggtctcctgagttgttaattaggtgaaaaaagatctgcaatggccccctccctttcctaatctggcttttacatttattttgtgccttaaagattaactacaaagataaacatggccaaaaataaataaataaatatggccatatgtccgttgttgcttagtcttcccttgcagccttttacccttgatttctccttcatctctaccaaatatagcacaactcctcaagtaattttttttttttaagatggagttttgctcttgttgcccaggctagagtgcggtggcacaatcttggctcactgcaacctctgcctcctgggttcaagcaattcttctgtctcagccccagagtagctgggattacaggcacctgtcaccatgcccggctaatttttgtatttttagtagagatggggtttcaccatgttggccaggctggtcttgaactcctgacctcaggtgatccacccgcctcggcctcccagagtgctgcgattacagttgtgagccactgtatccagcctactcaagtgatttttaaaccaaggtgtgtgtatgtacatggatgtgtatgtacacacacacacaggtgcatgcatagtctcatcttagccgggcatggtggcgacaatcacatttaactccaaaaatttgacgtgctattttcttctaaaactatagatgcttttatttttggtcactatttaactttgtgtaaagtggaccaagagaaaaccatattgtggaagacagtttttcacacattttagtatccgtgttgcacactgtgttagagattatgaaaaccattctagttcagtttatcacccaaagctatcacccaacactaactccttagtattctttcaaaggaagcaaatagtaagattacaatatagaatgagctaaaatatcaaggggaaagcttcatttcctctttattctctttatcgtccttcccattttaaccttttaactttgttttgatggtgccaagttgagtctgatgtacccattgttagctttggatagaatttaaagtatatcccagaattagctgggcatgttggtgcatgcctgtaatcccagctactcaggaggcaaggctggagaatcgcttgaacccgggaggcggaggttgcagtgagctgagattgcgccattgcactccatcctgggagacaagagcgaaactctgcctcaaaaaaaaaagaatttaaagtatatcctttgaggtcattttatgtaacaattagatataacctcctgtgtatctctctgttcctcttcaaagttattaaaattcagcttaggtcatggatttttaatatgagggccagctgtactggtgtcaggtaggtgttttgggtgtagataatttaggactggagggctgagttaagttttaggaggagaatgtggttgagaatattttgaaaggaatttatggagtttgtgaaataacttcgaagtcctcttcctttacaatatttgaattcatatttgtaccttctcaaaatagtgattcatttttcctagaattacaggagggagctcttttactaatgttgttttgtttgcaactttgatggcttataataggaagtattctagttgtaaagaaaactctttagagacttttgactggtcagtatactgaggtgtgagatttgattcatgatgaagaaagcctatagattgccaaaaaattaattctccaaaccacctttcactctcagaaaatgagaccacaaaggagtatgctataaatcaaatttgccaaccaattatgtagatattactcattctaggactaatgatgatggtaaagaagttgccagtgttatggcaatgaaaatttcagaaaggaggagttgatgatcttctagatgtatatgaacacctgtctatatctgcatgtatatgttttgacctgcagtggttgcaatgttgatatgtgttcaagattattcctgtctacaaaactgaaggcccatgttcaaattgttctttattgggtgtttttatggtcacgtggtaacaattttcttacctaacctacaaaaggttctcttgatgaacatttttatttatatttactaatcttttttaaaaaaagctttcatagcattatataatcagatgaagaaagcccagtagaataaaaaaaaaattcattagcctagcctatattatgttttctgtcaaaggaaaacaaattctcaaataggaattctaaaaatatttactaaagtaaaataactacttaaaatgttttattccagttggaaggaaggtacagggagaaatcgcaattatttaggggagaagtatatttattataagatggtgtcctcaaattagcctaccatggcacgtaggggcagcagctatattagatttactagaggtgctaagttagaacactaggcttttattgaggcaggttttaatattgatagatgctttttgtttggtttgtttcttctgggagagaatggaggacttaagtagaagtagctactgataacagactttctagtagcagtttccactccacggttacctttttagtttcatagtatcttttcacaaagtattacaaataagctagattctcccagtttgggaatgcaagtttgctacatttttagcctggcaatatttgtgtaggtattgccttattggaaattctggaaacctgatactgcaacctgcaatgtaggatgtttgtatggcatttaaaggtaatggtgatgtttattattctatactttgcattctgtgagagtaattttcactctgtcttaagtgtgagtaagcctcttctaaaaatcttgttcttgccaagaaatttataaatcacatacgaagacgtctgttgctaacagttaactttatgaggtaactatatccttctatttctctggactcatttttaaaaaatatgccgaatactgcatactgtttaaggtagtatataagtttatgagagaagtggagagctttcttccttgaaaagtcggtatttgttgagataccatttgcctcacagagaggtgttccccactcccatccccattgccagataataaatattttgagaaaagtgacctaaaacagctgaaatcttaggtgcatctgtctgcagacctccttaagcaggctgtatcttacaattcccttactgcactgggtaagtgttaacttagtttttgttgtttgctcttttgctttaaatattctccaaattaccatttatgcaacatggttagggttaatactgcatggtattcatttatcttgtttcatgaactttccagtactgtacaaggtcaacaaagtaatgcctgtggtatcctcatctctcacttttttactctgtgattttagcacagtaaggtactgcaaagaccttccttccaaatgttctccttgactttatttcttgggccaattcagtatcctcaacatcctaagattttgttgttttatcactgacctgtggttggcctgttttattctaatttccagaaaagtcaagtcccagtatttgcaatatcaaataactctaaaaccgatgtgtgattctaccttccttactatttttactgggcaaatgccctatttttttaattattattatttttaacttttgggacacacaaaaatcagcaattctcatgaagcgtttgttagtgtggcagacttgtctaattcctgaaactcattcatccccttgagccagccaatggggaggaataggataatgcaaacacatgttttgttttctcattttcaaataatttaccatgttaaaataaacttttctttgttttttatttgtagagtcagctaagtacccatatttaaatgccgtctttattatttttttgaggtctttgtttttgtctgtttttgttttgttttgttttgtaaataaggtaactgggcaatcaaacaccttttggggattctggctttagtattttatcagccattttaaaattaaatataaaaatcctttgtaagaaacttgcatcctaatttttctttattgcaattgaaagtgtaaataataagacaatgtaagtaagaccttcctaatgtctaatacaaactgggctccagcaagtggccctatttttattagggttttgaaggtttgtgtgtgtgtgtgcgtgcgtgtgtgtgtttttcttttttaaatgtatagtagagtggtgtctgtataagtgttacctgtagtggggttttgtccagcaagcctgaaatttatactttgaaataaaactactgggtttttaac

SEQ ID NO: 104143 - DNA, 568 bp, Homo sapiens
  Payload ID: 468
  Gene Symbol: ATF7IP
  Gene Name: activating transcription factor 7 interacting protein
  ENST ID: ENST00000545769
  CDS Start-End: 63-568
atttagttctcatggcaacctttgtgacaggtgttggtattagtccctttttaagattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggtgattccacctctggtgatcccacctctagcgagccctcctctagtgatgc

SEQ ID NO: 104144 - DNA, 3396 bp, Homo sapiens
  Payload ID: 469
  Gene Symbol: ATF7IP2
  Gene Name: activating transcription factor 7 interacting protein 2
  Uniprot ID: Q5U623
  ENST ID: ENST00000324570
  CDS Start-End: 27-1658
atgtcttaaattccaggatatgaaagatggcaagtccagatagaagtaaacggaagatattaaaagccaaaaagacaatgcccctaagttgccggaagcaagtagagatgctgaataagtcaaggaatgttgaagcgctgaaaacagcaattgggagtaatgttccaagcggtaatcagagtttcagtcctagtgtcataactaggacgactgaaataaccaaatgtagcccttctgaaaatggtgcatcctcattggactctaataaaaattcaatatcagagaaaagtaaagtattctctcagaattgcataaaaccagtagaagaaattgttcattcagaaacaaaattggaacaagttgtttgttcgtaccaaaagccaagtagaacaacagaatcccccagcagagtcttcacagaagaggcaaaagattcactgaacacttctgaaaacgattctgagcatcagacaaatgtaacaagatccctttttgagcatgagggggcttgtagtctaaagtccagttgctgtccacccagtgtattgagtggtgttgttcagatgccagagtctacagtaaccagtaccgtgggtgacaagaaaactgaccagatggttttccatttagaaacaaactccaattcagaatcacatgataaaaggcaaagtgacaacattttatgttcagaagactcaggttttgtgcctgttgagaaaacacctaatttggtgaattcagtcacttctaacaactgtgctgatgacattttgaaaactgatgagtgtagtagaaccagtatttcaaattgtgaaagtgcagactcaacatggcagtcatcacttgacactaataacaacagccattatcaaaagaagaggatgttttcagaaaacgaggaaaatgttaaacgcatgaaaacttcagagcaaattaatgaaaatatttgtgtaagtttggaaaggcaaacagcattcctggaacaggtcagacatttgattcagcaggagatctatagcataaattatgaactatttgataagaaactgaaagaattgaaccaacgcattgggaagacagagtgcagaaataagcatgaaggaatagctgataaacttttggcaaaaatagcaaaacttcaaagacgtattaaaacagtattattatttcaaaggaattgtttgaaaccaaacatgttatccagtaatggagcctctaaggttgcaaattcagaggctatgattttggataagaatcttgagtcagttaatagtccaattgaaaagtcttctgtgaattatgagccttctaacccttccgaaaaaggaagtaaaaaaattaatttgtcatcagatcaaaataagtctgtttctgaaagtaacaatgatgatgttatgttgatttctgtggaaagtcctaatttgacaactccaattacatcaaatccaacagataccagaaaaattacatcaggaaattctagcaattctcccaatgctgaagttatgaaagtccagtatcccccctggagtcacattcgaaagctgcttcaaactcaaaggaaacaaccccattggcacaaaatgcagtccaggttcctgagtcctttgagcacctgccacctctcccagaaccaccagcaccactacctgaattagtagacaaaacccgagacacacttcctccccagaagcctgagctcaaagtgaaacgggttttcagacccaatggcattgccctgacttggaatataaccaaaatcaatcccaagtgtgctcctgtagaaagctaccacctcttcctgtgtcatgagaactctaataataagttgatttggaagaagattggagaaattaaagctttaccactccccatggcctgtactttatctcagtttttagcttccaacagatactattttactgtccaatcaaaagatatttttggacgatatggaccattctgtgatataaaatctatccctgggttttctgaaaatcttacgtaaaaggtgtttaataatgatatactactttttttttcatatttgtttgtttgcaatgttactgtaatactatttgccattgtaaaaggccagctcagattgtgagccctttctattgggacagtcctcttctatatgttttaagtggccagtaatttaatgaatttctggtttgtattaaatatgtccttccaatggataagttctaaaacatacgctatcattggcccatgttgctgaggtgcattgtgaacaatacctttagtgactgtggaactgctgcttctatcagaagacctaggatacaagcagccactgtttcctccgttaacaatcagcttttagtaacctgctgtggtcagcatagctacaggaaaagtcagcccttgactgagggccagatcatccctggagtgcacctctactaagattttatgaaaagatgacatgttgggctgcatgataaaagttaattataaaaattaaaagatttttttttttgagatggaatattgctctgttgcccaggctggagtacagtggtcactgcaacctccatctccctggttcaagcaattctcctatgtcagcctcccaagtagctgggactatagtcacttgccaccatgcccggctaatttatttttagtagagatgaggtttcaccttgttggtcaggctggtctcaaactcctgacctcaggggatccacccgcctcggcctcccgaagtgctgggattataggcgtaagccaccatgcctggccaaaaattaaaagattttatgaaacgaaatggcttcccattctttctattcagcttctaagtgggctattcatttgtgctctcctcttttttgttttgttttgcactttgtcaatcatttggggaaatagcctggaggtctttcctgaatctgtttgtagacataataaaatttgtgtgctgtgtacacaaaaacataatgtatcttatgaaagcattacccaacctgtttgagttgagaatgcatttgtccacctttgatttgaggctttagtttgctgatttcctaaatgctaccctttgatcatttcctggccaccatcacaatactaaggggctcagatgtgtcttgtgcccacctcttcctgagaagagatggaagtggagctgtgactagtacaagcagcccaagaaactctgaacggggcccaatggaggcaaacttgagcaaataattgggatgataagaaacaaaaataatcccaactgtttgaaagttcgaaagaggggcattcttttctggtacatggtgagagttcaggctccagagactcaaaacggaatggttttccttggcattttgtaaatgctctcacatctgtagcaataaagctgttattttctgc

SEQ ID NO: 104145 - DNA, 3463 bp, Homo sapiens
  Payload ID: 469
  Gene Symbol: ATF7IP2
  Gene Name: activating transcription factor 7 interacting protein 2
  Uniprot ID: Q5U623
  ENST ID: ENST00000356427
  CDS Start-End: 27-2075
atgtcttaaattccaggatatgaaagatggcaagtccagatagaagtaaacggaagatattaaaagccaaaaagacaatgcccctaagttgccggaagcaagtagagatgctgaataagtcaaggaatgttgaagcgctgaaaacagcaattgggagtaatgttccaagcggtaatcagagtttcagtcctagtgtcataactaggacgactgaaataaccaaatgtagcccttctgaaaatggtgcatcctcattggactctaataaaaattcaatatcagagaaaagtaaagtattctctcagaattgcataaaaccagtagaagaaattgttcattcagaaacaaaattggaacaagttgtttgttcgtaccaaaagccaagtagaacaacagaatcccccagcagagtcttcacagaagaggcaaaagattcactgaacacttctgaaaacgattctgagcatcagacaaatgtaacaagatccctttttgagcatgagggggcttgtagtctaaagtccagttgctgtccacccagtgtattgagtggtgttgttcagatgccagagtctacagtaaccagtaccgtgggtgacaagaaaactgaccagatggttttccatttagaaacaaactccaattcagaatcacatgataaaaggcaaagtgacaacattttatgttcagaagactcaggttttgtgcctgttgagaaaacacctaatttggtgaattcagtcacttctaacaactgtgctgatgacattttgaaaactgatgagtgtagtagaaccagtatttcaaattgtgaaagtgcagactcaacatggcagtcatcacttgacactaataacaacagccattatcaaaagaagaggatgttttcagaaaacgaggaaaatgttaaacgcatgaaaacttcagagcaaattaatgaaaatatttgtgtaagtttggaaaggcaaacagcattcctggaacaggtcagacatttgattcagcaggagatctatagcataaattatgaactatttgataagaaactgaaagaattgaaccaacgcattgggaagacagagtgcagaaataagcatgaaggaatagctgataaacttttggcaaaaatagcaaaacttcaaagacgtattaaaacagtattattatttcaaaggaattgtttgaaaccaaacatgttatccagtaatggagcctctaaggttgcaaattcagaggctatgattttggataagaatcttgagtcagttaatagtccaattgaaaagtcttctgtgaattatgagccttctaacccttccgaaaaaggaagtaaaaaaattaatttgtcatcagatcaaaataagtctgtttctgaaagtaacaatgatgatgttatgttgatttctgtggaaagtcctaatttgacaactccaattacatcaaatccaacagataccagaaaaattacatcaggaaattctagcaattctcccaatgctgaagttatggctgtacagaagaaacttgattctataattgatttgacaaaagaaggcctatccaactgcaatacagaaagtccagtatcccccctggagtcacattcgaaagctgcttcaaactcaaaggaaacaaccccattggcacaaaatgcagtccaggttcctgagtcctttgagcacctgccacctctcccagaaccaccagcaccactacctgaattagtagacaaaacccgagacacacttcctccccagaagcctgagctcaaagtgaaacgggttttcagacccaatggcattgccctgacttggaatataaccaaaatcaatcccaagtgtgctcctgtagaaagctaccacctcttcctgtgtcatgagaactctaataataagttgatttggaagaagattggagaaattaaagctttaccactccccatggcctgtactttatctcagtttttagcttccaacagatactattttactgtccaatcaaaagatatttttggacgatatggaccattctgtgatataaaatctatccctgggttttctgaaaatcttacgtaaaaggtgtttaataatgatatactactttttttttcatatttgtttgtttgcaatgttactgtaatactatttgccattgtaaaaggccagctcagattgtgagccctttctattgggacagtcctcttctatatgttttaagtggccagtaatttaatgaatttctggtttgtattaaatatgtccttccaatggataagttctaaaacatacgctatcattggcccatgttgctgaggtgcattgtgaacaatacctttagtgactgtggaactgctgcttctatcagaagacctaggatacaagcagccactgtttcctccgttaacaatcagcttttagtaacctgctgtggtcagcatagctacaggaaaagtcagcccttgactgagggccagatcatccctggagtgcacctctactaagattttatgaaaagatgacatgttgggctgcatgataaaagttaattataaaaattaaaagatttttttttttgagatggaatattgctctgttgcccaggctggagtacagtggtcactgcaacctccatctccctggttcaagcaattctcctatgtcagcctcccaagtagctgggactatagtcacttgccaccatgcccggctaatttatttttagtagagatgaggtttcaccttgttggtcaggctggtctcaaactcctgacctcaggggatccacccgcctcggcctcccgaagtgctgggattataggcgtaagccaccatgcctggccaaaaattaaaagattttatgaaacgaaatggcttcccattctttctattcagcttctaagtgggctattcatttgtgctctcctcttttttgttttgttttgcactttgtcaatcatttggggaaatagcctggaggtctttcctgaatctgtttgtagacataataaaatttgtgtgctgtgtacacaaaaacataatgtatcttatgaaagcattacccaacctgtttgagttgagaatgcatttgtccacctttgatttgaggctttagtttgctgatttcctaaatgctaccctttgatcatttcctggccaccatcacaatactaaggggctcagatgtgtcttgtgcccacctcttcctgagaagagatggaagtggagctgtgactagtacaagcagcccaagaaactctgaacggggcccaatggaggcaaacttgagcaaataattgggatgataagaaacaaaaataatcccaactgtttgaaagttcgaaagaggggcattcttttctggtacatggtgagagttcaggctccagagactcaaaacggaatggttttccttggcattttgtaaatgctctcacatctgtagcaataaagctgttattttctgc

SEQ ID NO: 104146 - DNA, 3641 bp, Homo sapiens
  Payload ID: 469
  Gene Symbol: ATF7IP2
  Gene Name: activating transcription factor 7 interacting protein 2
  Uniprot ID: Q5U623
  ENST ID: ENST00000396559
  CDS Start-End: 271-1902
agcattgttaacggctgcggttcgaagtggctgtgggtattgctgcggctggtgcgtcgtcgctctaggttttcttccgccgtctgtgacagcttcttgatctgtccccaggaatcctgctttttttttttctttgagacacggtctcactctgtcacccttgctggagtgcagtggtgcaatcacagatcacggcagtgtctaattcctgggctcaagtgaaccttttgcatcagcctcctgaatagctgagaccacaggatatgaaagatggcaagtccagatagaagtaaacggaagatattaaaagccaaaaagacaatgcccctaagttgccggaagcaagtagagatgctgaataagtcaaggaatgttgaagcgctgaaaacagcaattgggagtaatgttccaagcggtaatcagagtttcagtcctagtgtcataactaggacgactgaaataaccaaatgtagcccttctgaaaatggtgcatcctcattggactctaataaaaattcaatatcagagaaaagtaaagtattctctcagaattgcataaaaccagtagaagaaattgttcattcagaaacaaaattggaacaagttgtttgttcgtaccaaaagccaagtagaacaacagaatcccccagcagagtcttcacagaagaggcaaaagattcactgaacacttctgaaaacgattctgagcatcagacaaatgtaacaagatccctttttgagcatgagggggcttgtagtctaaagtccagttgctgtccacccagtgtattgagtggtgttgttcagatgccagagtctacagtaaccagtaccgtgggtgacaagaaaactgaccagatggttttccatttagaaacaaactccaattcagaatcacatgataaaaggcaaagtgacaacattttatgttcagaagactcaggttttgtgcctgttgagaaaacacctaatttggtgaattcagtcacttctaacaactgtgctgatgacattttgaaaactgatgagtgtagtagaaccagtatttcaaattgtgaaagtgcagactcaacatggcagtcatcacttgacactaataacaacagccattatcaaaagaagaggatgttttcagaaaacgaggaaaatgttaaacgcatgaaaacttcagagcaaattaatgaaaatatttgtgtaagtttggaaaggcaaacagcattcctggaacaggtcagacatttgattcagcaggagatctatagcataaattatgaactatttgataagaaactgaaagaattgaaccaacgcattgggaagacagagtgcagaaataagcatgaaggaatagctgataaacttttggcaaaaatagcaaaacttcaaagacgtattaaaacagtattattatttcaaaggaattgtttgaaaccaaacatgttatccagtaatggagcctctaaggttgcaaattcagaggctatgattttggataagaatcttgagtcagttaatagtccaattgaaaagtcttctgtgaattatgagccttctaacccttccgaaaaaggaagtaaaaaaattaatttgtcatcagatcaaaataagtctgtttctgaaagtaacaatgatgatgttatgttgatttctgtggaaagtcctaatttgacaactccaattacatcaaatccaacagataccagaaaaattacatcaggaaattctagcaattctcccaatgctgaagttatgaaagtccagtatcccccctggagtcacattcgaaagctgcttcaaactcaaaggaaacaaccccattggcacaaaatgcagtccaggttcctgagtcctttgagcacctgccacctctcccagaaccaccagcaccactacctgaattagtagacaaaacccgagacacacttcctccccagaagcctgagctcaaagtgaaacgggttttcagacccaatggcattgccctgacttggaatataaccaaaatcaatcccaagtgtgctcctgtagaaagctaccacctcttcctgtgtcatgagaactctaataataagttgatttggaagaagattggagaaattaaagctttaccactccccatggcctgtactttatctcagtttttagcttccaacagatactattttactgtccaatcaaaagatatttttggacgatatggaccattctgtgatataaaatctatccctgggttttctgaaaatcttacgtaaaaggtgtttaataatgatatactactttttttttcatatttgtttgtttgcaatgttactgtaatactatttgccattgtaaaaggccagctcagattgtgagccctttctattgggacagtcctcttctatatgttttaagtggccagtaatttaatgaatttctggtttgtattaaatatgtccttccaatggataagttctaaaacatacgctatcattggcccatgttgctgaggtgcattgtgaacaatacctttagtgactgtggaactgctgcttctatcagaagacctaggatacaagcagccactgtttcctccgttaacaatcagcttttagtaacctgctgtggtcagcatagctacaggaaaagtcagcccttgactgagggccagatcatccctggagtgcacctctactaagattttatgaaaagatgacatgttgggctgcatgataaaagttaattataaaaattaaaagatttttttttttgagatggaatattgctctgttgcccaggctggagtacagtggtcactgcaacctccatctccctggttcaagcaattctcctatgtcagcctcccaagtagctgggactatagtcacttgccaccatgcccggctaatttatttttagtagagatgaggtttcaccttgttggtcaggctggtctcaaactcctgacctcaggggatccacccgcctcggcctcccgaagtgctgggattataggcgtaagccaccatgcctggccaaaaattaaaagattttatgaaacgaaatggcttcccattctttctattcagcttctaagtgggctattcatttgtgctctcctcttttttgttttgttttgcactttgtcaatcatttggggaaatagcctggaggtctttcctgaatctgtttgtagacataataaaatttgtgtgctgtgtacacaaaaacataatgtatcttatgaaagcattacccaacctgtttgagttgagaatgcatttgtccacctttgatttgaggctttagtttgctgatttcctaaatgctaccctttgatcatttcctggccaccatcacaatactaaggggctcagatgtgtcttgtgcccacctcttcctgagaagagatggaagtggagctgtgactagtacaagcagcccaagaaactctgaacggggcccaatggaggcaaacttgagcaaataattgggatgataagaaacaaaaataatcccaactgtttgaaagttcgaaagaggggcattcttttctggtacatggtgagagttcaggctccagagactcaaaacggaatggttttccttggcattttgtaaatgctctcacatctgtagcaataaagctgttattttctgca

SEQ ID NO: 104147 - DNA, 3665 bp, Homo sapiens
  Payload ID: 469
  Gene Symbol: ATF7IP2
  Gene Name: activating transcription factor 7 interacting protein 2
  Uniprot ID: Q5U623
  ENST ID: ENST00000396560
  CDS Start-End: 228-2276
agcattgttaacggctgcggttcgaagtggctgtgggtattgctgcggctggtgcgtcgtcgctctaggaatcctgctttttttttttctttgagacacggtctcactctgtcacccttgctggagtgcagtggtgcaatcacagatcacggcagtgtctaattcctgggctcaagtgaaccttttgcatcagcctcctgaatagctgagaccacaggatatgaaagatggcaagtccagatagaagtaaacggaagatattaaaagccaaaaagacaatgcccctaagttgccggaagcaagtagagatgctgaataagtcaaggaatgttgaagcgctgaaaacagcaattgggagtaatgttccaagcggtaatcagagtttcagtcctagtgtcataactaggacgactgaaataaccaaatgtagcccttctgaaaatggtgcatcctcattggactctaataaaaattcaatatcagagaaaagtaaagtattctctcagaattgcataaaaccagtagaagaaattgttcattcagaaacaaaattggaacaagttgtttgttcgtaccaaaagccaagtagaacaacagaatcccccagcagagtcttcacagaagaggcaaaagattcactgaacacttctgaaaacgattctgagcatcagacaaatgtaacaagatccctttttgagcatgagggggcttgtagtctaaagtccagttgctgtccacccagtgtattgagtggtgttgttcagatgccagagtctacagtaaccagtaccgtgggtgacaagaaaactgaccagatggttttccatttagaaacaaactccaattcagaatcacatgataaaaggcaaagtgacaacattttatgttcagaagactcaggttttgtgcctgttgagaaaacacctaatttggtgaattcagtcacttctaacaactgtgctgatgacattttgaaaactgatgagtgtagtagaaccagtatttcaaattgtgaaagtgcagactcaacatggcagtcatcacttgacactaataacaacagccattatcaaaagaagaggatgttttcagaaaacgaggaaaatgttaaacgcatgaaaacttcagagcaaattaatgaaaatatttgtgtaagtttggaaaggcaaacagcattcctggaacaggtcagacatttgattcagcaggagatctatagcataaattatgaactatttgataagaaactgaaagaattgaaccaacgcattgggaagacagagtgcagaaataagcatgaaggaatagctgataaacttttggcaaaaatagcaaaacttcaaagacgtattaaaacagtattattatttcaaaggaattgtttgaaaccaaacatgttatccagtaatggagcctctaaggttgcaaattcagaggctatgattttggataagaatcttgagtcagttaatagtccaattgaaaagtcttctgtgaattatgagccttctaacccttccgaaaaaggaagtaaaaaaattaatttgtcatcagatcaaaataagtctgtttctgaaagtaacaatgatgatgttatgttgatttctgtggaaagtcctaatttgacaactccaattacatcaaatccaacagataccagaaaaattacatcaggaaattctagcaattctcccaatgctgaagttatggctgtacagaagaaacttgattctataattgatttgacaaaagaaggcctatccaactgcaatacagaaagtccagtatcccccctggagtcacattcgaaagctgcttcaaactcaaaggaaacaaccccattggcacaaaatgcagtccaggttcctgagtcctttgagcacctgccacctctcccagaaccaccagcaccactacctgaattagtagacaaaacccgagacacacttcctccccagaagcctgagctcaaagtgaaacgggttttcagacccaatggcattgccctgacttggaatataaccaaaatcaatcccaagtgtgctcctgtagaaagctaccacctcttcctgtgtcatgagaactctaataataagttgatttggaagaagattggagaaattaaagctttaccactccccatggcctgtactttatctcagtttttagcttccaacagatactattttactgtccaatcaaaagatatttttggacgatatggaccattctgtgatataaaatctatccctgggttttctgaaaatcttacgtaaaaggtgtttaataatgatatactactttttttttcatatttgtttgtttgcaatgttactgtaatactatttgccattgtaaaaggccagctcagattgtgagccctttctattgggacagtcctcttctatatgttttaagtggccagtaatttaatgaatttctggtttgtattaaatatgtccttccaatggataagttctaaaacatacgctatcattggcccatgttgctgaggtgcattgtgaacaatacctttagtgactgtggaactgctgcttctatcagaagacctaggatacaagcagccactgtttcctccgttaacaatcagcttttagtaacctgctgtggtcagcatagctacaggaaaagtcagcccttgactgagggccagatcatccctggagtgcacctctactaagattttatgaaaagatgacatgttgggctgcatgataaaagttaattataaaaattaaaagatttttttttttgagatggaatattgctctgttgcccaggctggagtacagtggtcactgcaacctccatctccctggttcaagcaattctcctatgtcagcctcccaagtagctgggactatagtcacttgccaccatgcccggctaatttatttttagtagagatgaggtttcaccttgttggtcaggctggtctcaaactcctgacctcaggggatccacccgcctcggcctcccgaagtgctgggattataggcgtaagccaccatgcctggccaaaaattaaaagattttatgaaacgaaatggcttcccattctttctattcagcttctaagtgggctattcatttgtgctctcctcttttttgttttgttttgcactttgtcaatcatttggggaaatagcctggaggtctttcctgaatctgtttgtagacataataaaatttgtgtgctgtgtacacaaaaacataatgtatcttatgaaagcattacccaacctgtttgagttgagaatgcatttgtccacctttgatttgaggctttagtttgctgatttcctaaatgctaccctttgatcatttcctggccaccatcacaatactaaggggctcagatgtgtcttgtgcccacctcttcctgagaagagatggaagtggagctgtgactagtacaagcagcccaagaaactctgaacggggcccaatggaggcaaacttgagcaaataattgggatgataagaaacaaaaataatcccaactgtttgaaagttcgaaagaggggcattcttttctggtacatggtgagagttcaggctccagagactcaaaacggaatggttttccttggcattttgtaaatgctctcacatctgtagcaataaagctgttattttctgca

SEQ ID NO: 104148 - DNA, 1907 bp, Homo sapiens
  Payload ID: 469
  Gene Symbol: ATF7IP2
  Gene Name: activating transcription factor 7 interacting protein 2
  ENST ID: ENST00000535850
  CDS Start-End: 222-1499
gttaacggctgcggttcgaagtggctgtgggtattgctgcggctggtgcgtcgtcgctctaggaatcctgctttttttttttctttgagacacggtctcactctgtcacccttgctggagtgcagtggtgcaatcacagatcacggcagtgtctaattcctgggctcaagtgaaccttttgcatcagcctcctgaatagctgagaccacaggatatgaaagatggcaagtccagatagaagtaaacggaagatattaaaagccaaaaagacaatgcccctaagttgccggaagcaagtagagatgctgaataagtcaaggaatgttgaagcgctgaaaacagcaattgggagtaatgttccaagcggtaatcagagtttcagtcctagtgtcataactaggacgactgaaataaccaaatgtagcccttctgaaaatggtgcatcctcattggactctaataaaaattcaatatcagagaaaagtaaagtattctctcagaattgcataaaaccagtagaagaaattgttcattcagaaacaaaattggaacaagttgtttgttcgtaccaaaagccaagtagaacaacagaatcccccagcagagtcttcacagaagaggcaaaagattcactgaacacttctgaaaacgattctgagcatcagacaaatgtaacaagatccctttttgagcatgagggggcttgtagtctaaagtccagttgctgtccacccagtgtattgagtggtgttgttcagatgccagagtctacagtaaccagtaccgtgggtgacaagaaaactgaccagatggttttccatttagaaacaaactccaattcagaatcacatgataaaaggcaaagtgacaacattttatgttcagaagactcaggttttgtgcctgttgagaaaacacctaatttggtgaattcagtcacttctaacaactgtgctgatgacattttgaaaactgatgagtgtagtagaaccagtatttcaaattgtgaaagtgcagactcaacatggcagtcatcacttgacactaataacaacagccattatcaaaagaagaggatgttttcagaaaacgaggaaaatgttaaacgcatgaaaacttcagagcaaattaatgaaaatatttgtgtaagtttggaaaggcaaacagcattcctggaacaggtcagacatttgattcagcaggagatctatagcataaattatgaactatttgataagaaactgaaagaattgaaccaacgcattgggaagacagagtgcagaaataagcatgaaggaatagctgataaacttttggcaaaaatagcaaaacttcaaagacgtattaaaacagtattattatttcaaaggaattgtttgaaaccaaacatgttatccagtaatggagcctctaagataccagaaaaattacatcaggaaattctagcaattctcccaatgctgaagttatggctgtacagaagaaacttgattctataattgatttgacaaaagaaggcctatccaactgcaatacagaaagtccagtatcccccctggagtcacattcgaaagctgcttcaaactcaaaggaaacaaccccattggcacaaaatgcagtccaggttcctgagtcctttgagcacctgccacctctcccagaaccaccagcaccactacctgaattagtagacaaaacccgagacacacttcctccccagaagcctgagctcaaagtgaaacgggttttcagacccaatggcattgccctgacttggaatataaccaaaatcaatcccaagtgtgctcctgtagaaagctaccacctcttcctgtgtcatgagaactctaataataagttgatttggaagaagattggagaaattaaagctttaccactccccatgg

SEQ ID NO: 104149 - DNA, 998 bp, Homo sapiens
  Payload ID: 469
  Gene Symbol: ATF7IP2
  Gene Name: activating transcription factor 7 interacting protein 2
  ENST ID: ENST00000543967
  CDS Start-End: 81-761
ttgttaacggctgcggttcgaagtggctgtgggtattgctgcggctggtgcgtcgtcgctctagtaacaatgatgatgttatgttgatttctgtggaaagtcctaatttgacaactccaattacatcaaatccaacagataccagaaaaattacatcaggaaattctagcaattctcccaatgctgaagttatggctgtacagaagaaacttgattctataattgatttgacaaaagaaggcctatccaactgcaatacagaaagtccagtatcccccctggagtcacattcgaaagctgcttcaaactcaaaggaaacaaccccattggcacaaaatgcagtccaggttcctgagtcctttgagcacctgccacctctcccagaaccaccagcaccactacctgaattagtagacaaaacccgagacacacttcctccccagaagcctgagctcaaagtgaaacgggttttcagacccaatggcattgccctgacttggaatataaccaaaatcaatcccaagtgtgctcctgtagaaagctaccacctcttcctgtgtcatgagaactctaataataagttgatttggaagaagattggagaaattaaagctttaccactccccatggcctgtactttatctcagtttttagcttccaacagatactattttactgtccaatcaaaagatatttttggacgatatggaccattctgtgatataaaatctatccctgggttttctgaaaatcttacgtaaaaggtgtttaataatgatatactactttttttttcatatttgtttgtttgcaatgttactgtaatactatttgccattgtaaaaggccagctcagattgtgagccctttctattgggacagtcctcttctatatgttttaagtggccagtaatttaatgaatttctggtttgtattaaatatgtccttccaatggataagttctaaaacatacgctatcattggcccatgttgctga

SEQ ID NO: 104150 - DNA, 564 bp, Homo sapiens
  Payload ID: 469
  Gene Symbol: ATF7IP2
  Gene Name: activating transcription factor 7 interacting protein 2
  ENST ID: ENST00000569939
  CDS Start-End: 486-564
gttaacggctgcggttcgaagtggctgtgggtattgctgcggctggtgcgtcgtcgctctagccagtaaatgacctgcgacataactatttgcaaaacaaatggggaagaccaagataaagataagttatatcacaggaaagcaattgaaaatgcaaaaatgaagcatctgaatgaaggactaataacactgaattcagcttttgtgaatcttatctgcagatatgtacagaccacatcctaagattgacttctgcctcaacagaaatacatgagccagtgccttattggaaatgatttgcgtgttttaagaactggtgtatataggaatcctgctttttttttttctttgagacacggtctcactctgtcacccttgctggagtgcagtggtgcaatcacagatcacggcagtgtctaattcctgggctcaagtgaaccttttgcatcagcctcctgaatagctgagaccacaggatatgaaagatggcaagtccagatagaagtaaacggaagatattaaaagccaaaaagacaatgcccctaagttgccggaagcaagtag

SEQ ID NO: 104151 - DNA, 3406 bp, Homo sapiens
  Payload ID: 469
  Gene Symbol: ATF7IP2
  Gene Name: activating transcription factor 7 interacting protein 2
  ENST ID: ENST00000568027
  CDS Start-End: 127-1323
tctcactctgtcacccttgctggagtgcagtggtgcaatcacagatcacggcagtgtctaattcctgggctcaagtgaaccttttgcatcagcctcctgaatagctgagaccacaggatatgaaagatggcaagtccagatagaagtaaacggaagatattaaaagccaaaaagacaatgcccctaagttgccggaagcaagtagagatgctgaataagtcaaggaatgttgaagcgctgaaaacagcaattgggagtaatgttccaagcggtaatcagagtttcagtcctagtgtcataactaggacgactgaaataaccaaatgtagcccttctgaaaatggtgcatcctcattggactctaataaaaattcaatatcagagaaaagtaaagtattctctcagaattgcataaaaccagtagaagaaattgttcattcagaaacaaaattggaacaagttgtttgttcgtaccaaaagccaagtagaacaacagaatcccccagcagagtcttcacagaagaggcaaaagattcactgaacacttctgaaaacgattctgagcatcagacaaatgtaacaagatccctttttgagcatgagggggcttgtagtctaaagtccagttgctgtccacccagtgtattgagtggtgttgttcagatgccagagtctacagtaaccagtaccgtgggtgacaagaaaactgaccagatggttttccatttagaaacaaactccaattcagaatcacatgataaaaggcaaagtgacaacattttatgttcagaagactcaggttttgtgcctgttgagaaaacacctaatttggtgaattcagtcacttctaacaactgtgctgatgacattttgaaaactgatgagtgtagtagaaccagtatttcaaattgtgaaagtgcagactcaacatggcagtcatcacttgacactaataacaacagccattatcaaaagaagaggatgttttcagaaaacgaggaaaatgttaaacgcatgaaaacttcagagcaaattaatgaaaatatttgtgtaagtttggaaaggcaaacagcattcctggaacaggtcagacatttgattcagcaggagatctatagcataaattatgaactatttgataagaaactgaaagaattgaaccaacgcattgggaagacagagtgcagaaataagcatgaaggaatagctgataaacttttggcaaaaatagcaaaacttcaaagacgtattaaaacagtattattatttcaaaggaattgtttgaaaccaaacatgttatccagtaatggagcctctaagtaacaatgatgatgttatgttgatttctgtggaaagtcctaatttgacaactccaattacatcaaatccaacagataccagaaaaattacatcaggaaattctagcaattctcccaatgctgaagttatggctgtacagaagaaacttgattctataattgatttgacaaaagaaggcctatccaactgcaatacagaaagtccagtatcccccctggagtcacattcgaaagctgcttcaaactcaaaggaaacaaccccattggcacaaaatgcagtccaggttcctgagtcctttgagcacctgccacctctcccagaaccaccagcaccactacctgaattagtagacaaaacccgagacacacttcctccccagaagcctgagctcaaagtgaaacgggttttcagacccaatggcattgccctgacttggaatataaccaaaatcaatcccaagtgtgctcctgtagaaagctaccacctcttcctgtgtcatgagaactctaataataagttgatttggaagaagattggagaaattaaagctttaccactccccatggcctgtactttatctcagtttttagcttccaacagatactattttactgtccaatcaaaagatatttttggacgatatggaccattctgtgatataaaatctatccctgggttttctgaaaatcttacgtaaaaggtgtttaataatgatatactactttttttttcatatttgtttgtttgcaatgttactgtaatactatttgccattgtaaaaggccagctcagattgtgagccctttctattgggacagtcctcttctatatgttttaagtggccagtaatttaatgaatttctggtttgtattaaatatgtccttccaatggataagttctaaaacatacgctatcattggcccatgttgctgaggtgcattgtgaacaatacctttagtgactgtggaactgctgcttctatcagaagacctaggatacaagcagccactgtttcctccgttaacaatcagcttttagtaacctgctgtggtcagcatagctacaggaaaagtcagcccttgactgagggccagatcatccctggagtgcacctctactaagattttatgaaaagatgacatgttgggctgcatgataaaagttaattataaaaattaaaagatttttttttttgagatggaatattgctctgttgcccaggctggagtacagtggtcactgcaacctccatctccctggttcaagcaattctcctatgtcagcctcccaagtagctgggactatagtcacttgccaccatgcccggctaatttatttttagtagagatgaggtttcaccttgttggtcaggctggtctcaaactcctgacctcaggggatccacccgcctcggcctcccgaagtgctgggattataggcgtaagccaccatgcctggccaaaaattaaaagattttatgaaacgaaatggcttcccattctttctattcagcttctaagtgggctattcatttgtgctctcctcttttttgttttgttttgcactttgtcaatcatttggggaaatagcctggaggtctttcctgaatctgtttgtagacataataaaatttgtgtgctgtgtacacaaaaacataatgtatcttatgaaagcattacccaacctgtttgagttgagaatgcatttgtccacctttgatttgaggctttagtttgctgatttcctaaatgctaccctttgatcatttcctggccaccatcacaatactaaggggctcagatgtgtcttgtgcccacctcttcctgagaagagatggaagtggagctgtgactagtacaagcagcccaagaaactctgaacggggcccaatggaggcaaacttgagcaaataattgggatgataagaaacaaaaataatcccaactgtttgaaagttcgaaagaggggcattcttttctggtacatggtgagagttcaggctccagagactcaaaacggaatggttttccttggcattttgtaaatgctctcacatctgtagcaataaagctgttattttctgca

SEQ ID NO: 104152 - DNA, 559 bp, Homo sapiens
  Payload ID: 469
  Gene Symbol: ATF7IP2
  Gene Name: activating transcription factor 7 interacting protein 2
  ENST ID: ENST00000569900
  CDS Start-End: 337-559
gttaacggctgcggttcgaagtggctgtgggtattgctgcggctggtgcgtcgtcgctctagccagtaaatgacctgcgacataactatttgcaaaacaaatggggaagaccaagataaagataagttatatcacaggaaagcaattgaaaatgcaaaaatgaagcatctgaatgaaggactaataacactgaattcagcttttgtgaatcttatctgcagatatgtacagaccacatcctaagattgacttctgcctcaacagaaatacatgagccagtgccttattggaaatgatttgcgtgttttaagaactggtgtatataggatatgaaagatggcaagtccagatagaagtaaacggaagatattaaaagccaaaaagacaatgcccctaagttgccggaagcaagtagagatgctgaataagtcaaggaatgttgaagcgctgaaaacagcaattgggagtaatgttccaagcggtaatcagagtttcagtcctagtgtcataactaggacgactgaaataaccaaatgtagcccttctgaaaatggtgcat

SEQ ID NO: 104153 - DNA, 558 bp, Homo sapiens
  Payload ID: 469
  Gene Symbol: ATF7IP2
  Gene Name: activating transcription factor 7 interacting protein 2
  ENST ID: ENST00000562102
  CDS Start-End: 307-558
attgttaacggctgcggttcgaagtggctgtgggtattgctgcggctggtgcgtcgtcgctctaggtaaatcagggatttcttcttggtttggatccactgctggttttcttccgccgtctgtgacagcttcttgatctgtccccaggaatcctgctttttttttttctttgagacacggtctcactctgtcacccttgctggagtgcagtggtgcaatcacagatcacggcagtgtctaattcctgggctcaagtgaaccttttgcatcagcctcctgaatagctgagaccacaggatatgaaagatggcaagtccagatagaagtaaacggaagatattaaaagccaaaaagacaatgcccctaagttgccggaagcaagtagagatgctgaataagtcaaggaatgttgaagcgctgaaaacagcaattgggagtaatgttccaagcggtaatcagagtttcagtcctagtgtcataactaggacgactgaaataaccaaatgtagcccttctgaaaatggtgcatcctcattggactctaataaaaattcaata

SEQ ID NO: 104154 - DNA, 625 bp, Homo sapiens
  Payload ID: 469
  Gene Symbol: ATF7IP2
  Gene Name: activating transcription factor 7 interacting protein 2
  ENST ID: ENST00000562527
  CDS Start-End: 574-625
agcattgttaacggctgcggttcgaagtggctgtgggtattgctgcggctggtgcgtcgtcgctctagccagtaaatgacctgcgacataactatttgcaaaacaaatggggaagaccaagataaagataagttatatcacaggaaagcaattgaaaatgcaaaaatgaagcatctgaatgaaggactaataacactgaattcagcttttgtgaatcttatctgcagatatgtacagaccacatcctaagattgacttctgcctcaacagaaatacatgagccagtgccttattggaaatgatttgcgtgttttaagaactggtgtatataggtaaatcagggatttcttcttggtttggatccactgctggttttcttccgccgtctgtgacagcttcttgatctgtccccaggaatcctgctttttttttttctttgagacacggtctcactctgtcacccttgctggagtgcagtggtgcaatcacagatcacggcagtgtctaattcctgggctcaagtgaaccttttgcatcagcctcctgaatagctgagaccacaggatatgaaagatggcaagtccagatagaagtaaacggaagatattaaaagccaaaaagacaa

SEQ ID NO: 104155 - DNA, 2819 bp, Homo sapiens
  Payload ID: 470
  Gene Symbol: AICDA
  Gene Name: activation-induced cytidine deaminase
  Uniprot ID: Q9GZX7
  ENST ID: ENST00000229335
  CDS Start-End: 105-701
ggccaatgcactgtcagactaagacagagaaccatcattaattgaagtgagatttttctggcctgagacttgcagggaggcaagaagacactctggacaccactatggacagcctcttgatgaaccggaggaagtttctttaccaattcaaaaatgtccgctgggctaagggtcggcgtgagacctacctgtgctacgtagtgaagaggcgtgacagtgctacatccttttcactggactttggttatcttcgcaataagaacggctgccacgtggaattgctcttcctccgctacatctcggactgggacctagaccctggccgctgctaccgcgtcacctggttcacctcctggagcccctgctacgactgtgcccgacatgtggccgactttctgcgagggaaccccaacctcagtctgaggatcttcaccgcgcgcctctacttctgtgaggaccgcaaggctgagcccgaggggctgcggcggctgcaccgcgccggggtgcaaatagccatcatgaccttcaaagattatttttactgctggaatacttttgtagaaaaccacgaaagaactttcaaagcctgggaagggctgcatgaaaattcagttcgtctctccagacagcttcggcgcatccttttgcccctgtatgaggttgatgacttacgagacgcatttcgtactttgggactttgatagcaacttccaggaatgtcacacacgatgaaatatctctgctgaagacagtggataaaaaacagtccttcaagtcttctctgtttttattcttcaactctcactttcttagagtttacagaaaaaatatttatatacgactctttaaaaagatctatgtcttgaaaatagagaaggaacacaggtctggccagggacgtgctgcaattggtgcagttttgaatgcaacattgtcccctactgggaataacagaactgcaggacctgggagcatcctaaagtgtcaacgtttttctatgacttttaggtaggatgagagcagaaggtagatcctaaaaagcatggtgagaggatcaaatgtttttatatcaacatcctttattatttgattcatttgagttaacagtggtgttagtgatagatttttctattcttttcccttgacgtttactttcaagtaacacaaactcttccatcaggccatgatctataggacctcctaatgagagtatctgggtgattgtgaccccaaaccatctctccaaagcattaatatccaatcatgcgctgtatgttttaatcagcagaagcatgtttttatgtttgtacaaaagaagattgttatgggtggggatggaggtatagaccatgcatggtcaccttcaagctactttaataaaggatcttaaaatgggcaggaggactgtgaacaagacaccctaataatgggttgatgtctgaagtagcaaatcttctggaaacgcaaactcttttaaggaagtccctaatttagaaacacccacaaacttcacatatcataattagcaaacaattggaaggaagttgcttgaatgttggggagaggaaaatctattggctctcgtgggtctcttcatctcagaaatgccaatcaggtcaaggtttgctacattttgtatgtgtgtgatgcttctcccaaaggtatattaactatataagagagttgtgacaaaacagaatgataaagctgcgaaccgtggcacacgctcatagttctagctgcttgggaggttgaggagggaggatggcttgaacacaggtgttcaaggccagcctgggcaacataacaagatcctgtctctcaaaaaaaaaaaaaaaaaaaagaaagagagagggccgggcgtggtggctcacgcctgtaatcccagcactttgggaggccgagccgggcggatcacctgtggtcaggagtttgagaccagcctggccaacatggcaaaaccccgtctgtactcaaaatgcaaaaattagccaggcgtggtagcaggcacctgtaatcccagctacttgggaggctgaggcaggagaatcgcttgaacccaggaggtggaggttgcagtaagctgagatcgtgccgttgcactccagcctgggcgacaagagcaagactctgtctcagaaaaaaaaaaaaaaaagagagagagagagaaagagaacaatatttgggagagaaggatggggaagcattgcaaggaaattgtgctttatccaacaaaatgtaaggagccaataagggatccctatttgtctcttttggtgtctatttgtccctaacaactgtctttgacagtgagaaaaatattcagaataaccatatccctgtgccgttattacctagcaacccttgcaatgaagatgagcagatccacaggaaaacttgaatgcacaactgtcttattttaatcttattgtacataagtttgtaaaagagttaaaaattgttacttcatgtattcatttatattttatattattttgcgtctaatgattttttattaacatgatttccttttctgatatattgaaatggagtctcaaagcttcataaatttataactttagaaatgattctaataacaacgtatgtaattgtaacattgcagtaatggtgctacgaagccatttctcttgatttttagtaaacttttatgacagcaaatttgcttctggctcactttcaatcagttaaataaatgataaataattttggaagctgtgaagataaaataccaaataaaataatataaaagtgatttatatgaagttaaaataaaaaatcagtatgatggaataaacttg

SEQ ID NO: 104156 - DNA, 1075 bp, Homo sapiens
  Payload ID: 470
  Gene Symbol: AICDA
  Gene Name: activation-induced cytidine deaminase
  ENST ID: ENST00000543081
  CDS Start-End: 1-434
acagcctcttgatgaaccggaggaagtttctttaccaattcaaaaatgtccgctgggctaagggtcggcgtgagacctacctgtgctacgtagtgaagaggcgtgacagtgctacatccttttcactggactttggttatcttcgcaataagaacggctgccacgtggaattgctcttcctccgctacatctcggactgggacctagaccctggccgctgctaccgcgtcacctggttcacctcctggagcccctgctacgactgtgcccgacatgtggccgactttctgcgagggaaccccaacctcagtctgaggatcttcaccgcgcgcctctacttctgtgaggaccgcaaggctgagcccgaggggctgcggcggctgcaccgcgccggggtgcaaatagccatcatgaccttcaaagcccctgtatgaggttgatgacttacgagacgcatttcgtactttgggactttgatagcaacttccaggaatgtcacacacgatgaaatatctctgctgaagacagtggataaaaaacagtccttcaagtcttctctgtttttattcttcaactctcactttcttagagtttacagaaaaaatatttatatacgactctttaaaaagatctatgtcttgaaaatagagaaggaacacaggtctggccagggacgtgctgcaattggtgcagttttgaatgcaacattgtcccctactgggaataacagaactgcaggacctgggagcatcctaaagtgtcaacgtttttctatgacttttaggtaggatgagagcagaaggtagatcctaaaaagcatggtgagaggatcaaatgtttttatatcaacatcctttattatttgattcatttgagttaacagtggtgttagtgatagatttttctattcttttcccttgacgtttactttcaagtaacacaaactcttccatcaggccatgatctataggacctcctaatgagagtatctgggtgattgtgaccccaaaccatctctccaaagcattaatatccaatcatgcgctgtatgttttaatcagcagaagcatgtttt

SEQ ID NO: 104157 - DNA, 206 bp, Homo sapiens
  Payload ID: 470
  Gene Symbol: AICDA
  Gene Name: activation-induced cytidine deaminase
  ENST ID: ENST00000544516
  CDS Start-End: 1-206
acagcctcttgatgaaccggaggaagtttctttaccaattcaaaaatgtccgctgggctaagggtcggcgtgagacctacctgtgctacgtagtgaagaggcgtgacagtgctacatccttttcactggactttggttatcttcgcaataagcccctgtatgaggttgatgacttacgagacgcatttcgtactttgggactttga

SEQ ID NO: 104158 - DNA, 592 bp, Homo sapiens
  Payload ID: 470
  Gene Symbol: AICDA
  Gene Name: activation-induced cytidine deaminase
  ENST ID: ENST00000545512
  CDS Start-End: 1-592
acagcctcttgatgaaccggaggaagtttctttaccaattcaaaaatgtccgctgggctaagggtcggcgtgagacctacctgtgctacgtagtgaagaggcgtgacagtgctacatccttttcactggactttggttatcttcgcaataagaacggctgccacgtggaattgctcttcctccgctacatctcggactgggacctagaccctggccgctgctaccgcgtcacctggttcacctcctggagcccctgctacgactgtgcccgacatgtggccgactttctgcgagggaaccccaacctcagtctgaggatcttcaccgcgcgcctctacttctgtgaggaccgcaaggctgagcccgaggggctgcggcggctgcaccgcgccggggtgcaaatagccatcatgaccttcaaagattatttttactgctggaatacttttgtagaaaaccacgaaagaactttcaaagcctgggaagggctgcatgaaaattcagttcgtctctccagacagcttcggcgcatccttttgcccctgtatgaggttgatgacttacgagacgcatttcgtactttgggactttg

SEQ ID NO: 104159 - DNA, 667 bp, Homo sapiens
  Payload ID: 470
  Gene Symbol: AICDA
  Gene Name: activation-induced cytidine deaminase
  Uniprot ID: Q9GZX7
  ENST ID: ENST00000537228
  CDS Start-End: 101-667
aatgcactgtcagactaagacagagaaccatcattaattgaagtgagatttttctggcctgagacttgcagggaggcaagaagacactctggacaccactatggacagcctcttgatgaaccggaggaagtttctttaccaattcaaaaatgtccgctgggctaagggtcggcgtgagacctacctgtgctacgtagtgaagaggcgtgacagtgctacatccttttcactggactttggttatcttcgcaataagaacggctgccacgtggaattgctcttcctccgctacatctcggactgggacctagaccctggccgctgctaccgcgtcacctggttcacctcctggagcccctgctacgactgtgcccgacatgtggccgactttctgcgagggaaccccaacctcagtctgaggatcttcaccgcgcgcctctacttctgtgaggaccgcaaggctgagcccgaggggctgcggcggctgcaccgcgccggggtgcaaatagccatcatgaccttcaaagaaaaccacgaaagaactttcaaagcctgggaagggctgcatgaaaattcagttcgtctctccagacagcttcggcgcatccttttgcccctgtatgaggttgatgacttacgagacgcatttcgtactttgggactttga

SEQ ID NO: 104160 - DNA, 2949 bp, Homo sapiens
  Payload ID: 471
  Gene Symbol: ABT1
  Gene Name: activator of basal transcription 1
  Uniprot ID: Q9ULW3
  ENST ID: ENST00000274849
  CDS Start-End: 32-850
tacggccgtcgtgccgctcgtgtcagtcaacatggaggcagaggaatcggagaaggccgcaacggagcaagagccgctggaagggacagaacagacactagatgcggaggaggagcaggaggaatccgaagaagcggcctgtggcagcaagaaacgggtagtgccaggtattgtgtacctgggccatatcccgccgcgcttccggcccctgcacgtccgcaaccttctcagcgcctatggcgaggtcggacgcgtcttctttcaggctgaggaccggttcgtgagacgcaagaagaaggcagcagcagctgccggaggaaaaaagcggtcctacaccaaggactacaccgagggatgggtggagttccgtgacaagcgcatagccaagcgcgtggcggccagtctacacaacacgcctatgggtgcccgcaggcgcagccccttccgttatgatctttggaacctcaagtacttgcaccgtttcacctggtcccacctcagcgagcacctcgcctttgagcgccaggtgcgcaggcagcgcttgagagcggaggttgctcaagccaagcgtgagaccgacttctatcttcaaagtgtggaacggggacaacgctttcttgcggccgatggggaccctgctcgcccagatggctcctggacatttgcccagcgtcctactgagcaggaactgagggcccgtaaagcagcacggccagggggacgtgaacgggctcgcctggcaactgcccaggacaaggcccgctccaacaaagggctcctggccaggatctttggagccccgccaccctcagagagcatggagggaccttcccttgtcagggactcctgagggcctgggtggccccttccatttcctggccctgctctgcttcctgtctacctcatactagaatgatcgtgactacccgggcagacattttactgtgtttctcagaccaagtgtctactgatggcccaaacatggagttttgtgggcttccactgtccccactccgaactcctgtatgtgcctggctgagtcacctaattcatactgtcatactagcataattatgactattgcatatgcttgttttgtttgactcttggctgcctacgtctgtagggtcccctgaaaatcccacttcctgcccccagaaagggcctttatttccaactaggaggataatgcctagtccaggcaatctttctctgtttagcagtcacaggtgagggtggtattagcatcttttttatgtagaaaaaattgagttaatggggtggactgggttgggaagaaatacatttcctaatgtatttatagaaaataaaaatatttttatgtgcctttttatttttgttggtggggaggtcattggacaagttccaactttcatcttgtgttcccttcaccttcatatcctgatcttagagcccccctccccctgccacccaccttactgtttaacctggatttttttttctatttaatttttgtctaatatcttagcccagtttatcaatcagttatcttaagtcagcattttctaagccattgtttgaggaaacagtgacaataggtaataacacatcttagtattaagagttttacaggccactagtataagataggcatcgtggtagatgcatataaagggtggaatgggagccatggcaggtcatagagtcctctcaatgggaacctgattgatgatcacagtcttcagtggtgagtcagtcctcaccaagttttccagatcattcctacaaagtaaactgggagaataataagtctgaaagagtgtggagtgctcccacaattacaaagaatgcttcctgggtggagtgttgagttggaaccattgtaaaggtgggcaaagcctagtagagaaccagtgcacctcaggtgcacttacatatggtggggctgaggcaaagcagccctgtaggcttcaaagaatcagtgtaagccactaaaaggaactgaaaacctaggtgtcacaataaacagtctacacagtctcacgtagaccaaaattctgatcattttccaggctgttgcatgaagtgatagagtatgattataatttctgtttgcttgtgctgtttgtttttgtttttcatctgtcaatgtgatgatctgtgttttatagggtagagtggatttgtctactttggctgtaaaataccctaatcacattatgatcttgacaggtgcactttactggggagaataaaaaggaccatacggtaaagctggtataacatttctcacaacccacatacctcttatacttggcacacaaactacgtttccatttagaaactttcgtcttgtttctgtttttaattcttgtgggtttgtttcatgtgaattgtttcctcagatcattgatgtcttaaagtgaaacagaaaaatccagaatcagaatttgacaggctggcatattcatttattcagaattccaagtgcccattgctacttctgctagataaagagataccaaggtgaagaagaaactttccctctagttgctaacagcttagaaagtacagtagacatactggggttttatttaagactttcttgaatgaagaaataaattgcattcccacggtggacagcgttagataacagtatgttcaagggctggtatttcagggtccatctccaaaacagttctgtacaaagagctcacacctgcggccaggcaagctaagtaagtcacaggtggagtgaggaatgagaataaatgggtggaagaaaatatcctaggaactttcatcttgactttaagcccattgagtgtaggaaaataattttttacatccacaattttgtttctatttaaacagcacttgtttttttatatgaagtaactcatttaatccacaactatataatattgttatccccccattaaaactgagctcagagagatgactcaa

SEQ ID NO: 104161 - DNA, 2673 bp, Homo sapiens
  Payload ID: 472
  Gene Symbol: ABR
  Gene Name: active BCR-related
  Uniprot ID: Q12979
  ENST ID: ENST00000291107
  CDS Start-End: 33-2501
ttcctgtctgccctccgcgggctccggctgccatggaggaggaagaggaggcgataggcttgctggacaaggttctggaggacgaagatgtgtttctcctggaggagtgcgagctgggaaccccgaccagccccggctcagggtcccccttcctggtggctgtgaaggtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaagctggccagccagctcggtgtgtacaaagcgtttgtcgataactataaagtcgctctggagacagctgagaagtgcagccagtccaacaaccagttccagaagatctcagaggaactcaaagtgaaaggtcccaaggactccaaggacagccacacgtctgtcaccatggaagctctgctctacaagcccattgaccgggtcactcggagcaccctagtcctacacgacctgctgaagcacacacctgtggaccaccccgactacccgctgctgcaggatgccctccgcatctcccagaacttcctgtccagcatcaacgaggacatcgacccccgccggactgcagtgacaacgcccaagggggagacgcgacagctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggagtctgaggccagcccccaggtgcaccccttcccagaccatgagctggaggacatgaagatgaagatctctgccctcaagagtgaaatccagaaggagaaagccaacaaaggccagagccgggccatcgagcgcctgaagaagaagatgtttgagaatgagttcctgctgctgctcaactcccccacaatcccgttcaggatccacaatcggaatggaaagagttacctgttcctactgtcctcggactacgagaggtcagagtggagagaagcaattcagaaactacagaagaaggatctccaggcctttgtcctgagctcagtggagctccaggtgctcacaggatcctgtttcaagcttaggactgtacacaacattcctgtcaccagcaataaagacgacgatgagtctccaggactctatggcttccttcatgtcatcgtccactctgccaagggatttaagcaatcagccaacctgtactgtaccctggaggtggattccttcggctattttgtcagcaaagccaaaaccagggtgttccgggacacagcggagcccaagtgggatgaggagtttgagatcgagctggagggctcccagtccctgaggatcctgtgctatgagaagtgctatgacaagaccaaggtcaacaaggacaacaatgagatcgtggacaagatcatgggcaaaggacagatccagctggacccacaaaccgtggagaccaagaactggcacacggacgtgattgagatgaacgggatcaaagtggaattttccatgaaattcaccagccgagatatgagcctgaagaggaccccgtccaaaaagcagaccggcgtcttcggtgtgaagatcagcgtggtgacgaagcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcaggtccaggtcctcctctactacctgcagcacccccccatttccttcgcagaactcaagcggaacacactgtacttctccaccgacgtgtagcccgaggcagggtggctgcgggcgggtggtggaaccagcccctccagcctggggtccaactcagacttgaaagactgcaatagaaaactcccaaacccagcactccagactcgagggaagccagcttccaagaactggaatgcgtacgtcttttgtgccaccttgtacaaag

SEQ ID NO: 104162 - DNA, 5289 bp, Homo sapiens
  Payload ID: 472
  Gene Symbol: ABR
  Gene Name: active BCR-related
  Uniprot ID: Q12979
  ENST ID: ENST00000302538
  CDS Start-End: 148-2727
gccccgcgctcctcccggggacctggttcccggcctcctcgcccctccgcgctcgcaacttcggcctcccccggctcccgcccgctctccctcctttgttgcgcgatgagggtcgggtttcggatctgaccgagccgccgccgcgggatggagccgctcagccaccggggcctgccgcgcctgtcctggatcgacaccctctacagcaacttcagctacgggacggacgagtacgacggagaggggaatgaggagcagaaggggcccccggagggctcagagaccatgccgtacatcgatgagtcgcccaccatgtccccgcagctcagcgcccgcagccagggcgggggggatggcgtctccccgactccacctgagggactggctcctggggtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaagctggccagccagctcggtgtgtacaaagcgtttgtcgataactataaagtcgctctggagacagctgagaagtgcagccagtccaacaaccagttccagaagatctcagaggaactcaaagtgaaaggtcccaaggactccaaggacagccacacgtctgtcaccatggaagctctgctctacaagcccattgaccgggtcactcggagcaccctagtcctacacgacctgctgaagcacacacctgtggaccaccccgactacccgctgctgcaggatgccctccgcatctcccagaacttcctgtccagcatcaacgaggacatcgacccccgccggactgcagtgacaacgcccaagggggagacgcgacagctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggagtctgaggccagcccccaggtgcaccccttcccagaccatgagctggaggacatgaagatgaagatctctgccctcaagagtgaaatccagaaggagaaagccaacaaaggccagagccgggccatcgagcgcctgaagaagaagatgtttgagaatgagttcctgctgctgctcaactcccccacaatcccgttcaggatccacaatcggaatggaaagagttacctgttcctactgtcctcggactacgagaggtcagagtggagagaagcaattcagaaactacagaagaaggatctccaggcctttgtcctgagctcagtggagctccaggtgctcacaggatcctgtttcaagcttaggactgtacacaacattcctgtcaccagcaataaagacgacgatgagtctccaggactctatggcttccttcatgtcatcgtccactctgccaagggatttaagcaatcagccaacctgtactgtaccctggaggtggattccttcggctattttgtcagcaaagccaaaaccagggtgttccgggacacagcggagcccaagtgggatgaggagtttgagatcgagctggagggctcccagtccctgaggatcctgtgctatgagaagtgctatgacaagaccaaggtcaacaaggacaacaatgagatcgtggacaagatcatgggcaaaggacagatccagctggacccacaaaccgtggagaccaagaactggcacacggacgtgattgagatgaacgggatcaaagtggaattttccatgaaattcaccagccgagatatgagcctgaagaggaccccgtccaaaaagcagaccggcgtcttcggtgtgaagatcagcgtggtgacgaagcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcaggtccaggtcctcctctactacctgcagcacccccccatttccttcgcagaactcaagcggaacacactgtacttctccaccgacgtgtagcccgaggcagggtggctgcgggcgggtggtggaaccagcccctccagcctggggtccaactcagacttgaaagactgcaatagaaaactcccaaacccagcactccagactcgagggaagccagcttccaagaactggaatgcgtacgtcttttgtgccaccttgtacaaagccggctgcccagccccagcctcaccaccgcatcccacctcctgccctccatacctctagttgtgtctgatgctccgtgctgttcgggaattgttttatgtacacttgtcaggcagaaaaggtagtgaccggcccggcgtgggcacacagacagcccgctttgttctttcatttcctccagcactttctttccgcctgagtccagcccaaggccttttattttgcgctgtgtaactgctgccagcttctctcttggccctgctcccagatggcggtctcctggcagcctcccctcagtcttcctccacccgctcttccttcccagcctgcctgcatgcatgtgcacccttggtcttcgctccatcgccttgaaagctctgaagaggccctgggttgccgcggcagcagtggtctgtttgatgctgccgtttgccgctgccggcccctcctcagactccgcctttgggagcacacctgctttgccttgctgcctgtgcaaatgttggacaagcagacacactcacactcgtccccagcttagcacagagctggagcgcccatttctggaattttccgtttgggaatctccacttctggggtttacctgttcggcctcctgtctatcagtgaggcatctctgactgtttcttctactgcttttcagttcccttccctgctgttctatttcctttgagtgtaaagactcacaggtgacctgctatcgagatagccagagggtcaggagagaatgggggaggaggcggtcaggctgctgaggaaacaccacaggctgaacgggggaggaatgcacatgccacgctgggtgtcccgggtcgcggggaggcagctcagctcttaggagcaagttgtgggggcttttcaagaggggccaggcttcctggagggtgactgatgtggccgaagcaggtgtccaggcaggtaggctgcagccaggagctccctggcaccgcaggacctcgtggtactcttgccttagattttacacacactccacagccaagcactgccacggtcctccaggacctgggaagcaaaggcacaggcccacggtggccagccattgtggtgccgccccagcttctggatacagccttttgggtaaacactgggaactccagaagttgtggggagagtggggaatcagacagccgcctctaggggctgggttctgctggggcctccttgttggtgctgtaggcacccgccagggagcagggacccgacttgcagacgcattgcccggtactaggaaggagtgaggtgtgttcccaccgtacacttcccacacgagctgcggctgccagcctcgggccatcagcctaggagagcagatgcagctccaggggctcgacttatagccagttacagctccccggctcttctgtgtggcagagcgtcgtttccgggccctcagggctggggagctcagttcccattgcttgtgctcagggctgagtcttaaagaagggtttgccggccctaacgctgcagcgcgtgcgcggtgagaggccctttttgagcctgtttactcctgtggccttgggcagaacagtaaatactctgtgcacggaggaaagacatgcccaagaggaaggaagtactgaccatcggctgcctgtgagcagcttagcaaggagcccttgctccctgggaaaggcggtgaacttgagtctaaagatgcagtgcctggcccttcctaaggtccctgcctggcatccgagtgtcggtgtgtggcacagaaggctcctgcttgcttccaaagtgatggacaggaaggggcagagtgagtcacggcccagactgggcaccttcgcgtctcagcctcagggagccccacagccccaagctcgctgaggcaacgtgagaacaggctatgggaaggctgcaaaggctgagaaatgcaaaggctcatatttataaatcccacccccagagtggggagggtcaggtgccagacctggactaaactgcaccaaggaaacacccagcagggtctcctgtgagccggggaccatgcagcccgaaacctccagtcactgcgcccggcaggagtcaggagccagggactgtgcagcctggaacctccagtcactgtgcccagcagggtgggctgtgcccagcaggagtcaggctaagaaacgccaggtctgcctgttcttgctgggcaatggctgatggctgccagtttctgctgatacacaggtaggatgggacccttcatgaatatctgactttaataagttggtaaggatatatttttttgtctatgttctgtttcaacttatgtagattattataaattgatgtaaaccacgtgagaggaaaatgttaataaaaaatgcaaagccccatcatttgcacaaaactcag

SEQ ID NO: 104163 - DNA, 2213 bp, Homo sapiens
  Payload ID: 472
  Gene Symbol: ABR
  Gene Name: active BCR-related
  ENST ID: ENST00000536794
  CDS Start-End: 288-2213
agcctcgtgcccaggcagccagccagctacaaacgtgctcctctttaggatgccagcaggctgctggctccctccctccctacccctcctccccttccccttccctcctctcctcgccacgcgcctccctcccctcccccttgctggaagagcactccggagcggctgcccgatgctggagtccgtgcggcagcatcagcaaggtggctgagtggccgggctgctggtgggcgccggggagcctggagcgatggctgcacgctcccgccgcggggacagaggctgccatggagattctcctcattattcgcttctgctgtaactgcacctatgctctgctctacaagcccattgaccgggtcactcggagcaccctagtcctacacgacctgctgaagcacacacctgtggaccaccccgactacccgctgctgcaggatgccctccgcatctcccagaacttcctgtccagcatcaacgaggacatcgacccccgccggactgcagtgacaacgcccaagggggagacgcgacagctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggagtctgaggccagcccccaggtgcaccccttcccagaccatgagctggaggacatgaagatgaagatctctgccctcaagagtgaaatccagaaggagaaagccaacaaaggccagagccgggccatcgagcgcctgaagaagaagatgtttgagaatgagttcctgctgctgctcaactcccccacaatcccgttcaggatccacaatcggaatggaaagagttacctgttcctactgtcctcggactacgagaggtcagagtggagagaagcaattcagaaactacagaagaaggatctccaggcctttgtcctgagctcagtggagctccaggtgctcacaggatcctgtttcaagcttaggactgtacacaacattcctgtcaccagcaataaagacgacgatgagtctccaggactctatggcttccttcatgtcatcgtccactctgccaagggatttaagcaatcagccaacctgtactgtaccctggaggtggattccttcggctattttgtcagcaaagccaaaaccagggtgttccgggacacagcggagcccaagtgggatgaggagtttgagatcgagctggagggctcccagtccctgaggatcctgtgctatgagaagtgctatgacaagaccaaggtcaacaaggacaacaatgagatcgtggacaagatcatgggcaaaggacagatccagctggacccacaaaccgtggagaccaagaactggcacacggacgtgattgagatgaacgggatcaaagtggaattttccatgaaattcaccagccgagatatgagcctgaagaggaccccgtccaaaaagcagaccggcgtcttcggtgtgaagatcagcgtggtgacgaagcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcaggtccaggtcctcctctactacctgcagcacccccccatttccttcgcagaactcaagcggaacacactgtacttctccaccgacgtgtag

SEQ ID NO: 104164 - DNA, 5595 bp, Homo sapiens
  Payload ID: 472
  Gene Symbol: ABR
  Gene Name: active BCR-related
  Uniprot ID: Q12979
  ENST ID: ENST00000544583
  CDS Start-End: 601-3042
ggactgcagagggaacttgccttgaagaggcctggtccttaaagagacacagcacacacggcccgaccggcagccccagagcagaggctccactgatggcaggcgcccctggctaggctctgaggttcctttgccctcgccttgctgaatggtgagccgctgcctctcggagcccgtctccttgacagcctgccctcggctcctgcagccactcctgggcctgatggggacagggccagcctggtgggtggtgtcagaggtcctggcagagcagcgtaggcctgggatgcgtctgcagaattctggctgaacgagcgaggagcacggccagcttcggggccgtcgtgaccacaggagggcagagggccagcccgtgagctctgaccccagctggacgtgctcttgtttcccttggggctaaggagattggagccactgaactgaatctctgggttttggagacttagagaatccattggactcttctgctggcgtctttctgaatgctgatggggacttggtgacttcagctacgggacggacgagtacgacggagaggggaatgaggagcagaaggggcccccggagggctcagagaccatgccgtacatcgatgagtcgcccaccatgtccccgcagctcagcgcccgcagccagggcgggggggatggcgtctccccgactccacctgagggactggctcctggggtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaagctggccagccagctcggtgtgtacaaagcgtttgtcgataactataaagtcgctctggagacagctgagaagtgcagccagtccaacaaccagttccagaagatctcagaggaactcaaagtgaaaggtcccaaggactccaaggacagccacacgtctgtcaccatggaagctctgctctacaagcccattgaccgggtcactcggagcaccctagtcctacacgacctgctgaagcacacacctgtggaccaccccgactacccgctgctgcaggatgccctccgcatctcccagaacttcctgtccagcatcaacgaggacatcgacccccgccggactgcagtgacaacgcccaagggggagacgcgacagctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggagtctgaggccagcccccaggtgcaccccttcccagaccatgagctggaggacatgaagatgaagatctctgccctcaagagtgaaatccagaaggagaaagccaacaaaggccagagccgggccatcgagcgcctgaagaagaagatgtttgagaatgagttcctgctgctgctcaactcccccacaatcccgttcaggatccacaatcggaatggaaagagttacctgttcctactgtcctcggactacgagaggtcagagtggagagaagcaattcagaaactacagaagaaggatctccaggcctttgtcctgagctcagtggagctccaggtgctcacaggatcctgtttcaagcttaggactgtacacaacattcctgtcaccagcaataaagacgacgatgagtctccaggactctatggcttccttcatgtcatcgtccactctgccaagggatttaagcaatcagccaacctgtactgtaccctggaggtggattccttcggctattttgtcagcaaagccaaaaccagggtgttccgggacacagcggagcccaagtgggatgaggagtttgagatcgagctggagggctcccagtccctgaggatcctgtgctatgagaagtgctatgacaagaccaaggtcaacaaggacaacaatgagatcgtggacaagatcatgggcaaaggacagatccagctggacccacaaaccgtggagaccaagaactggcacacggacgtgattgagatgaacgggatcaaagtggaattttccatgaaattcaccagccgagatatgagcctgaagaggaccccgtccaaaaagcagaccggcgtcttcggtgtgaagatcagcgtggtgacgaagcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcaggtccaggtcctcctctactacctgcagcacccccccatttccttcgcagaactcaagcggaacacactgtacttctccaccgacgtgtagcccgaggcagggtggctgcgggcgggtggtggaaccagcccctccagcctggggtccaactcagacttgaaagactgcaatagaaaactcccaaacccagcactccagactcgagggaagccagcttccaagaactggaatgcgtacgtcttttgtgccaccttgtacaaagccggctgcccagccccagcctcaccaccgcatcccacctcctgccctccatacctctagttgtgtctgatgctccgtgctgttcgggaattgttttatgtacacttgtcaggcagaaaaggtagtgaccggcccggcgtgggcacacagacagcccgctttgttctttcatttcctccagcactttctttccgcctgagtccagcccaaggccttttattttgcgctgtgtaactgctgccagcttctctcttggccctgctcccagatggcggtctcctggcagcctcccctcagtcttcctccacccgctcttccttcccagcctgcctgcatgcatgtgcacccttggtcttcgctccatcgccttgaaagctctgaagaggccctgggttgccgcggcagcagtggtctgtttgatgctgccgtttgccgctgccggcccctcctcagactccgcctttgggagcacacctgctttgccttgctgcctgtgcaaatgttggacaagcagacacactcacactcgtccccagcttagcacagagctggagcgcccatttctggaattttccgtttgggaatctccacttctggggtttacctgttcggcctcctgtctatcagtgaggcatctctgactgtttcttctactgcttttcagttcccttccctgctgttctatttcctttgagtgtaaagactcacaggtgacctgctatcgagatagccagagggtcaggagagaatgggggaggaggcggtcaggctgctgaggaaacaccacaggctgaacgggggaggaatgcacatgccacgctgggtgtcccgggtcgcggggaggcagctcagctcttaggagcaagttgtgggggcttttcaagaggggccaggcttcctggagggtgactgatgtggccgaagcaggtgtccaggcaggtaggctgcagccaggagctccctggcaccgcaggacctcgtggtactcttgccttagattttacacacactccacagccaagcactgccacggtcctccaggacctgggaagcaaaggcacaggcccacggtggccagccattgtggtgccgccccagcttctggatacagccttttgggtaaacactgggaactccagaagttgtggggagagtggggaatcagacagccgcctctaggggctgggttctgctggggcctccttgttggtgctgtaggcacccgccagggagcagggacccgacttgcagacgcattgcccggtactaggaaggagtgaggtgtgttcccaccgtacacttcccacacgagctgcggctgccagcctcgggccatcagcctaggagagcagatgcagctccaggggctcgacttatagccagttacagctccccggctcttctgtgtggcagagcgtcgtttccgggccctcagggctggggagctcagttcccattgcttgtgctcagggctgagtcttaaagaagggtttgccggccctaacgctgcagcgcgtgcgcggtgagaggccctttttgagcctgtttactcctgtggccttgggcagaacagtaaatactctgtgcacggaggaaagacatgcccaagaggaaggaagtactgaccatcggctgcctgtgagcagcttagcaaggagcccttgctccctgggaaaggcggtgaacttgagtctaaagatgcagtgcctggcccttcctaaggtccctgcctggcatccgagtgtcggtgtgtggcacagaaggctcctgcttgcttccaaagtgatggacaggaaggggcagagtgagtcacggcccagactgggcaccttcgcgtctcagcctcagggagccccacagccccaagctcgctgaggcaacgtgagaacaggctatgggaaggctgcaaaggctgagaaatgcaaaggctcatatttataaatcccacccccagagtggggagggtcaggtgccagacctggactaaactgcaccaaggaaacacccagcagggtctcctgtgagccggggaccatgcagcccgaaacctccagtcactgcgcccggcaggagtcaggagccagggactgtgcagcctggaacctccagtcactgtgcccagcagggtgggctgtgcccagcaggagtcaggctaagaaacgccaggtctgcctgttcttgctgggcaatggctgatggctgccagtttctgctgatacacaggtaggatgggacccttcatgaatatctgactttaataagttggtaaggatatatttttttgtctatgttctgtttcaacttatgtagattattataaattgatgtaaaccacgtgagaggaaaatgttaataaaaaatgcaaagccccatcatttgcac

SEQ ID NO: 104165 - DNA, 1049 bp, Homo sapiens
  Payload ID: 472
  Gene Symbol: ABR
  Gene Name: active BCR-related
  Uniprot ID: Q12979
  ENST ID: ENST00000543210
  CDS Start-End: 98-1030
gaaagccggcgggactagggaactagcgggactggcagccgggactgagcgctccacaggcgccttctctccagcgccgcgtcccgtcccccccggcatgaccgacgtcctgccccagcccgactgcagcccgaaggcggggcgcgaacccctggcgctggaggagtcggggagcaagcgcccccccaacaccggcgcccggctctggggccgcgtgcgcaacaagctgctccgaaacaagctggacccacaaaccgtggagaccaagaactggcacacggacgtgattgagatgaacgggatcaaagtggaattttccatgaaattcaccagccgagatatgagcctgaagaggaccccgtccaaaaagcagaccggcgtcttcggtgtgaagatcagcgtggtgacgaagcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcaggtccaggtcctcctctactacctgcagcacccccccatttccttcgcagaactcaagcggaacacactgtacttctccaccgacgtgtagcccgaggcagggtggctgc

SEQ ID NO: 104166 - DNA, 566 bp, Homo sapiens
  Payload ID: 472
  Gene Symbol: ABR
  Gene Name: active BCR-related
  ENST ID: ENST00000574544
  CDS Start-End: 1-566
gaagacctctgcagggaagcaccagcagtatgactgtaagtggtacatccccctggccgacctggtgtttccatcccccgaggagtctgaggccagcccccaggtgcaccccttcccagaccatgagctggaggacatgaagatgaagatctctgccctcaagagtgaaatccagaaggagaaagccaacaaaggccagagccgggccatcgagcgcctgaagaagaagatgtttgagaatgagttcctgctgctgctcaactcccccacaatcccgttcaggatccacaatcggaatggaaagagttacctgttcctactgtcctcggactacgagaggtcagagtggagagaagcaattcagaaactacagaagaaggatctccaggcctttgtcctgagctcagtggagctccaggtgctcacaggatcctgtttcaagcttaggactgtacacaacattcctgtcaccagcaataaagacgacctgtactgtaccctggaggtggattccttcggctattttgtcagcaaagccaaaaccagggtgttccgggacacagcgg

SEQ ID NO: 104167 - DNA, 760 bp, Homo sapiens
  Payload ID: 472
  Gene Symbol: ABR
  Gene Name: active BCR-related
  ENST ID: ENST00000571945
  CDS Start-End: 264-760
agctacaaacgtgctcctctttaggatgccagcaggctgctggctccctccctccctacccctcctccccttccccttccctcctctcctcgccacgcgcctccctcccctcccccttgctggaagagcactccggagcggctgcccgatgctggagtccgtgcggcagcatcagcaaggtggctgagtggccgggctgctggtgggcgccggggagcctggagcgatggctgcacgctcccgccgcggggacagaggctgccatggagattctcctcattattcgcttctgctgtaactgcacctatggtaacccagctctgctctacaagcccattgaccgggtcactcggagcaccctagtcctacacgacctgctgaagcacacacctgtggaccaccccgactacccgctgctgcaggatgccctccgcatctcccagaacttcctgtccagcatcaacgaggacatcgacccccgccggactgcagtgacaacgcccaagggggagacgcgacagctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggagtctgaggccagcccccaggtgcaccccttcccagaccatgagctggaggacatgaa

SEQ ID NO: 104168 - DNA, 597 bp, Homo sapiens
  Payload ID: 472
  Gene Symbol: ABR
  Gene Name: active BCR-related
  ENST ID: ENST00000574266
  CDS Start-End: 339-597
ctcctttgttgcgcgatgagggtcgggtttcggatctgaccgagccgccgccgcgggatggagccgctcagccaccggggcctgccgcgcctgtcctggatcgacaccctctacagcagagctgtccttgtgatggttcattctgctttggtttctcaacatcaaaggggcaaagccggatcccctgggcataggtcctgtgccaggtgccgccgctccatctgctccttcccctgcagaggccagcgtcgttgggtgaagacttcagctacgggacggacgagtacgacggagaggggaatgaggagcagaaggggcccccggagggctcagagaccatgccgtacatcgatgagtcgcccaccatgtccccgcagctcagcgcccgcagccagggcgggggggatggcgtctccccgactccacctgagggactggctcctggggtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcacca

SEQ ID NO: 104169 - DNA, 563 bp, Homo sapiens
  Payload ID: 472
  Gene Symbol: ABR
  Gene Name: active BCR-related
  ENST ID: ENST00000572441
  CDS Start-End: 62-523
agccgggactgagcgctccacaggcgccttctctccagcgccgcgtcccgtcccccccggcatgaccgacgtcctgccccagcccgactgcagcccgaaggcggggcgcgaacccctggcgctggaggagtcggggagcaagcgcccccccaacaccggcgcccggctctggggccgcgtgcgcaacaagctgctccgaaacaagctggacccacaaaccgtggagaccaagaactggcacacggacgtgattgagatgaacgggatcaaagtggaattttccatgaaattcaccagccgagatatgagcctgaagaggaccccgtccaaaaagcagaccggcgtcttcggtgtgaagatcagcgtggtgacgaagcgggagcgctccaaggtgccctacatcgtccggcagtgtgtggaggaggcggtcaggctgctgaggaaacaccacaggctgaacgggggaggaatgcacatgccacgctgggtgtcccgggtcgcggggaggcagctcagctcttaggagcaagttgtgggggcttttcaagaggggccaggcttcc

SEQ ID NO: 104170 - DNA, 549 bp, Homo sapiens
  Payload ID: 472
  Gene Symbol: ABR
  Gene Name: active BCR-related
  ENST ID: ENST00000570525
  CDS Start-End: 284-549
gccccaaggctgccggcacggtgatcttcgtgtctccaggacgccctgcggtgccagctcccgctggcccgcacgagtgctgaagcttacccctgctctgcgatgagtgtgagaggggtgtccaccccccgctggcggccccagcccaaggaggtccaccacagccctcgggagcaacactgccacgttctccgttgccagtcgtgacttcagctacgggacggacgagtacgacggagaggggaatgaggagcagaaggggcccccggagggctcagagaccatgccgtacatcgatgagtcgcccaccatgtccccgcagctcagcgcccgcagccagggcgggggggatggcgtctccccgactccacctgagggactggctcctggggtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagca

SEQ ID NO: 104171 - DNA, 690 bp, Homo sapiens
  Payload ID: 472
  Gene Symbol: ABR
  Gene Name: active BCR-related
  ENST ID: ENST00000570441
  CDS Start-End: 186-690
tctggaggtggggcttgagtttctgccaggaaagctgggagagccagggagaagccaagaggcgggagaaagtgcttcaagccgaggacctgccgttgttaaaggcctggaagtgagaacgtgccaggccctttgagaggttactgtcaacagtgagatgggtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaagctggccagccagctcggtgtgtacaaagcgtttgtcgataactataaagtcgctctggagacagctgagaagtgcagccagtccaacaaccagttccagaagatctcagaggaactcaaagtgaaaggtcccaaggactccaaggacagccacacgtctgtcaccatggaagctctgctctacaagcccattgaccgggtcactcggagcaccctagtcctacacgacctgctgaagcacacacctg

SEQ ID NO: 104172 - DNA, 637 bp, Homo sapiens
  Payload ID: 472
  Gene Symbol: ABR
  Gene Name: active BCR-related
  ENST ID: ENST00000572152
  CDS Start-End: 1-353
tccgggacacagcggagcccaagtgggatgaggagtttgagatcgagctggagggctcccagtccctgaggatcctgtgctatgagaagtgctatgacaagaccaaggtcaacaaggacaacaatgagatcgtggacaagatcatgggcaaaggacagatccagctggacccacaaaccgtggagaccaagaactggcacacggacgtgattgagatgaacgggatcaaagtggaattttccatgaaattcaccagccgagatatgagcctgaagaggaccccgtccaaaaagcagaccggcgtcttcggtgtgaagatcagcgtggtgacgaaatggccggtgtggatctagagtggccgcagaggcgctcacaggacacttcagaagcacgcgagccagcacctaaacgctggaaggcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccggga

SEQ ID NO: 104173 - DNA, 689 bp, Homo sapiens
  Payload ID: 472
  Gene Symbol: ABR
  Gene Name: active BCR-related
  ENST ID: ENST00000575934
  CDS Start-End: 290-689
ccgcgacctggagcagcgggaggccgaggccaagggccgcccgggctcgcccctcgccgcggaggagacccccgggcgcgagcacctgcccccgtggcggcgccgcaggttcctgcgggtgcccgagcgggactcgcccggccacagctcgccggagagagacagcgacggcagccggcacagctccgaccgcgaggacgacttctccgcagacttcagctacgggacggacgagtacgacggagaggggaatgaggagcagaaggggcccccggagggctcagagaccatgccgtacatcgatgagtcgcccaccatgtccccgcagctcagcgcccgcagccagggcgggggggatggcgtctccccgactccacctgagggactggctcctgggcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaagctggccagccagctcggtgtgtacaaagcgtttgtcgataactataaagtcgctctggagacagctgagaagtgcagccagtccaacaaccagttccagaagatctcag

SEQ ID NO: 104174 - DNA, 3196 bp, Homo sapiens
  Payload ID: 472
  Gene Symbol: ABR
  Gene Name: active BCR-related
  Uniprot ID: Q12979
  ENST ID: ENST00000574437
  CDS Start-End: 466-2907
ataaaaagcaaaatggtgactcagagaggagagttggaagcgtcctgcctcttgctcccactgttaatttttacacttggaattaggcagaaggcaaagaaaacagcagcttgaaatacgcggctgacatgctcttcatcgggtagcaacagcagagccgctcctccccgcctcccagcagccccggagcgggcagggcccggtgcctgctggctctcccccgcccctcaccaggcccaggcccccgcacagcccccgcccgggccaggcgtggatggtgcggccggggccatggctgccgggggccgccgccggcgcccactacgctaccagtccctggcagctctggtggaggattctcagtggcctttcttgttccttgtctcagacttcagctacgggacggacgagtacgacggagaggggaatgaggagcagaaggggcccccggagggctcagagaccatgccgtacatcgatgagtcgcccaccatgtccccgcagctcagcgcccgcagccagggcgggggggatggcgtctccccgactccacctgagggactggctcctggggtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaagctggccagccagctcggtgtgtacaaagcgtttgtcgataactataaagtcgctctggagacagctgagaagtgcagccagtccaacaaccagttccagaagatctcagaggaactcaaagtgaaaggtcccaaggactccaaggacagccacacgtctgtcaccatggaagctctgctctacaagcccattgaccgggtcactcggagcaccctagtcctacacgacctgctgaagcacacacctgtggaccaccccgactacccgctgctgcaggatgccctccgcatctcccagaacttcctgtccagcatcaacgaggacatcgacccccgccggactgcagtgacaacgcccaagggggagacgcgacagctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggagtctgaggccagcccccaggtgcaccccttcccagaccatgagctggaggacatgaagatgaagatctctgccctcaagagtgaaatccagaaggagaaagccaacaaaggccagagccgggccatcgagcgcctgaagaagaagatgtttgagaatgagttcctgctgctgctcaactcccccacaatcccgttcaggatccacaatcggaatggaaagagttacctgttcctactgtcctcggactacgagaggtcagagtggagagaagcaattcagaaactacagaagaaggatctccaggcctttgtcctgagctcagtggagctccaggtgctcacaggatcctgtttcaagcttaggactgtacacaacattcctgtcaccagcaataaagacgacgatgagtctccaggactctatggcttccttcatgtcatcgtccactctgccaagggatttaagcaatcagccaacctgtactgtaccctggaggtggattccttcggctattttgtcagcaaagccaaaaccagggtgttccgggacacagcggagcccaagtgggatgaggagtttgagatcgagctggagggctcccagtccctgaggatcctgtgctatgagaagtgctatgacaagaccaaggtcaacaaggacaacaatgagatcgtggacaagatcatgggcaaaggacagatccagctggacccacaaaccgtggagaccaagaactggcacacggacgtgattgagatgaacgggatcaaagtggaattttccatgaaattcaccagccgagatatgagcctgaagaggaccccgtccaaaaagcagaccggcgtcttcggtgtgaagatcagcgtggtgacgaagcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcaggtccaggtcctcctctactacctgcagcacccccccatttccttcgcagaactcaagcggaacacactgtacttctccaccgacgtgtagcccgaggcagggtggctgcgggcgggtggtggaaccagcccctccagcctggggtccaactcagacttgaaagactgcaatagaaaactcccaaacccagcactccagactcgagggaagccagcttccaagaactggaatgcgtacgtcttttgtgccaccttgtacaaagccggctgcccagccccagcctcaccaccgcatcccacctcctgccctccatacctctagttgtgtctgatgctccgtgctgttcgggaattgttttatgtacacttgtcaggcagaa

SEQ ID NO: 104175 - DNA, 678 bp, Homo sapiens
  Payload ID: 472
  Gene Symbol: ABR
  Gene Name: active BCR-related
  ENST ID: ENST00000574139
  CDS Start-End: 290-678
ccgcgacctggagcagcgggaggccgaggccaagggccgcccgggctcgcccctcgccgcggaggagacccccgggcgcgagcacctgcccccgtggcggcgccgcaggttcctgcgggtgcccgagcgggactcgcccggccacagctcgccggagagagacagcgacggcagccggcacagctccgaccgcgaggacgacttctccgcagacttcagctacgggacggacgagtacgacggagaggggaatgaggagcagaaggggcccccggagggctcagagaccatgccgtacatcgatgagtcgcccaccatgtccccgcagctcagcgcccgcagccagggcgggggggatggcgtctccccgactccacctgagggactggctcctggggtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaa

SEQ ID NO: 104176 - DNA, 850 bp, Homo sapiens
  Payload ID: 472
  Gene Symbol: ABR
  Gene Name: active BCR-related
  ENST ID: ENST00000571797
  CDS Start-End: 1-575
tcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcagaactcaagcggaacacactgtacttctccaccgacgtgtagcccgaggcagggtggctgcgggcgggtggtggaaccagcccctccagcctggggtccaactcagacttgaaagactgcaatagaaaactcccaaacccagcactccagactcgagggaagccagcttccaagaactggaatgcgtacgtcttttgtgccaccttgtacaaagccggctgcccagccccagcctcaccaccgcatcccacctcctgccctccatacctctagttgtgtctgatgctccgtgctgttcgggaattgttttatgtacacttgtcaggcagaaaaggtagtgaccggcccggcgtgggcacacagacagcccgctttgttctttcattt

SEQ ID NO: 104177 - DNA, 5595 bp, Homo sapiens
  Payload ID: 472
  Gene Symbol: ABR
  Gene Name: active BCR-related
  Uniprot ID: Q12979
  ENST ID: ENST00000620619
  CDS Start-End: 601-3042
ggactgcagagggaacttgccttgaagaggcctggtccttaaagagacacagcacacacggcccgaccggcagccccagagcagaggctccactgatggcaggcgcccctggctaggctctgaggttcctttgccctcgccttgctgaatggtgagccgctgcctctcggagcccgtctccttgacagcctgccctcggctcctgcagccactcctgggcctgatggggacagggccagcctggtgggtggtgtcagaggtcctggcagagcagcgtaggcctgggatgcgtctgcagaattctggctgaacgagcgaggagcacggccagcttcggggccgtcgtgaccacaggagggcagagggccagcccgtgagctctgaccccagctggacgtgctcttgtttcccttggggctaaggagattggagccactgaactgaatctctgggttttggagacttagagaatccattggactcttctgctggcgtctttctgaatgctgatggggacttggtgacttcagctacgggacggacgagtacgacggagaggggaatgaggagcagaaggggcccccggagggctcagagaccatgccgtacatcgatgagtcgcccaccatgtccccgcagctcagcgcccgcagccagggcgggggggatggcgtctccccgactccacctgagggactggctcctggggtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaagctggccagccagctcggtgtgtacaaagcgtttgtcgataactataaagtcgctctggagacagctgagaagtgcagccagtccaacaaccagttccagaagatctcagaggaactcaaagtgaaaggtcccaaggactccaaggacagccacacgtctgtcaccatggaagctctgctctacaagcccattgaccgggtcactcggagcaccctagtcctacacgacctgctgaagcacacacctgtggaccaccccgactacccgctgctgcaggatgccctccgcatctcccagaacttcctgtccagcatcaacgaggacatcgacccccgccggactgcagtgacaacgcccaagggggagacgcgacagctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggaatctgaggccagcccccaggtgcaccccttcccagaccatgagctggaggacatgaagatgaagatctctgccctcaagagtgaaatccagaaggagaaagccaacaaaggccagagccgggccatcgagcgcctgaagaagaagatgtttgagaatgagttcctgctgctgctcaactcccccacaatcccgttcaggatccacaatcggaatggaaagagttacctgttcctactgtcctcggactacgagaggtcagagtggagagaagcaattcagaaactacagaagaaggatctccaggcctttgtcctgagctcagtggagctccaggtgctcacaggatcctgtttcaagcttaggactgtacacaacattcctgtcaccagcaataaagacgacgatgagtctccaggactctatggcttccttcatgtcatcgtccactctgccaagggatttaagcaatcagccaacctgtactgtaccctggaggtggattccttcggctattttgtcagcaaagccaaaaccagggtgttccgggacacagcggagcccaagtgggatgaggagtttgagatcgagctggagggctcccagtccctgaggatcctgtgctatgagaagtgctatgacaagaccaaggtcaacaaggacaacaatgagatcgtggacaagatcatgggcaaaggacagatccagctggacccacaaaccgtggagaccaagaactggcacacggacgtgattgagatgaacgggatcaaagtggaattttccatgaaattcaccagccgagatatgagcctgaagaggaccccgtccaaaaagcagaccggcgtcttcggtgtgaagatcagcgtggtgacgaagcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcaggtccaggtcctcctctactacctgcagcacccccccatttccttcgcagaactcaagcggaacacactgtacttctccaccgacgtgtagcccgaggcagggtggctgcgggcgggtggtggaaccagcccctccagcctggggtccaactcagacttgaaagactgcaatagaaaactcccaaacccagcactccagactcgagggaagccagcttccaagaactggaatgcgtacgtcttttgtgccaccttgtacaaagccggctgcccagccccagcctcaccaccgcatcccacctcctgccctccatacctctagttgtgtctgatgctccgtgctgttcgggaattgttttatgtacacttgtcaggcagaaaaggtagtgaccggcccggcgtgggcacacagacagcccgctttgttctttcatttcctccagcactttctttccgcctgagtccagcccaaggccttttattttgcgctgtgtaactgctgccagcttctctcttggccctgctcccagatggcggtctcctggcagcctcccctcagtcttcctccacccgctcttccttcccagcctgcctgcatgcatgtgcacccttggtcttcgctccatcgccttgaaagctctgaagaggccctgggttgccgcggcagcagtggtctgtttgatgctgccgtttgccgctgccggcccctcctcagactccgcctttgggagcacacctgctttgccttgctgcctgtgcaaatgttggacaagcagacacactcacactcgtccccagcttagcacagagctggagcgcccatttctggaattttccgtttgggaatctccacttctggggtttacctgttcggcctcctgtctatcagtgaggcatctctgactgtttcttctactgcttttcagttcccttccctgctgttctatttcctttgagtgtaaagactcacaggtgacctgctatcgagatagccagagggtcaggagagaatgggggaggaggcggtcaggctgctgaggaaacaccacaggctgaacgggggaggaatgcacatgccacgctgggtgtcccgggtcgcggggaggcagctcagctcttaggagcaagttgtgggggcttttcaagaggggccaggcttcctggagggtgactgatgtggccgaagcaggtgtccaggcaggtaggctgcagccaggagctccctggcaccgcaggacctcgtggtactcttgccttagattttacacacactccacagccaagcactgccacggtcctccaggacctgggaagcaaaggcacaggcccacggtggccagccattgtggtgccgccccagcttctggatacagccttttgggtaaacactgggaactccagaagttgtggggagagtggggaatcagacagccgcctctaggggctgggttctgctggggcctccttgttggtgctgtaggcacccgccagggagcagggacccgacttgcagacgcattgcccggtactaggaaggagtgaggtgtgttcccaccgtacacttcccacacgagctgcggctgccagcctcgggccatcagcctaggagagcagatgcagctccaggggctcgacttatagccagttacagctccccggctcttctgtgtggcagagcgtcgtttccgggccctcagggctggggagctcagttcccattgcttgtgctcagggctgagtcttaaagaagggtttgccggccctaacgctgcagcgcgtgcgcggtgagaggccctttttgagcctgtttactcctgtggccttgggcagaacagtaaatactctgtgcacggaggaaagacatgcccaagaggaaggaagtactgaccatcggctgcctgtgagcagcttagcaaggagcccttgctccctgggaaaggcggtgaacttgagtctaaagatgcagtgcctggcccttcctaaggtccctgcctggcatccgagtgtcggtgtgtggcacagaaggctcctgcttgcttccaaagtgatggacaggaaggggcagagtgagtcacggcccagactgggcaccttcgcgtctcagcctcagggagccccacagccccaagctcgctgaggcaacgtgagaacaggctatgggaaggctgcaaaggctgagaaatgcaaaggctcatatttataaatcccacccccagagtggggagggtcaggtgccagacctggactaaactgcaccaaggaaacacccagcagggtctcctgtgagccggggaccatgcagcccgaaacctccagtcactgcgcccggcaggagtcaggagccagggactgtgcagcctggaacctccagtcactgtgcccagcagggtgggctgtgcccagcaggagtcaggctaagaaacgccaggtctgcctgttcttgctgggcaatggctgatggctgccagtttctgctgatacacaggtaggatgggacccttcatgaatatctgactttaataagttggtaaggatatatttttttgtctatgttctgtttcaacttatgtagattattataaattgatgtaaaccacgtgagaggaaaatgttaataaaaaatgcaaagccccatcatttgcac

SEQ ID NO: 104178 - DNA, 1049 bp, Homo sapiens; identical to SEQ ID NO: 104165
  Payload ID: 472
  Gene Symbol: ABR
  Gene Name: active BCR-related
  Uniprot ID: Q12979
  ENST ID: ENST00000615642
  CDS Start-End: 98-1030

SEQ ID NO: 104179 - DNA, 2502 bp, Homo sapiens
  Payload ID: 472
  Gene Symbol: ABR
  Gene Name: active BCR-related
  ENST ID: ENST00000619569
  CDS Start-End: 288-2213
agcctcgtgcccaggcagccagccagctacaaacgtgctcctctttaggatgccagcaggctgctggctccctccctccctacccctcctccccttccccttccctcctctcctcgccacgcgcctccctcccctcccccttgctggaagagcactccggagcggctgcccgatgctggagtccgtgcggcagcatcagcaaggtggctgagtggccgggctgctggtgggcgccggggagcctggagcgatggctgcacgctcccgccgcggggacagaggctgccatggagattctcctcattattcgcttctgctgtaactgcacctatgctctgctctacaagcccattgaccgggtcactcggagcaccctagtcctacacgacctgctgaagcacacacctgtggaccaccccgactacccgctgctgcaggatgccctccgcatctcccagaacttcctgtccagcatcaacgaggacatcgacccccgccggactgcagtgacaacgcccaagggggagacgcgacagctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggaatctgaggccagcccccaggtgcaccccttcccagaccatgagctggaggacatgaagatgaagatctctgccctcaagagtgaaatccagaaggagaaagccaacaaaggccagagccgggccatcgagcgcctgaagaagaagatgtttgagaatgagttcctgctgctgctcaactcccccacaatcccgttcaggatccacaatcggaatggaaagagttacctgttcctactgtcctcggactacgagaggtcagagtggagagaagcaattcagaaactacagaagaaggatctccaggcctttgtcctgagctcagtggagctccaggtgctcacaggatcctgtttcaagcttaggactgtacacaacattcctgtcaccagcaataaagacgacgatgagtctccaggactctatggcttccttcatgtcatcgtccactctgccaagggatttaagcaatcagccaacctgtactgtaccctggaggtggattccttcggctattttgtcagcaaagccaaaaccagggtgttccgggacacagcggagcccaagtgggatgaggagtttgagatcgagctggagggctcccagtccctgaggatcctgtgctatgagaagtgctatgacaagaccaaggtcaacaaggacaacaatgagatcgtggacaagatcatgggcaaaggacagatccagctggacccacaaaccgtggagaccaagaactggcacacggacgtgattgagatgaacgggatcaaagtggaattttccatgaaattcaccagccgagatatgagcctgaagaggaccccgtccaaaaagcagaccggcgtcttcggtgtgaagatcagcgtggtgacgaagcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcaggtccaggtcctcctctactacctgcagcacccccccatttccttcgcagaactcaagcggaacacactgtacttctccaccgacgtgtagcccgaggcagggtggctgcgggcgggtggtggaaccagcccctccagcctggggtccaactcagacttgaaagactgcaatagaaaactcccaaacccagcactccagactcgagggaagccagcttccaagaactggaatgcgtacgtcttttgtgccaccttgtacaaagccggctgcccagccccagcctcaccaccgcatcccacctcctgccctccatacctctagttgtgtctgatgctccgtgctgttcgggaattgttttatgtacacttgtcaggcagaa

SEQ ID NO: 104180 - DNA, 4895 bp, Homo sapiens
  Payload ID: 472
  Gene Symbol: ABR
  Gene Name: active BCR-related
  ENST ID: ENST00000613981
  CDS Start-End: 1-2334
gtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaagctggccagccagctcggtgtgtacaaagcgtttgtcgataactataaagtcgctctggagacagctgagaagtgcagccagtccaacaaccagttccagaagatctcagaggaactcaaagtgaaaggtcccaaggactccaaggacagccacacgtctgtcaccatggaagctctgctctacaagcccattgaccgggtcactcggagcaccctagtcctacacgacctgctgaagcacacacctgtggaccaccccgactacccgctgctgcaggatgccctccgcatctcccagaacttcctgtccagcatcaacgaggacatcgacccccgccggactgcagtgacaacgcccaagggggagacgcgacagctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggaatctgaggccagcccccaggtgcaccccttcccagaccatgagctggaggacatgaagatgaagatctctgccctcaagagtgaaatccagaaggagaaagccaacaaaggccagagccgggccatcgagcgcctgaagaagaagatgtttgagaatgagttcctgctgctgctcaactcccccacaatcccgttcaggatccacaatcggaatggaaagagttacctgttcctactgtcctcggactacgagaggtcagagtggagagaagcaattcagaaactacagaagaaggatctccaggcctttgtcctgagctcagtggagctccaggtgctcacaggatcctgtttcaagcttaggactgtacacaacattcctgtcaccagcaataaagacgacgatgagtctccaggactctatggcttccttcatgtcatcgtccactctgccaagggatttaagcaatcagccaacctgtactgtaccctggaggtggattccttcggctattttgtcagcaaagccaaaaccagggtgttccgggacacagcggagcccaagtgggatgaggagtttgagatcgagctggagggctcccagtccctgaggatcctgtgctatgagaagtgctatgacaagaccaaggtcaacaaggacaacaatgagatcgtggacaagatcatgggcaaaggacagatccagctggacccacaaaccgtggagaccaagaactggcacacggacgtgattgagatgaacgggatcaaagtggaattttccatgaaattcaccagccgagatatgagcctgaagaggaccccgtccaaaaagcagaccggcgtcttcggtgtgaagatcagcgtggtgacgaagcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcaggtccaggtcctcctctactacctgcagcacccccccatttccttcgcagaactcaagcggaacacactgtacttctccaccgacgtgtagcccgaggcagggtggctgcgggcgggtggtggaaccagcccctccagcctggggtccaactcagacttgaaagactgcaatagaaaactcccaaacccagcactccagactcgagggaagccagcttccaagaactggaatgcgtacgtcttttgtgccaccttgtacaaagccggctgcccagccccagcctcaccaccgcatcccacctcctgccctccatacctctagttgtgtctgatgctccgtgctgttcgggaattgttttatgtacacttgtcaggcagaaaaggtagtgaccggcccggcgtgggcacacagacagcccgctttgttctttcatttcctccagcactttctttccgcctgagtccagcccaaggccttttattttgcgctgtgtaactgctgccagcttctctcttggccctgctcccagatggcggtctcctggcagcctcccctcagtcttcctccacccgctcttccttcccagcctgcctgcatgcatgtgcacccttggtcttcgctccatcgccttgaaagctctgaagaggccctgggttgccgcggcagcagtggtctgtttgatgctgccgtttgccgctgccggcccctcctcagactccgcctttgggagcacacctgctttgccttgctgcctgtgcaaatgttggacaagcagacacactcacactcgtccccagcttagcacagagctggagcgcccatttctggaattttccgtttgggaatctccacttctggggtttacctgttcggcctcctgtctatcagtgaggcatctctgactgtttcttctactgcttttcagttcccttccctgctgttctatttcctttgagtgtaaagactcacaggtgacctgctatcgagatagccagagggtcaggagagaatgggggaggaggcggtcaggctgctgaggaaacaccacaggctgaacgggggaggaatgcacatgccacgctgggtgtcccgggtcgcggggaggcagctcagctcttaggagcaagttgtgggggcttttcaagaggggccaggcttcctggagggtgactgatgtggccgaagcaggtgtccaggcaggtaggctgcagccaggagctccctggcaccgcaggacctcgtggtactcttgccttagattttacacacactccacagccaagcactgccacggtcctccaggacctgggaagcaaaggcacaggcccacggtggccagccattgtggtgccgccccagcttctggatacagccttttgggtaaacactgggaactccagaagttgtggggagagtggggaatcagacagccgcctctaggggctgggttctgctggggcctccttgttggtgctgtaggcacccgccagggagcagggacccgacttgcagacgcattgcccggtactaggaaggagtgaggtgtgttcccaccgtacacttcccacacgagctgcggctgccagcctcgggccatcagcctaggagagcagatgcagctccaggggctcgacttatagccagttacagctccccggctcttctgtgtggcagagcgtcgtttccgggccctcagggctggggagctcagttcccattgcttgtgctcagggctgagtcttaaagaagggtttgccggccctaacgctgcagcgcgtgcgcggtgagaggccctttttgagcctgtttactcctgtggccttgggcagaacagtaaatactctgtgcacggaggaaagacatgcccaagaggaaggaagtactgaccatcggctgcctgtgagcagcttagcaaggagcccttgctccctgggaaaggcggtgaacttgagtctaaagatgcagtgcctggcccttcctaaggtccctgcctggcatccgagtgtcggtgtgtggcacagaaggctcctgcttgcttccaaagtgatggacaggaaggggcagagtgagtcacggcccagactgggcaccttcgcgtctcagcctcagggagccccacagccccaagctcgctgaggcaacgtgagaacaggctatgggaaggctgcaaaggctgagaaatgcaaaggctcatatttataaatcccacccccagagtggggagggtcaggtgccagacctggactaaactgcaccaaggaaacacccagcagggtctcctgtgagccggggaccatgcagcccgaaacctccagtcactgcgcccggcaggagtcaggagccagggactgtgcagcctggaacctccagtcactgtgcccagcagggtgggctgtgcccagcaggagtcaggctaagaaacgccaggtctgcctgttcttgctgggcaatggctgatggctgccagtttctgctgatacacaggtaggatgggacccttcatgaatatctgactttaataagttggtaaggatatatttttttgtctatgttctgtttcaacttatgtagattattataaattgatgtaaaccacgtgagaggaaaatgttaataaaaaatgcaaagccccatcatttgcacaaaactca

SEQ ID NO: 104181 - DNA, 5288 bp, Homo sapiens
  Payload ID: 472
  Gene Symbol: ABR
  Gene Name: active BCR-related
  Uniprot ID: Q12979
  ENST ID: ENST00000612118
  CDS Start-End: 148-2727
gccccgcgctcctcccggggacctggttcccggcctcctcgcccctccgcgctcgcaacttcggcctcccccggctcccgcccgctctccctcctttgttgcgcgatgagggtcgggtttcggatctgaccgagccgccgccgcgggatggagccgctcagccaccggggcctgccgcgcctgtcctggatcgacaccctctacagcaacttcagctacgggacggacgagtacgacggagaggggaatgaggagcagaaggggcccccggagggctcagagaccatgccgtacatcgatgagtcgcccaccatgtccccgcagctcagcgcccgcagccagggcgggggggatggcgtctccccgactccacctgagggactggctcctggggtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaagctggccagccagctcggtgtgtacaaagcgtttgtcgataactataaagtcgctctggagacagctgagaagtgcagccagtccaacaaccagttccagaagatctcagaggaactcaaagtgaaaggtcccaaggactccaaggacagccacacgtctgtcaccatggaagctctgctctacaagcccattgaccgggtcactcggagcaccctagtcctacacgacctgctgaagcacacacctgtggaccaccccgactacccgctgctgcaggatgccctccgcatctcccagaacttcctgtccagcatcaacgaggacatcgacccccgccggactgcagtgacaacgcccaagggggagacgcgacagctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggaatctgaggccagcccccaggtgcaccccttcccagaccatgagctggaggacatgaagatgaagatctctgccctcaagagtgaaatccagaaggagaaagccaacaaaggccagagccgggccatcgagcgcctgaagaagaagatgtttgagaatgagttcctgctgctgctcaactcccccacaatcccgttcaggatccacaatcggaatggaaagagttacctgttcctactgtcctcggactacgagaggtcagagtggagagaagcaattcagaaactacagaagaaggatctccaggcctttgtcctgagctcagtggagctccaggtgctcacaggatcctgtttcaagcttaggactgtacacaacattcctgtcaccagcaataaagacgacgatgagtctccaggactctatggcttccttcatgtcatcgtccactctgccaagggatttaagcaatcagccaacctgtactgtaccctggaggtggattccttcggctattttgtcagcaaagccaaaaccagggtgttccgggacacagcggagcccaagtgggatgaggagtttgagatcgagctggagggctcccagtccctgaggatcctgtgctatgagaagtgctatgacaagaccaaggtcaacaaggacaacaatgagatcgtggacaagatcatgggcaaaggacagatccagctggacccacaaaccgtggagaccaagaactggcacacggacgtgattgagatgaacgggatcaaagtggaattttccatgaaattcaccagccgagatatgagcctgaagaggaccccgtccaaaaagcagaccggcgtcttcggtgtgaagatcagcgtggtgacgaagcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcaggtccaggtcctcctctactacctgcagcacccccccatttccttcgcagaactcaagcggaacacactgtacttctccaccgacgtgtagcccgaggcagggtggctgcgggcgggtggtggaaccagcccctccagcctggggtccaactcagacttgaaagactgcaatagaaaactcccaaacccagcactccagactcgagggaagccagcttccaagaactggaatgcgtacgtcttttgtgccaccttgtacaaagccggctgcccagccccagcctcaccaccgcatcccacctcctgccctccatacctctagttgtgtctgatgctccgtgctgttcgggaattgttttatgtacacttgtcaggcagaaaaggtagtgaccggcccggcgtgggcacacagacagcccgctttgttctttcatttcctccagcactttctttccgcctgagtccagcccaaggccttttattttgcgctgtgtaactgctgccagcttctctcttggccctgctcccagatggcggtctcctggcagcctcccctcagtcttcctccacccgctcttccttcccagcctgcctgcatgcatgtgcacccttggtcttcgctccatcgccttgaaagctctgaagaggccctgggttgccgcggcagcagtggtctgtttgatgctgccgtttgccgctgccggcccctcctcagactccgcctttgggagcacacctgctttgccttgctgcctgtgcaaatgttggacaagcagacacactcacactcgtccccagcttagcacagagctggagcgcccatttctggaattttccgtttgggaatctccacttctggggtttacctgttcggcctcctgtctatcagtgaggcatctctgactgtttcttctactgcttttcagttcccttccctgctgttctatttcctttgagtgtaaagactcacaggtgacctgctatcgagatagccagagggtcaggagagaatgggggaggaggcggtcaggctgctgaggaaacaccacaggctgaacgggggaggaatgcacatgccacgctgggtgtcccgggtcgcggggaggcagctcagctcttaggagcaagttgtgggggcttttcaagaggggccaggcttcctggagggtgactgatgtggccgaagcaggtgtccaggcaggtaggctgcagccaggagctccctggcaccgcaggacctcgtggtactcttgccttagattttacacacactccacagccaagcactgccacggtcctccaggacctgggaagcaaaggcacaggcccacggtggccagccattgtggtgccgccccagcttctggatacagccttttgggtaaacactgggaactccagaagttgtggggagagtggggaatcagacagccgcctctaggggctgggttctgctggggcctccttgttggtgctgtaggcacccgccagggagcagggacccgacttgcagacgcattgcccggtactaggaaggagtgaggtgtgttcccaccgtacacttcccacacgagctgcggctgccagcctcgggccatcagcctaggagagcagatgcagctccaggggctcgacttatagccagttacagctccccggctcttctgtgtggcagagcgtcgtttccgggccctcagggctggggagctcagttcccattgcttgtgctcagggctgagtcttaaagaagggtttgccggccctaacgctgcagcgcgtgcgcggtgagaggccctttttgagcctgtttactcctgtggccttgggcagaacagtaaatactctgtgcacggaggaaagacatgcccaagaggaaggaagtactgaccatcggctgcctgtgagcagcttagcaaggagcccttgctccctgggaaaggcggtgaacttgagtctaaagatgcagtgcctggcccttcctaaggtccctgcctggcatccgagtgtcggtgtgtggcacagaaggctcctgcttgcttccaaagtgatggacaggaaggggcagagtgagtcacggcccagactgggcaccttcgcgtctcagcctcagggagccccacagccccaagctcgctgaggcaacgtgagaacaggctatgggaaggctgcaaaggctgagaaatgcaaaggctcatatttataaatcccacccccagagtggggagggtcaggtgccagacctggactaaactgcaccaaggaaacacccagcagggtctcctgtgagccggggaccatgcagcccgaaacctccagtcactgcgcccggcaggagtcaggagccagggactgtgcagcctggaacctccagtcactgtgcccagcagggtgggctgtgcccagcaggagtcaggctaagaaacgccaggtctgcctgttcttgctgggcaatggctgatggctgccagtttctgctgatacacaggtaggatgggacccttcatgaatatctgactttaataagttggtaaggatatatttttttgtctatgttctgtttcaacttatgtagattattataaattgatgtaaaccacgtgagaggaaaatgttaataaaaaatgcaaagccccatcatttgcacaaaactca

SEQ ID NO: 104182 - DNA, 2673 bp, Homo sapiens
  Payload ID: 472
  Gene Symbol: ABR
  Gene Name: active BCR-related
  Uniprot ID: Q12979
  ENST ID: ENST00000611021
  CDS Start-End: 33-2501
ttcctgtctgccctccgcgggctccggctgccatggaggaggaagaggaggcgataggcttgctggacaaggttctggaggacgaagatgtgtttctcctggaggagtgcgagctgggaaccccgaccagccccggctcagggtcccccttcctggtggctgtgaaggtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaagctggccagccagctcggtgtgtacaaagcgtttgtcgataactataaagtcgctctggagacagctgagaagtgcagccagtccaacaaccagttccagaagatctcagaggaactcaaagtgaaaggtcccaaggactccaaggacagccacacgtctgtcaccatggaagctctgctctacaagcccattgaccgggtcactcggagcaccctagtcctacacgacctgctgaagcacacacctgtggaccaccccgactacccgctgctgcaggatgccctccgcatctcccagaacttcctgtccagcatcaacgaggacatcgacccccgccggactgcagtgacaacgcccaagggggagacgcgacagctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggaatctgaggccagcccccaggtgcaccccttcccagaccatgagctggaggacatgaagatgaagatctctgccctcaagagtgaaatccagaaggagaaagccaacaaaggccagagccgggccatcgagcgcctgaagaagaagatgtttgagaatgagttcctgctgctgctcaactcccccacaatcccgttcaggatccacaatcggaatggaaagagttacctgttcctactgtcctcggactacgagaggtcagagtggagagaagcaattcagaaactacagaagaaggatctccaggcctttgtcctgagctcagtggagctccaggtgctcacaggatcctgtttcaagcttaggactgtacacaacattcctgtcaccagcaataaagacgacgatgagtctccaggactctatggcttccttcatgtcatcgtccactctgccaagggatttaagcaatcagccaacctgtactgtaccctggaggtggattccttcggctattttgtcagcaaagccaaaaccagggtgttccgggacacagcggagcccaagtgggatgaggagtttgagatcgagctggagggctcccagtccctgaggatcctgtgctatgagaagtgctatgacaagaccaaggtcaacaaggacaacaatgagatcgtggacaagatcatgggcaaaggacagatccagctggacccacaaaccgtggagaccaagaactggcacacggacgtgattgagatgaacgggatcaaagtggaattttccatgaaattcaccagccgagatatgagcctgaagaggaccccgtccaaaaagcagaccggcgtcttcggtgtgaagatcagcgtggtgacgaagcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcaggtccaggtcctcctctactacctgcagcacccccccatttccttcgcagaactcaagcggaacacactgtacttctccaccgacgtgtagcccgaggcagggtggctgcgggcgggtggtggaaccagcccctccagcctggggtccaactcagacttgaaagactgcaatagaaaactcccaaacccagcactccagactcgagggaagccagcttccaagaactggaatgcgtacgtcttttgtgccaccttgtacaaag

SEQ ID NO: 104183 - DNA, 1049 bp, Homo sapiens; identical to SEQ ID NO: 104165
  Payload ID: 472
  Gene Symbol: ABR
  Gene Name: active BCR-related
  Uniprot ID: Q12979
  ENST ID: ENST00000611009
  CDS Start-End: 98-1030

SEQ ID NO: 104184 - DNA, 4887 bp, Homo sapiens
  Payload ID: 472
  Gene Symbol: ABR
  Gene Name: active BCR-related
  ENST ID: ENST00000620170
  CDS Start-End: 1-2334
gtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaagctggccagccagctcggtgtgtacaaagcgtttgtcgataactataaagtcgctctggagacagctgagaagtgcagccagtccaacaaccagttccagaagatctcagaggaactcaaagtgaaaggtcccaaggactccaaggacagccacacgtctgtcaccatggaagctctgctctacaagcccattgaccgggtcactcggagcaccctagtcctacacgacctgctgaagcacacacctgtggaccaccccgactacccgctgctgcaggatgccctccgcatctcccagaacttcctgtccagcatcaacgaggacatcgacccccgccggactgcagtgacaacgcccaagggggagacgcgacagctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggaatctgaggccagcccccaggtgcaccccttcccagaccatgagctggaggacatgaagatgaagatctctgccctcaagagtgaaatccagaaggagaaagccaacaaaggccagagccgggccatcgagcgcctgaagaagaagatgtttgagaatgagttcctgctgctgctcaactcccccacaatcccgttcaggatccacaatcggaatggaaagagttacctgttcctactgtcctcggactacgagaggtcagagtggagagaagcaattcagaaactacagaagaaggatctccaggcctttgtcctgagctcagtggagctccaggtgctcacaggatcctgtttcaagcttaggactgtacacaacattcctgtcaccagcaataaagacgacgatgagtctccaggactctatggcttccttcatgtcatcgtccactctgccaagggatttaagcaatcagccaacctgtactgtaccctggaggtggattccttcggctattttgtcagcaaagccaaaaccagggtgttccgggacacagcggagcccaagtgggatgaggagtttgagatcgagctggagggctcccagtccctgaggatcctgtgctatgagaagtgctatgacaagaccaaggtcaacaaggacaacaatgagatcgtggacaagatcatgggcaaaggacagatccagctggacccacaaaccgtggagaccaagaactggcacacggacgtgattgagatgaacgggatcaaagtggaattttccatgaaattcaccagccgagatatgagcctgaagaggaccccgtccaaaaagcagaccggcgtcttcggtgtgaagatcagcgtggtgacgaagcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcaggtccaggtcctcctctactacctgcagcacccccccatttccttcgcagaactcaagcggaacacactgtacttctccaccgacgtgtagcccgaggcagggtggctgcgggcgggtggtggaaccagcccctccagcctggggtccaactcagacttgaaagactgcaatagaaaactcccaaacccagcactccagactcgagggaagccagcttccaagaactggaatgcgtacgtcttttgtgccaccttgtacaaagccggctgcccagccccagcctcaccaccgcatcccacctcctgccctccatacctctagttgtgtctgatgctccgtgctgttcgggaattgttttatgtacacttgtcaggcagaaaaggtagtgaccggcccggcgtgggcacacagacagcccgctttgttctttcatttcctccagcactttctttccgcctgagtccagcccaaggccttttattttgcgctgtgtaactgctgccagcttctctcttggccctgctcccagatggcggtctcctggcagcctcccctcagtcttcctccacccgctcttccttcccagcctgcctgcatgcatgtgcacccttggtcttcgctccatcgccttgaaagctctgaagaggccctgggttgccgcggcagcagtggtctgtttgatgctgccgtttgccgctgccggcccctcctcagactccgcctttgggagcacacctgctttgccttgctgcctgtgcaaatgttggacaagcagacacactcacactcgtccccagcttagcacagagctggagcgcccatttctggaattttccgtttgggaatctccacttctggggtttacctgttcggcctcctgtctatcagtgaggcatctctgactgtttcttctactgcttttcagttcccttccctgctgttctatttcctttgagtgtaaagactcacaggtgacctgctatcgagatagccagagggtcaggagagaatgggggaggaggcggtcaggctgctgaggaaacaccacaggctgaacgggggaggaatgcacatgccacgctgggtgtcccgggtcgcggggaggcagctcagctcttaggagcaagttgtgggggcttttcaagaggggccaggcttcctggagggtgactgatgtggccgaagcaggtgtccaggcaggtaggctgcagccaggagctccctggcaccgcaggacctcgtggtactcttgccttagattttacacacactccacagccaagcactgccacggtcctccaggacctgggaagcaaaggcacaggcccacggtggccagccattgtggtgccgccccagcttctggatacagccttttgggtaaacactgggaactccagaagttgtggggagagtggggaatcagacagccgcctctaggggctgggttctgctggggcctccttgttggtgctgtaggcacccgccagggagcagggacccgacttgcagacgcattgcccggtactaggaaggagtgaggtgtgttcccaccgtacacttcccacacgagctgcggctgccagcctcgggccatcagcctaggagagcagatgcagctccaggggctcgacttatagccagttacagctccccggctcttctgtgtggcagagcgtcgtttccgggccctcagggctggggagctcagttcccattgcttgtgctcagggctgagtcttaaagaagggtttgccggccctaacgctgcagcgcgtgcgcggtgagaggccctttttgagcctgtttactcctgtggccttgggcagaacagtaaatactctgtgcacggaggaaagacatgcccaagaggaaggaagtactgaccatcggctgcctgtgagcagcttagcaaggagcccttgctccctgggaaaggcggtgaacttgagtctaaagatgcagtgcctggcccttcctaaggtccctgcctggcatccgagtgtcggtgtgtggcacagaaggctcctgcttgcttccaaagtgatggacaggaaggggcagagtgagtcacggcccagactgggcaccttcgcgtctcagcctcagggagccccacagccccaagctcgctgaggcaacgtgagaacaggctatgggaaggctgcaaaggctgagaaatgcaaaggctcatatttataaatcccacccccagagtggggagggtcaggtgccagacctggactaaactgcaccaaggaaacacccagcagggtctcctgtgagccggggaccatgcagcccgaaacctccagtcactgcgcccggcaggagtcaggagccagggactgtgcagcctggaacctccagtcactgtgcccagcagggtgggctgtgcccagcaggagtcaggctaagaaacgccaggtctgcctgttcttgctgggcaatggctgatggctgccagtttctgctgatacacaggtaggatgggacccttcatgaatatctgactttaataagttggtaaggatatatttttttgtctatgttctgtttcaacttatgtagattattataaattgatgtaaaccacgtgagaggaaaatgttaataaaaaatgcaaagccccatcatttgcac

SEQ ID NO: 104185 - DNA, 466 bp, Homo sapiens
  Payload ID: 472
  Gene Symbol: ABR
  Gene Name: active BCR-related
  ENST ID: ENST00000627795
  CDS Start-End: 78-466
acttcagctacgggacggacgagtacgacggagaggggaatgaggagcagaaggggcccccggagggctcagagaccatgccgtacatcgatgagtcgcccaccatgtccccgcagctcagcgcccgcagccagggcgggggggatggcgtctccccgactccacctgagggactggctcctggggtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaa

SEQ ID NO: 104186 - DNA, 760 bp, Homo sapiens
  Payload ID: 472
  Gene Symbol: ABR
  Gene Name: active BCR-related
  ENST ID: ENST00000627424
  CDS Start-End: 264-760
agctacaaacgtgctcctctttaggatgccagcaggctgctggctccctccctccctacccctcctccccttccccttccctcctctcctcgccacgcgcctccctcccctcccccttgctggaagagcactccggagcggctgcccgatgctggagtccgtgcggcagcatcagcaaggtggctgagtggccgggctgctggtgggcgccggggagcctggagcgatggctgcacgctcccgccgcggggacagaggctgccatggagattctcctcattattcgcttctgctgtaactgcacctatggtaacccagctctgctctacaagcccattgaccgggtcactcggagcaccctagtcctacacgacctgctgaagcacacacctgtggaccaccccgactacccgctgctgcaggatgccctccgcatctcccagaacttcctgtccagcatcaacgaggacatcgacccccgccggactgcagtgacaacgcccaagggggagacgcgacagctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggaatctgaggccagcccccaggtgcaccccttcccagaccatgagctggaggacatgaa

SEQ ID NO: 104187 - DNA, 566 bp, Homo sapiens
  Payload ID: 472
  Gene Symbol: ABR
  Gene Name: active BCR-related
  ENST ID: ENST00000626570
  CDS Start-End: 1-566
gaagacctctgcagggaagcaccagcagtatgactgtaagtggtacatccccctggccgacctggtgtttccatcccccgaggaatctgaggccagcccccaggtgcaccccttcccagaccatgagctggaggacatgaagatgaagatctctgccctcaagagtgaaatccagaaggagaaagccaacaaaggccagagccgggccatcgagcgcctgaagaagaagatgtttgagaatgagttcctgctgctgctcaactcccccacaatcccgttcaggatccacaatcggaatggaaagagttacctgttcctactgtcctcggactacgagaggtcagagtggagagaagcaattcagaaactacagaagaaggatctccaggcctttgtcctgagctcagtggagctccaggtgctcacaggatcctgtttcaagcttaggactgtacacaacattcctgtcaccagcaataaagacgacctgtactgtaccctggaggtggattccttcggctattttgtcagcaaagccaaaaccagggtgttccgggacacagcgg

SEQ ID NO: 104188 - DNA, 151 bp, Homo sapiens
  Payload ID: 472
  Gene Symbol: ABR
  Gene Name: active BCR-related
  ENST ID: ENST00000630524
  CDS Start-End: 1-151
gtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcacca

SEQ ID NO: 104189 - DNA, 850 bp, Homo sapiens; identical to SEQ ID NO: 104176
  Payload ID: 472
  Gene Symbol: ABR
  Gene Name: active BCR-related
  ENST ID: ENST00000625562
  CDS Start-End: 1-575

SEQ ID NO: 104190 - DNA, 281 bp, Homo sapiens
  Payload ID: 472
  Gene Symbol: ABR
  Gene Name: active BCR-related
  ENST ID: ENST00000630420
  CDS Start-End: 1-281
gtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaa

SEQ ID NO: 104191 - DNA, 477 bp, Homo sapiens
  Payload ID: 472
  Gene Symbol: ABR
  Gene Name: active BCR-related
  ENST ID: ENST00000630943
  CDS Start-End: 78-477
acttcagctacgggacggacgagtacgacggagaggggaatgaggagcagaaggggcccccggagggctcagagaccatgccgtacatcgatgagtcgcccaccatgtccccgcagctcagcgcccgcagccagggcgggggggatggcgtctccccgactccacctgagggactggctcctgggcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaagctggccagccagctcggtgtgtacaaagcgtttgtcgataactataaagtcgctctggagacagctgagaagtgcagccagtccaacaaccagttccagaagatctcag

SEQ ID NO: 104192 - DNA, 3196 bp, Homo sapiens
  Payload ID: 472
  Gene Symbol: ABR
  Gene Name: active BCR-related
  Uniprot ID: Q12979
  ENST ID: ENST00000627258
  CDS Start-End: 466-2907
ataaaaagcaaaatggtgactcagagaggagagttggaagcgtcctgcctcttgctcccactgttaatttttacacttggaattaggcagaaggcaaagaaaacagcagcttgaaatacgcggctgacatgctcttcatcgggtagcaacagcagagccgctcctccccgcctcccagcagccccggagcgggcagggcccggtgcctgctggctctcccccgcccctcaccaggcccaggcccccgcacagcccccgcccgggccaggcgtggatggtgcggccggggccatggctgccgggggccgccgccggcgcccactacgctaccagtccctggcagctctggtggaggattctcagtggcctttcttgttccttgtctcagacttcagctacgggacggacgagtacgacggagaggggaatgaggagcagaaggggcccccggagggctcagagaccatgccgtacatcgatgagtcgcccaccatgtccccgcagctcagcgcccgcagccagggcgggggggatggcgtctccccgactccacctgagggactggctcctggggtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaagctggccagccagctcggtgtgtacaaagcgtttgtcgataactataaagtcgctctggagacagctgagaagtgcagccagtccaacaaccagttccagaagatctcagaggaactcaaagtgaaaggtcccaaggactccaaggacagccacacgtctgtcaccatggaagctctgctctacaagcccattgaccgggtcactcggagcaccctagtcctacacgacctgctgaagcacacacctgtggaccaccccgactacccgctgctgcaggatgccctccgcatctcccagaacttcctgtccagcatcaacgaggacatcgacccccgccggactgcagtgacaacgcccaagggggagacgcgacagctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggaatctgaggccagcccccaggtgcaccccttcccagaccatgagctggaggacatgaagatgaagatctctgccctcaagagtgaaatccagaaggagaaagccaacaaaggccagagccgggccatcgagcgcctgaagaagaagatgtttgagaatgagttcctgctgctgctcaactcccccacaatcccgttcaggatccacaatcggaatggaaagagttacctgttcctactgtcctcggactacgagaggtcagagtggagagaagcaattcagaaactacagaagaaggatctccaggcctttgtcctgagctcagtggagctccaggtgctcacaggatcctgtttcaagcttaggactgtacacaacattcctgtcaccagcaataaagacgacgatgagtctccaggactctatggcttccttcatgtcatcgtccactctgccaagggatttaagcaatcagccaacctgtactgtaccctggaggtggattccttcggctattttgtcagcaaagccaaaaccagggtgttccgggacacagcggagcccaagtgggatgaggagtttgagatcgagctggagggctcccagtccctgaggatcctgtgctatgagaagtgctatgacaagaccaaggtcaacaaggacaacaatgagatcgtggacaagatcatgggcaaaggacagatccagctggacccacaaaccgtggagaccaagaactggcacacggacgtgattgagatgaacgggatcaaagtggaattttccatgaaattcaccagccgagatatgagcctgaagaggaccccgtccaaaaagcagaccggcgtcttcggtgtgaagatcagcgtggtgacgaagcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcaggtccaggtcctcctctactacctgcagcacccccccatttccttcgcagaactcaagcggaacacactgtacttctccaccgacgtgtagcccgaggcagggtggctgcgggcgggtggtggaaccagcccctccagcctggggtccaactcagacttgaaagactgcaatagaaaactcccaaacccagcactccagactcgagggaagccagcttccaagaactggaatgcgtacgtcttttgtgccaccttgtacaaagccggctgcccagccccagcctcaccaccgcatcccacctcctgccctccatacctctagttgtgtctgatgctccgtgctgttcgggaattgttttatgtacacttgtcaggcagaa

SEQ ID NO: 104193 - DNA, 690 bp, Homo sapiens; identical to SEQ ID NO: 104171
  Payload ID: 472
  Gene Symbol: ABR
  Gene Name: active BCR-related
  ENST ID: ENST00000628370
  CDS Start-End: 186-690

SEQ ID NO: 104194 - DNA, 2673 bp, Homo sapiens; identical to SEQ ID NO: 104182
  Payload ID: 472
  Gene Symbol: ABR
  Gene Name: active BCR-related
  Uniprot ID: Q12979
  ENST ID: ENST00000625740
  CDS Start-End: 33-2501

SEQ ID NO: 104195 - DNA, 690 bp, Homo sapiens; identical to SEQ ID NO: 104171
  Payload ID: 472
  Gene Symbol: ABR
  Gene Name: active BCR-related
  ENST ID: ENST00000628817
  CDS Start-End: 186-690

SEQ ID NO: 104196 - DNA, 557 bp, Homo sapiens
  Payload ID: 472
  Gene Symbol: ABR
  Gene Name: active BCR-related
  ENST ID: ENST00000628400
  CDS Start-End: 1-63
gagaccaagaactggcacacggacgtgattgagatgaacggggtgagccggggatgggaatgatcagtggcgtgagccgggaggtggaacgtctgtgcagcagatcaaagtggaattttccatgaaattcaccagccgagatatgagcctgaagaggaccccgtccaaaaagcagaccggcgtcttcggtgtgaagatcagcgtggtgacgaagcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacc

SEQ ID NO: 104197 - DNA, 563 bp, Homo sapiens; identical to SEQ ID NO: 104169
  Payload ID: 472
  Gene Symbol: ABR
  Gene Name: active BCR-related
  ENST ID: ENST00000627848
  CDS Start-End: 62-523

SEQ ID NO: 104198 - DNA, 292 bp, Homo sapiens
  Payload ID: 472
  Gene Symbol: ABR
  Gene Name: active BCR-related
  ENST ID: ENST00000629473
  CDS Start-End: 1-292
cccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaagctggccagccagctcggtgtgtacaaagcgtttgtcgataactataaagtcgctctggagacagctgagaagtgcagccagtccaacaaccagttccagaagatctcag

SEQ ID NO: 104199 - DNA, 597 bp, Homo sapiens; identical to SEQ ID NO: 104168
  Payload ID: 472
  Gene Symbol: ABR
  Gene Name: active BCR-related
  ENST ID: ENST00000627499
  CDS Start-End: 339-597

SEQ ID NO: 104200 - DNA, 2623 bp, Homo sapiens
  Payload ID: 472
  Gene Symbol: ABR
  Gene Name: active BCR-related
  ENST ID: ENST00000631205
  CDS Start-End: 1-2334
gtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaagctggccagccagctcggtgtgtacaaagcgtttgtcgataactataaagtcgctctggagacagctgagaagtgcagccagtccaacaaccagttccagaagatctcagaggaactcaaagtgaaaggtcccaaggactccaaggacagccacacgtctgtcaccatggaagctctgctctacaagcccattgaccgggtcactcggagcaccctagtcctacacgacctgctgaagcacacacctgtggaccaccccgactacccgctgctgcaggatgccctccgcatctcccagaacttcctgtccagcatcaacgaggacatcgacccccgccggactgcagtgacaacgcccaagggggagacgcgacagctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggaatctgaggccagcccccaggtgcaccccttcccagaccatgagctggaggacatgaagatgaagatctctgccctcaagagtgaaatccagaaggagaaagccaacaaaggccagagccgggccatcgagcgcctgaagaagaagatgtttgagaatgagttcctgctgctgctcaactcccccacaatcccgttcaggatccacaatcggaatggaaagagttacctgttcctactgtcctcggactacgagaggtcagagtggagagaagcaattcagaaactacagaagaaggatctccaggcctttgtcctgagctcagtggagctccaggtgctcacaggatcctgtttcaagcttaggactgtacacaacattcctgtcaccagcaataaagacgacgatgagtctccaggactctatggcttccttcatgtcatcgtccactctgccaagggatttaagcaatcagccaacctgtactgtaccctggaggtggattccttcggctattttgtcagcaaagccaaaaccagggtgttccgggacacagcggagcccaagtgggatgaggagtttgagatcgagctggagggctcccagtccctgaggatcctgtgctatgagaagtgctatgacaagaccaaggtcaacaaggacaacaatgagatcgtggacaagatcatgggcaaaggacagatccagctggacccacaaaccgtggagaccaagaactggcacacggacgtgattgagatgaacgggatcaaagtggaattttccatgaaattcaccagccgagatatgagcctgaagaggaccccgtccaaaaagcagaccggcgtcttcggtgtgaagatcagcgtggtgacgaagcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcaggtccaggtcctcctctactacctgcagcacccccccatttccttcgcagaactcaagcggaacacactgtacttctccaccgacgtgtagcccgaggcagggtggctgcgggcgggtggtggaaccagcccctccagcctggggtccaactcagacttgaaagactgcaatagaaaactcccaaacccagcactccagactcgagggaagccagcttccaagaactggaatgcgtacgtcttttgtgccaccttgtacaaagccggctgcccagccccagcctcaccaccgcatcccacctcctgccctccatacctctagttgtgtctgatgctccgtgctgttcgggaattgttttatgtacacttgtcaggcagaa

SEQ ID NO: 104201 - DNA, 637 bp, Homo sapiens; identical to SEQ ID NO: 104172
  Payload ID: 472
  Gene Symbol: ABR
  Gene Name: active BCR-related
  ENST ID: ENST00000629906
  CDS Start-End: 1-353

SEQ ID NO: 104202 - DNA, 158 bp, Homo sapiens
  Payload ID: 472
  Gene Symbol: ABR
  Gene Name: active BCR-related
  ENST ID: ENST00000625685
  CDS Start-End: 1-158
gtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagca

SEQ ID NO: 104203 - DNA, 563 bp, Homo sapiens; identical to SEQ ID NO: 104169
  Payload ID: 472
  Gene Symbol: ABR
  Gene Name: active BCR-related
  ENST ID: ENST00000626654
  CDS Start-End: 62-523

SEQ ID NO: 104204 - DNA, 760 bp, Homo sapiens; identical to SEQ ID NO: 104186
  Payload ID: 472
  Gene Symbol: ABR
  Gene Name: active BCR-related
  ENST ID: ENST00000630582
  CDS Start-End: 264-760

SEQ ID NO: 104205 - DNA, 618 bp, Homo sapiens
  Payload ID: 472
  Gene Symbol: ABR
  Gene Name: active BCR-related
  ENST ID: ENST00000575770
  CDS Start-End: 1-150
ggaaagagttacctgttcctactgtcctcggactacgagaggtcagagtggagagaagcaattcagaaactacagaagaagggtaaattcctgcctcttccacgctccccaatgatgtccgtggcattgatgggccttttgtatttctaagcgtttcatgtccagtatcacgtctttggccctcgcagtcaccctcagaggtgccaggatctccaggcctttgtcctgagctcagtggagctccaggtgctcacaggatcctgtttcaagcttaggactgtacacaacattcctgtcaccagcaataaagacgacgatgagtctccaggactctatggcttccttcatgtcatcgtccactctgccaagggatttaagcaatcagccaacctgtactgtaccctggaggtggattccttcggctattttgtcagcaaagccaaaaccagggtgttccgggacacagcggagcccaagtgggatgaggagtttgagatcgagctggagggctcccagtccctgaggatcctgtgctatgagaagtgctatgacaagaccaaggtcaacaaggacaacaatgagatcgtggacaagatcatgggcaaaggacagatccag

SEQ ID NO: 104206 - DNA, 2502 bp, Homo sapiens; identical to SEQ ID NO: 104179
  Payload ID: 472
  Gene Symbol: ABR
  Gene Name: active BCR-related
  ENST ID: ENST00000631260
  CDS Start-End: 288-2213

SEQ ID NO: 104207 - DNA, 549 bp, Homo sapiens; identical to SEQ ID NO: 104170
  Payload ID: 472
  Gene Symbol: ABR
  Gene Name: active BCR-related
  ENST ID: ENST00000627242
  CDS Start-End: 284-549

SEQ ID NO: 104208 - DNA, 850 bp, Homo sapiens; identical to SEQ ID NO: 104176
  Payload ID: 472
  Gene Symbol: ABR
  Gene Name: active BCR-related
  ENST ID: ENST00000627102
  CDS Start-End: 1-575

SEQ ID NO: 104209 - DNA, 637 bp, Homo sapiens; identical to SEQ ID NO: 104172
  Payload ID: 472
  Gene Symbol: ABR
  Gene Name: active BCR-related
  ENST ID: ENST00000628588
  CDS Start-End: 1-353

SEQ ID NO: 104210 - DNA, 557 bp, Homo sapiens; identical to SEQ ID NO: 104196
  Payload ID: 472
  Gene Symbol: ABR
  Gene Name: active BCR-related
  ENST ID: ENST00000630902
  CDS Start-End: 1-63

SEQ ID NO: 104211 - DNA, 618 bp, Homo sapiens
  Payload ID: 472
  Gene Symbol: ABR
  Gene Name: active BCR-related
  ENST ID: ENST00000631336
  CDS Start-End: 1-150
ggaaagagttacctgttcctactgtcctcggactacgagaggtcagagtggagagaagcaattcagaaactacagaagaagggtaaattcctgcctcttccacgctccccaatgatgtccgtggcattgatgggccttttgtttttctaagcgtttcatgtccagtatcacgtctttggccctcgcagtcaccctcagaggtgccaggatctccaggcctttgtcctgagctcagtggagctccaggtgctcacaggatcctgtttcaagcttaggactgtacacaacattcctgtcaccagcaataaagacgacgatgagtctccaggactctatggcttccttcatgtcatcgtccactctgccaagggatttaagcaatcagccaacctgtactgtaccctggaggtggattccttcggctattttgtcagcaaagccaaaaccagggtgttccgggacacagcggagcccaagtgggatgaggagtttgagatcgagctggagggctcccagtccctgaggatcctgtgctatgagaagtgctatgacaagaccaaggtcaacaaggacaacaatgagatcgtggacaagatcatgggcaaaggacagatccag

SEQ ID NO: 104212 - DNA, 1971 bp, Homo sapiens
  Payload ID: 473
  Gene Symbol: ACVRL1
  Gene Name: activin A receptor type II-like 1
  Uniprot ID: P37023
  ENST ID: ENST00000388922
  CDS Start-End: 284-1795
aggaaacggtttattaggagggagtggtggagctgggccaggcaggaagacgctggaataagaaacatttttgctccagcccccatcccagtcccgggaggctgccgcgccagctgcgccgagcgagcccctccccggctccagcccggtccggggccgcgcccggaccccagcccgccgtccagcgctggcggtgcaactgcggccgcgcggtggaggggaggtggccccggtccgccgaaggctagcgccccgccacccgcagagcgggcccagagggaccatgaccttgggctcccccaggaaaggccttctgatgctgctgatggccttggtgacccagggagaccctgtgaagccgtctcggggcccgctggtgacctgcacgtgtgagagcccacattgcaaggggcctacctgccggggggcctggtgcacagtagtgctggtgcgggaggaggggaggcacccccaggaacatcggggctgcgggaacttgcacagggagctctgcagggggcgccccaccgagttcgtcaaccactactgctgcgacagccacctctgcaaccacaacgtgtccctggtgctggaggccacccaacctccttcggagcagccgggaacagatggccagctggccctgatcctgggccccgtgctggccttgctggccctggtggccctgggtgtcctgggcctgtggcatgtccgacggaggcaggagaagcagcgtggcctgcacagcgagctgggagagtccagtctcatcctgaaagcatctgagcagggcgacagcatgttgggggacctcctggacagtgactgcaccacagggagtggctcagggctccccttcctggtgcagaggacagtggcacggcaggttgccttggtggagtgtgtgggaaaaggccgctatggcgaagtgtggcggggcttgtggcacggtgagagtgtggccgtcaagatcttctcctcgagggatgaacagtcctggttccgggagactgagatctataacacagtgttgctcagacacgacaacatcctaggcttcatcgcctcagacatgacctcccgcaactcgagcacgcagctgtggctcatcacgcactaccacgagcacggctccctctacgactttctgcagagacagacgctggagccccatctggctctgaggctagctgtgtccgcggcatgcggcctggcgcacctgcacgtggagatcttcggtacacagggcaaaccagccattgcccaccgcgacttcaagagccgcaatgtgctggtcaagagcaacctgcagtgttgcatcgccgacctgggcctggctgtgatgcactcacagggcagcgattacctggacatcggcaacaacccgagagtgggcaccaagcggtacatggcacccgaggtgctggacgagcagatccgcacggactgctttgagtcctacaagtggactgacatctgggcctttggcctggtgctgtgggagattgcccgccggaccatcgtgaatggcatcgtggaggactatagaccacccttctatgatgtggtgcccaatgaccccagctttgaggacatgaagaaggtggtgtgtgtggatcagcagacccccaccatccctaaccggctggctgcagacccggtcctctcaggcctagctcagatgatgcgggagtgctggtacccaaacccctctgcccgactcaccgcgctgcggatcaagaagacactacaaaaaattagcaacagtccagagaagcctaaagtgattcaatagcccaggagcacctgattcctttctgcctgcagggggctgggggggtggggggcagtggatggtgccctatctgggtagaggtagtgtgagtgtggtgtgtgctggggatgggcagctgcgcctgcctgctcggcccccagcccacccagccaaaaatacagctgggctgaaacctg

SEQ ID NO: 104213 - DNA, 1356 bp, Homo sapiens
  Payload ID: 473
  Gene Symbol: ACVRL1
  Gene Name: activin A receptor type II-like 1
  ENST ID: ENST00000419526
  CDS Start-End: 63-1052
aaaaaaaactctgtgatttcctctgggcaggagggagccacggccagcggctgtcacacttcatggctcttactccacctctcttgctcctctctgcagggaccatgaccttgggctcccccaggaaaggccttctgatgctgctgatggccttggtgacccagggaaaaggccgctatggcgaagtgtggcggggcttgtggcacggtgagagtgtggccgtcaagatcttctcctcgagggatgaacagtcctggttccgggagactgagatctataacacagtgttgctcagacacgacaacatcctaggcttcatcgcctcagacatgacctcccgcaactcgagcacgcagctgtggctcatcacgcactaccacgagcacggctccctctacgactttctgcagagacagacgctggagccccatctggctctgaggctagctgtgtccgcggcatgcggcctggcgcacctgcacgtggagatcttcggtacacagggcaaaccagccattgcccaccgcgacttcaagagccgcaatgtgctggtcaagagcaacctgcagtgttgcatcgccgacctgggcctggctgtgatgcactcacagggcagcgattacctggacatcggcaacaacccgagagtgggcaccaagcggtacatggcacccgaggtgctggacgagcagatccgcacggactgctttgagtcctacaagtggactgacatctgggcctttggcctggtgctgtgggagattgcccgccggaccatcgtgaatggcatcgtggaggactatagaccacccttctatgatgtggtgcccaatgaccccagctttgaggacatgaagaaggtggtgtgtgtggatcagcagacccccaccatccctaaccggctggctgcagacccggtcctctcaggcctagctcagatgatgcgggagtgctggtacccaaacccctctgcccgactcaccgcgctgcggatcaagaagacactacaaaaaattagcaacagtccagagaagcctaaagtgattcaatagcccaggagcacctgattcctttctgcctgcagggggctgggggggtggggggcagtggatggtgccctatctgggtagaggtagtgtgagtgtggtgtgtgctggggatgggcagctgcgcctgcctgctcggcccccagcccacccagccaaaaatacagctgggctgaaacctgatcccctgctgtctggcctgctcaaagcggcaggctccctgacgcctggctctctccccacccctatggccagcatggtgcaccccctaccactcccgggacaggatgcaaaagaggctccagagtca

SEQ ID NO: 104214 - DNA, 582 bp, Homo sapiens
  Payload ID: 473
  Gene Symbol: ACVRL1
  Gene Name: activin A receptor type II-like 1
  ENST ID: ENST00000547400
  CDS Start-End: 105-582
aggcggcagggagtagggaggcggcctccctgcctcccctccaaaaaaaactctgtgatttcctctgggcaggagggagccacggccagcggctgtcacacttcatggctcttactccacctctcttgctcctctctgcagggaccatgaccttgggctcccccaggaaaggccttctgatgctgctgatggccttggtgacccagggagaccctgtgaagccgtctcggggcccgctggtgacctgcacgtgtgagagcccacattgcaaggggcctacctgccggggggcctggtgcacagtagtgctggtgcgggaggaggggaggcacccccaggaacatcggggctgcgggaacttgcacagggagctctgcagggggcgccccaccgagttcgtcaaccactactgctgcgacagccacctctgcaaccacaacgtgtccctggtgctggagggaaaaggccgctatggcgaagtgtggcggggcttgtggcacggtgagagtgtggccgtcaagatcttctcctcgagggatgaacagtcctggttccgggagactgagatctataacacagtgt

SEQ ID NO: 104215 - DNA, 4121 bp, Homo sapiens
  Payload ID: 473
  Gene Symbol: ACVRL1
  Gene Name: activin A receptor type II-like 1
  ENST ID: ENST00000550683
  CDS Start-End: 102-1655
cggcagggagtagggaggcggcctccctgcctcccctccaaaaaaaactctgtgatttcctctgggcaggagggagccacggccagcggctgtcacacttcatggctcttactccacctctcttgctcctctctgcagggaccatgaccttgggctcccccaggaaaggccttctgatgctgctgatggccttggtgacccagggagaccctgtgaagccgtctcggggcccgctggtgacctgcacgtgtgagagcccacattgcaaggggcctacctgccggggggcctggtgcacagtagtgctggtgcgggaggaggggaggcacccccaggaacatcggggctgcgggaacttgcacagggagctctgcagggggcgccccaccgagttcgtcaaccactactgctgcgacagccacctctgcaaccacaacgtgtccctggtgctggaggccacccaacctccttcggagcagccgggaacagatggccagctggccctgatcctgggccccgtgctggccttgctggccctggtggccctgggtgtcctgggcctgtggcatgtccgacggaggcaggagaagcagcgtggcctgcacagcgagctgggagagtccagtctcatcctgaaagcatctgagcagggcgacagcatgttgggggacctcctggacagtgactgcaccacagggagtggctcagggctccccttcctggtgcagaggacagtggcacggcaggttgccttggtggagtgtgtgggaaaaggccgctatggcgaagtgtggcggggcttgtggcacggtgagagtgtggccgtcaagatcttctcctcgagggatgaacagtcctggttccgggagactgagatctataacacagtgttgctcagacacgacaacatcctaggcttcatcgcctcagacatgacctcccgcaactcgagcacgcagctgtggctcatcacgcactaccacgagcacggctccctctacgactttctgcagagacagacgctggagccccatctggctctgaggctagctgtgtccgcggcatgcggcctggcgcacctgcacgtggagatcttcggtacacagggcaaaccagccattgcccaccgcgacttcaagagccgcaatgtgctggtcaagagcaacctgcagtgttgcatcgccgacctgggcctggctgtgatgcactcacagggcagcgattacctggacatcggcaacaacccgagagtgggcaccaagcggtacatggcacccgaggtgctggacgagcagatccgcacggactgctttgagtcctacaagtggactgacatctgggcctttggcctggtgctgtgggagattgcccgccggaccatcgtgaatggcatcgtggaggactatagaccacccttctatgatgtggtgcccaatgaccccagctttgaggacatgaagaaggtggtgtgtgtggatcagcagacccccaccatccctaaccggctggctgcagacccggtcctctcaggcctagctcagatgatgcgggagtgctggtacccaaacccctctgcccgactcaccgcgctgcggatcaagaagacactacaaaaaattagcaacagtccagagaagcctaaagtgattcaatagcccaggagcacctgattcctttctgcctgcagggggctgggggggtggggggcagtggatggtgccctatctgggtagaggtagtgtgagtgtggtgtgtgctggggatgggcagctgcgcctgcctgctcggcccccagcccacccagccaaaaatacagctgggctgaaacctgatcccctgctgtctggcctgctcaaagcggcaggctccctgacgcctggctctctccccacccctatggccagcatggtgcaccccctaccactcccgggacaggatgcaaaagaggctccagagtcagagtgccaagccagggaatcccagtcccagactcagagcccgggcctgcactttgccccctgcccttgatcaaccccactgccccaccagagctgccagggtggcacagggccctgtccagcccctggcacacacttccctgccaggcctcagcctctagcataagctccagagagccagggcccatcagtttctctctgtggatttgtatctcagctccatgatgccttgggctttctgtctcctcaacaagagtgcagcttgctgaatgtcagctgcctgagagagctggggcctgacttactagggcattaaatcctaagaggtcctactgaggtgtggcaggatcacaggccagtggaaaaagggcaggtcagatgggcaaggcccaggactttcagattaactgagaggatatcgaggccaagcatggcagggggaaggtcagtgggtgtcaagagacccaggtctgaccccggatgtttgctccatgtgacaaaagcaggcctgtctcaggaccttttcttttcttttttccttctttttttttttgacacggagtttcgctcttgttgtccaggctagagtgcaatggcatgatcccagctcaccgcaacgtctacctcccaggttcaaatcattctcttgcctcagactcccgagtagctgggattacaggcacatgccaccatgcctggctaattttgtatatttagtagaaacagggtttcaccatgctggccatgctggtctcgaactcctgacctcaggtgttccacctacctcagcctcccaaagtgctggggttacaggtgtgagccatcgcgcctggccaggacctttgtttcttatctacatattggaagatttggtcctgatgtcctttgaggcttctttagctctagttctctgacacttcagcctatatcacagctaacttcttcagtctcatctattccttatgctccagcccctggcaatttgcctcaagatgggggtttgaaaataactttacctgactcaaggagtgtctggagcacctcctagtctaagtctgcaagctccagttcttgcctaaaaccatgccagtggccacccttgggctcagacagctctgggccttttgaccacaagccagcccctcgccctctctgtggcatagtcttctctgccccaggactgcagggcggcttcctccaaggcttccaaggctcaaaagaaatttggctccatccaagaaggctccagctcccctactggcccctggctcaggcccacacccctggccaggcccagagagtgtgtctcaggagaattcaatggctctagagagacacacagaaagtttggcatttggaaatttcaaggatgtatgtatgctcacgtatggagcaggttgtcctggtccctgggtgcagggaagtgggctgcagggaagtggattggaggggagcttgaggaatataaggagcgggggtggagactcaggctatggacaaggacagccccaaggttgggaagacctggccttagtcgtcctcagcctaggggcagggcagtgaagaaagctctccccgctcctgctgtaatgacccagagtagcctccccaggccggcatcttatgtgtgtcttccaccatcctcatggtggcacttttctaggcctgtctcccagcattgtgcaaggctcggaagagaaccaggaagtgaaactgggtgaaaacagaaagctcaatggatgggctaggttcccagatcattagggcagagtttgcacgtcctctggtcactggaatccacccagcccacgaatcatctccctcttgaaggattttatttctactgggttttggaacaaactcctgctgagaccccacagccagaaactgaaagcagcagctccccaaagcctggaaaatccctaagagaaggcctggggcaggaagtggagtgacaggggacaggtagagagaagggggcccaatggccagggagtgaaggaggtggcgttgctgagagcagtctgcacatgcttctgtctgagtgcaggaaggtgttccagggtcgaaattacacttctcgtacctggagacgctgtttgtgggagcactgggctcatgcctggcacacaataggtctgcaataaaccatggttaaatcct

SEQ ID NO: 104216 - DNA, 557 bp, Homo sapiens
  Payload ID: 473
  Gene Symbol: ACVRL1
  Gene Name: activin A receptor type II-like 1
  ENST ID: ENST00000551576
  CDS Start-End: 291-557
aaaacgcatctggattttgctagccccaaactctgccctcattgctgcaagcctcctagaccgaggacccccgggctgagggtgggcccccatcccagtcccgggaggctgccgcgccagctgcgccgagcgagcccctccccggctccagcccggtccggggccgcgcccggaccccagcccgccgtccagcgctggcggtgcaactgcggccgcgcggtggaggggaggtggccccggtccgccgaaggctagcgccccgccacccgcagagcgggcccagagggaccatgaccttgggctcccccaggaaaggccttctgatgctgctgatggccttggtgacccagggagaccctgtgaagccgtctcggggcccgctggtgacctgcacgtgtgagagcccacattgcaaggggcctacctgccggggggcctggtgcacagtagtgctggtgcgggaggaggggaggcacccccaggaacatcggggctgcgggaacttgcacagggagctctgcagggggcgccccaccgagttcgtcaaccactactgc

SEQ ID NO: 104217 - DNA, 609 bp, Homo sapiens
  Payload ID: 473
  Gene Symbol: ACVRL1
  Gene Name: activin A receptor type II-like 1
  ENST ID: ENST00000552678
  CDS Start-End: 1-490
gagccgcaatgtgctggtcaagagcaacctgcagtgttgcatcgccgacctgggcctggctgtgatgcactcacagggcagcgattacctggacatcggcaacaacccgagagtgggcaccaagcggtacatggcacccgaggtgctggacgagcagatccgcacggactgctttgagtcctacaagtggactgacatctgggcctttggcctggtgctgtgggagattgcccgccggaccatcgtgaatggcatcgtggaggactatagaccacccttctatgatgtggtgcccaatgaccccagctttgaggacatgaagaaggtggtgtgtgtggatcagcagacccccaccatccctaaccggctggctgcagacccggtgaggcctctgctgggactaggatggcgtggggtggtggctcatggctgggatttctgggcccaggaacttgtgtctgaggcctctgcttcatctcatagatactgagtgtcctggttagggcacctctctaggtactccctctttcaaccctggcccatgctccctgcccccagggccatctggtcattctgggattttaagaaccttcaccttccctgtgaaaa

SEQ ID NO: 104218 - DNA, 3047 bp, Homo sapiens
  Payload ID: 474
  Gene Symbol: ACVR1
  Gene Name: activin A receptor, type I
  Uniprot ID: Q04771
  ENST ID: ENST00000263640
  CDS Start-End: 431-1960
gaagagatgtgggcctctggggccgctggattcagtaacttccgtcgggttctagactggctcggctctgtccagtttgtgccagatagtctcccaccccctccccacccctcctttcccctggagatttgaacgctgcttgcatgggagaaaagctacttagagaagaaaacgttccacttagtaacagaagaaaagtcttggttaaaaagttgtcatgaatttggcttttggagagaggcagcaagcctggagcattggtaagcgtcacactgccaaagtgagagctgctggagaactcataatcccaggaacgcctcttctactctccgagtaccccagtgaccagagtgagagaagctctgaacgagggcacgcggcttgaaggactgtgggcagatgtgaccaagagcctgcattaagttgtacaatggtagatggagtgatgattcttcctgtgcttatcatgattgctctcccctcccctagtatggaagatgagaagcccaaggtcaaccccaaactctacatgtgtgtgtgtgaaggtctctcctgcggtaatgaggaccactgtgaaggccagcagtgcttttcctcactgagcatcaacgatggcttccacgtctaccagaaaggctgcttccaggtttatgagcagggaaagatgacctgtaagaccccgccgtcccctggccaagccgtggagtgctgccaaggggactggtgtaacaggaacatcacggcccagctgcccactaaaggaaaatccttccctggaacacagaatttccacttggaggttggcctcattattctctctgtagtgttcgcagtatgtcttttagcctgcctgctgggagttgctctccgaaaatttaaaaggcgcaaccaagaacgcctcaatccccgagacgtggagtatggcactatcgaagggctcatcaccaccaatgttggagacagcactttagcagatttattggatcattcgtgtacatcaggaagtggctctggtcttccttttctggtacaaagaacagtggctcgccagattacactgttggagtgtgtcgggaaaggcaggtatggtgaggtgtggaggggcagctggcaaggggagaatgttgccgtgaagatcttctcctcccgtgatgagaagtcatggttcagggaaacggaattgtacaacactgtgatgctgaggcatgaaaatatcttaggtttcattgcttcagacatgacatcaagacactccagtacccagctgtggttaattacacattatcatgaaatgggatcgttgtacgactatcttcagcttactactctggatacagttagctgccttcgaatagtgctgtccatagctagtggtcttgcacatttgcacatagagatatttgggacccaagggaaaccagccattgcccatcgagatttaaagagcaaaaatattctggttaagaagaatggacagtgttgcatagcagatttgggcctggcagtcatgcattcccagagcaccaatcagcttgatgtggggaacaatccccgtgtgggcaccaagcgctacatggcccccgaagttctagatgaaaccatccaggtggattgtttcgattcttataaaagggtcgatatttgggcctttggacttgttttgtgggaagtggccaggcggatggtgagcaatggtatagtggaggattacaagccaccgttctacgatgtggttcccaatgacccaagttttgaagatatgaggaaggtagtctgtgtggatcaacaaaggccaaacatacccaacagatggttctcagacccgacattaacctctctggccaagctaatgaaagaatgctggtatcaaaatccatccgcaagactcacagcactgcgtatcaaaaagactttgaccaaaattgataattccctcgacaaattgaaaactgactgttgacattttcatagtgtcaagaaggaagatttgacgttgttgtcattgtccagctgggacctaatgctggcctgactggttgtcagaatggaatccatctgtctccctccccaaatggctgctttgacaaggcagacgtcgtacccagccatgtgttggggagacatcaaaaccaccctaacctcgctcgatgactgtgaactgggcatttcacgaactgttcacactgcagagactaatgttggacagacactgttgcaaaggtagggactggaggaacacagagaaatcctaaaagagatctgggcattaagtcagtggctttgcatagctttcacaagtctcctagacactccccacgggaaactcaaggaggtggtgaatttttaatcagcaatattgcctgtgcttctcttctttattgcactaggaattctttgcattccttacttgcactgttactcttaattttaaagacccaacttgccaaaatgttggctgcgtactccactggtctgtctttggataataggaattcaatttggcaaaacaaaatgtaatgtcagactttgctgcattttacacatgtgctgatgtttacaatgatgccgaacattaggaattgtttatacacaactttgcaaattatttattacttgtgcacttagtagtttttacaaaactgctttgtgcatatgttaaagcttatttttatgtggtcttatgattttattacagaaatgtttttaacactatactctaaaatggacattttcttttattatcagttaaaatcacattttaagtgcttcacatttgtatgtgtgtagactgtaactttttttcagttcatatgcagaacgtatttagccattacccacgtgacaccaccgaatatattactgatttagaagcaaagatttcagtagaattttagtcctgaacgctacggggaaaatgcattttcttcagaattatccattacgtgcatttaaactctgccagaaaaaaataactattttgttttaatctactttttgtatttagtagttatttgtataaattaaataaactgttttcaagtcaaaca

SEQ ID NO: 104219 - DNA, 2084 bp, Homo sapiens
  Payload ID: 474
  Gene Symbol: ACVR1
  Gene Name: activin A receptor, type I
  Uniprot ID: Q04771
  ENST ID: ENST00000410057
  CDS Start-End: 340-1869
gaagcgaatagcgtttcagagatattgggcggctcaagggtcttactctgtcgcccagtctgtaatgcagtgctgtgaccatagcccactgcagcctccacctcccaggctcaagcagtccttcccccctcgccctcatgaatagctgggactacagcctggagcattggtaagcgtcacactgccaaagtgagagctgctggagaactcataatcccaggaacgcctcttctactctccgagtaccccagtgaccagagtgagagaagctctgaacgagggcacgcggcttgaaggactgtgggcagatgtgaccaagagcctgcattaagttgtacaatggtagatggagtgatgattcttcctgtgcttatcatgattgctctcccctcccctagtatggaagatgagaagcccaaggtcaaccccaaactctacatgtgtgtgtgtgaaggtctctcctgcggtaatgaggaccactgtgaaggccagcagtgcttttcctcactgagcatcaacgatggcttccacgtctaccagaaaggctgcttccaggtttatgagcagggaaagatgacctgtaagaccccgccgtcccctggccaagccgtggagtgctgccaaggggactggtgtaacaggaacatcacggcccagctgcccactaaaggaaaatccttccctggaacacagaatttccacttggaggttggcctcattattctctctgtagtgttcgcagtatgtcttttagcctgcctgctgggagttgctctccgaaaatttaaaaggcgcaaccaagaacgcctcaatccccgagacgtggagtatggcactatcgaagggctcatcaccaccaatgttggagacagcactttagcagatttattggatcattcgtgtacatcaggaagtggctctggtcttccttttctggtacaaagaacagtggctcgccagattacactgttggagtgtgtcgggaaaggcaggtatggtgaggtgtggaggggcagctggcaaggggagaatgttgccgtgaagatcttctcctcccgtgatgagaagtcatggttcagggaaacggaattgtacaacactgtgatgctgaggcatgaaaatatcttaggtttcattgcttcagacatgacatcaagacactccagtacccagctgtggttaattacacattatcatgaaatgggatcgttgtacgactatcttcagcttactactctggatacagttagctgccttcgaatagtgctgtccatagctagtggtcttgcacatttgcacatagagatatttgggacccaagggaaaccagccattgcccatcgagatttaaagagcaaaaatattctggttaagaagaatggacagtgttgcatagcagatttgggcctggcagtcatgcattcccagagcaccaatcagcttgatgtggggaacaatccccgtgtgggcaccaagcgctacatggcccccgaagttctagatgaaaccatccaggtggattgtttcgattcttataaaagggtcgatatttgggcctttggacttgttttgtgggaagtggccaggcggatggtgagcaatggtatagtggaggattacaagccaccgttctacgatgtggttcccaatgacccaagttttgaagatatgaggaaggtagtctgtgtggatcaacaaaggccaaacatacccaacagatggttctcagacccgacattaacctctctggccaagctaatgaaagaatgctggtatcaaaatccatccgcaagactcacagcactgcgtatcaaaaagactttgaccaaaattgataattccctcgacaaattgaaaactgactgttgacattttcatagtgtcaagaaggaagatttgacgttgttgtcattgtccagctgggacctaatgctggcctgactggttgtcagaatggaatccatctgtctccctccccaaatggctgctttgacaaggcagacgtcgtacccagccatgtgttggggagacatcaaaaccaccctaacctcgctcgatgactgtgaactgggcatttcacgaac

SEQ ID NO: 104220 - DNA, 2879 bp, Homo sapiens
  Payload ID: 474
  Gene Symbol: ACVR1
  Gene Name: activin A receptor, type I
  Uniprot ID: Q04771
  ENST ID: ENST00000409283
  CDS Start-End: 268-1797
gataaacggatccagggcctggttttcagttctataggacttgtccaagaagctatttgtattcatctatcatgaaagatcaaattacatgctaatattctgaaagtaacaccccgccagaaaccctccagcagcagtgaagtctatataaaaccaagccttggcaatttgcacattgccagttccgacagagtgtggtgttaaaaatatttaacaggtcatttttgaaccgtagaaaagaccctgacttaacttacatgttgtacaatggtagatggagtgatgattcttcctgtgcttatcatgattgctctcccctcccctagtatggaagatgagaagcccaaggtcaaccccaaactctacatgtgtgtgtgtgaaggtctctcctgcggtaatgaggaccactgtgaaggccagcagtgcttttcctcactgagcatcaacgatggcttccacgtctaccagaaaggctgcttccaggtttatgagcagggaaagatgacctgtaagaccccgccgtcccctggccaagccgtggagtgctgccaaggggactggtgtaacaggaacatcacggcccagctgcccactaaaggaaaatccttccctggaacacagaatttccacttggaggttggcctcattattctctctgtagtgttcgcagtatgtcttttagcctgcctgctgggagttgctctccgaaaatttaaaaggcgcaaccaagaacgcctcaatccccgagacgtggagtatggcactatcgaagggctcatcaccaccaatgttggagacagcactttagcagatttattggatcattcgtgtacatcaggaagtggctctggtcttccttttctggtacaaagaacagtggctcgccagattacactgttggagtgtgtcgggaaaggcaggtatggtgaggtgtggaggggcagctggcaaggggagaatgttgccgtgaagatcttctcctcccgtgatgagaagtcatggttcagggaaacggaattgtacaacactgtgatgctgaggcatgaaaatatcttaggtttcattgcttcagacatgacatcaagacactccagtacccagctgtggttaattacacattatcatgaaatgggatcgttgtacgactatcttcagcttactactctggatacagttagctgccttcgaatagtgctgtccatagctagtggtcttgcacatttgcacatagagatatttgggacccaagggaaaccagccattgcccatcgagatttaaagagcaaaaatattctggttaagaagaatggacagtgttgcatagcagatttgggcctggcagtcatgcattcccagagcaccaatcagcttgatgtggggaacaatccccgtgtgggcaccaagcgctacatggcccccgaagttctagatgaaaccatccaggtggattgtttcgattcttataaaagggtcgatatttgggcctttggacttgttttgtgggaagtggccaggcggatggtgagcaatggtatagtggaggattacaagccaccgttctacgatgtggttcccaatgacccaagttttgaagatatgaggaaggtagtctgtgtggatcaacaaaggccaaacatacccaacagatggttctcagacccgacattaacctctctggccaagctaatgaaagaatgctggtatcaaaatccatccgcaagactcacagcactgcgtatcaaaaagactttgaccaaaattgataattccctcgacaaattgaaaactgactgttgacattttcatagtgtcaagaaggaagatttgacgttgttgtcattgtccagctgggacctaatgctggcctgactggttgtcagaatggaatccatctgtctccctccccaaatggctgctttgacaaggcagacgtcgtacccagccatgtgttggggagacatcaaaaccaccctaacctcgctcgatgactgtgaactgggcatttcacgaactgttcacactgcagagactaatgttggacagacactgttgcaaaggtagggactggaggaacacagagaaatcctaaaagagatctgggcattaagtcagtggctttgcatagctttcacaagtctcctagacactccccacgggaaactcaaggaggtggtgaatttttaatcagcaatattgcctgtgcttctcttctttattgcactaggaattctttgcattccttacttgcactgttactcttaattttaaagacccaacttgccaaaatgttggctgcgtactccactggtctgtctttggataataggaattcaatttggcaaaacaaaatgtaatgtcagactttgctgcattttacacatgtgctgatgtttacaatgatgccgaacattaggaattgtttatacacaactttgcaaattatttattacttgtgcacttagtagtttttacaaaactgctttgtgcatatgttaaagcttatttttatgtggtcttatgattttattacagaaatgtttttaacactatactctaaaatggacattttcttttattatcagttaaaatcacattttaagtgcttcacatttgtatgtgtgtagactgtaactttttttcagttcatatgcagaacgtatttagccattacccacgtgacaccaccgaatatattactgatttagaagcaaagatttcagtagaattttagtcctgaacgctacggggaaaatgcattttcttcagaattatccattacgtgcatttaaactctgccagaaaaaaataactattttgttttaatctactttttgtatttagtagttatttgtataaattaaataaactgttttcaagtc

SEQ ID NO: 104221 - DNA, 536 bp, Homo sapiens
  Payload ID: 474
  Gene Symbol: ACVR1
  Gene Name: activin A receptor, type I
  ENST ID: ENST00000413751
  CDS Start-End: 472-536
actccgcctcccccggctcagcccccggccgcggcgggacccgaggtgggctcagccttctttccttcaattcctgtttcagtctcattttcatggactggtccccaaacttgtctgcattggaagcacctggggagtttctagacctgagcctgtgcccacctcatgagggtcttactctgtcgcccagtctgtaatgcagtgctgtgaccatagcccactgcagcctccacctcccaggctcaagcagtccttcccccctcgccctcatgaatagctgggactacagcctggagcattggtaagcgtcacactgccaaagtgagagctgctggagaactcataatcccaggaacgcctcttctactctccgagtaccccagtgaccagagtgagagaagctctgaacgagggcacgcggcttgaaggactgtgggcagatgtgaccaagagcctgcattaagttgtacaatggtagatggagtgatgattcttcctgtgcttatcatgattgctctcccctcccctagtatgga

SEQ ID NO: 104222 - DNA, 550 bp, Homo sapiens
  Payload ID: 474
  Gene Symbol: ACVR1
  Gene Name: activin A receptor, type I
  ENST ID: ENST00000424669
  CDS Start-End: 337-550
ctgcagcgcccggctgcctcgcactccgcctcccccggctcagcccccggccgcggcgggacccgagagtttcgctcttgttgtccaggctggagtggaatggcgtgatctcggctcaccgtgatctcggctcaccgtaacctccgcctctcagcctggagcattggtaagcgtcacactgccaaagtgagagctgctggagaactcataatcccaggaacgcctcttctactctccgagtaccccagtgaccagagtgagagaagctctgaacgagggcacgcggcttgaaggactgtgggcagatgtgaccaagagcctgcattaagttgtacaatggtagatggagtgatgattcttcctgtgcttatcatgattgctctcccctcccctagtatggaagatgagaagcccaaggtcaaccccaaactctacatgtgtgtgtgtgaaggtctctcctgcggtaatgaggaccactgtgaaggccagcagtgcttttcctcactgagcatcaacgatggcttccacgtctaccagaaaggctgcttcc

SEQ ID NO: 104223 - DNA, 534 bp, Homo sapiens
  Payload ID: 474
  Gene Symbol: ACVR1
  Gene Name: activin A receptor, type I
  ENST ID: ENST00000440523
  CDS Start-End: 275-534
gcagccgcggaacaaaactgtcttgctttgggcctgaactgctggtgggatatggggggtgggggggcagaggcgtggagcgggggtctcagcctggagcattggtaagcgtcacactgccaaagtgagagctgctggagaactcataatcccaggaacgcctcttctactctccgagtaccccagtgaccagagtgagagaagctctgaacgagggcacgcggcttgaaggactgtgggcagatgtgaccaagagcctgcattaagttgtacaatggtagatggagtgatgattcttcctgtgcttatcatgattgctctcccctcccctagtatggaagatgagaagcccaaggtcaaccccaaactctacatgtgtgtgtgtgaaggtctctcctgcggtaatgaggaccactgtgaaggccagcagtgcttttcctcactgagcatcaacgatggcttccacgtctaccagaaaggctgcttccaggtttatgagcagggaaagatgacctgtaagaccccgccgtcccc

SEQ ID NO: 104224 - DNA, 531 bp, Homo sapiens
  Payload ID: 474
  Gene Symbol: ACVR1
  Gene Name: activin A receptor, type I
  ENST ID: ENST00000412025
  CDS Start-End: 270-531
ggtctatcggaagtttaaagcaatgcagcgggaagtaccttgcctttttgaagcgaatagcgtttcagagatattgggcggctcaagcctggagcattggtaagcgtcacactgccaaagtgagagctgctggagaactcataatcccaggaacgcctcttctactctccgagtaccccagtgaccagagtgagagaagctctgaacgagggcacgcggcttgaaggactgtgggcagatgtgaccaagagcctgcattaagttgtacaatggtagatggagtgatgattcttcctgtgcttatcatgattgctctcccctcccctagtatggaagatgagaagcccaaggtcaaccccaaactctacatgtgtgtgtgtgaaggtctctcctgcggtaatgaggaccactgtgaaggccagcagtgcttttcctcactgagcatcaacgatggcttccacgtctaccagaaaggctgcttccaggtttatgagcagggaaagatgacctgtaagaccccgccgtcccctg

SEQ ID NO: 104225 - DNA, 2861 bp, Homo sapiens
  Payload ID: 474
  Gene Symbol: ACVR1
  Gene Name: activin A receptor, type I
  Uniprot ID: Q04771
  ENST ID: ENST00000434821
  CDS Start-End: 250-1779
ctgcagcgcccggctgcctcgcactccgcctcccccggctcagcccccggccgcggcgggacccgagcctggagcattggtaagcgtcacactgccaaagtgagagctgctggagaactcataatcccaggaacgcctcttctactctccgagtaccccagtgaccagagtgagagaagctctgaacgagggcacgcggcttgaaggactgtgggcagatgtgaccaagagcctgcattaagttgtacaatggtagatggagtgatgattcttcctgtgcttatcatgattgctctcccctcccctagtatggaagatgagaagcccaaggtcaaccccaaactctacatgtgtgtgtgtgaaggtctctcctgcggtaatgaggaccactgtgaaggccagcagtgcttttcctcactgagcatcaacgatggcttccacgtctaccagaaaggctgcttccaggtttatgagcagggaaagatgacctgtaagaccccgccgtcccctggccaagccgtggagtgctgccaaggggactggtgtaacaggaacatcacggcccagctgcccactaaaggaaaatccttccctggaacacagaatttccacttggaggttggcctcattattctctctgtagtgttcgcagtatgtcttttagcctgcctgctgggagttgctctccgaaaatttaaaaggcgcaaccaagaacgcctcaatccccgagacgtggagtatggcactatcgaagggctcatcaccaccaatgttggagacagcactttagcagatttattggatcattcgtgtacatcaggaagtggctctggtcttccttttctggtacaaagaacagtggctcgccagattacactgttggagtgtgtcgggaaaggcaggtatggtgaggtgtggaggggcagctggcaaggggagaatgttgccgtgaagatcttctcctcccgtgatgagaagtcatggttcagggaaacggaattgtacaacactgtgatgctgaggcatgaaaatatcttaggtttcattgcttcagacatgacatcaagacactccagtacccagctgtggttaattacacattatcatgaaatgggatcgttgtacgactatcttcagcttactactctggatacagttagctgccttcgaatagtgctgtccatagctagtggtcttgcacatttgcacatagagatatttgggacccaagggaaaccagccattgcccatcgagatttaaagagcaaaaatattctggttaagaagaatggacagtgttgcatagcagatttgggcctggcagtcatgcattcccagagcaccaatcagcttgatgtggggaacaatccccgtgtgggcaccaagcgctacatggcccccgaagttctagatgaaaccatccaggtggattgtttcgattcttataaaagggtcgatatttgggcctttggacttgttttgtgggaagtggccaggcggatggtgagcaatggtatagtggaggattacaagccaccgttctacgatgtggttcccaatgacccaagttttgaagatatgaggaaggtagtctgtgtggatcaacaaaggccaaacatacccaacagatggttctcagacccgacattaacctctctggccaagctaatgaaagaatgctggtatcaaaatccatccgcaagactcacagcactgcgtatcaaaaagactttgaccaaaattgataattccctcgacaaattgaaaactgactgttgacattttcatagtgtcaagaaggaagatttgacgttgttgtcattgtccagctgggacctaatgctggcctgactggttgtcagaatggaatccatctgtctccctccccaaatggctgctttgacaaggcagacgtcgtacccagccatgtgttggggagacatcaaaaccaccctaacctcgctcgatgactgtgaactgggcatttcacgaactgttcacactgcagagactaatgttggacagacactgttgcaaaggtagggactggaggaacacagagaaatcctaaaagagatctgggcattaagtcagtggctttgcatagctttcacaagtctcctagacactccccacgggaaactcaaggaggtggtgaatttttaatcagcaatattgcctgtgcttctcttctttattgcactaggaattctttgcattccttacttgcactgttactcttaattttaaagacccaacttgccaaaatgttggctgcgtactccactggtctgtctttggataataggaattcaatttggcaaaacaaaatgtaatgtcagactttgctgcattttacacatgtgctgatgtttacaatgatgccgaacattaggaattgtttatacacaactttgcaaattatttattacttgtgcacttagtagtttttacaaaactgctttgtgcatatgttaaagcttatttttatgtggtcttatgattttattacagaaatgtttttaacactatactctaaaatggacattttcttttattatcagttaaaatcacattttaagtgcttcacatttgtatgtgtgtagactgtaactttttttcagttcatatgcagaacgtatttagccattacccacgtgacaccaccgaatatattactgatttagaagcaaagatttcagtagaattttagtcctgaacgctacggggaaaatgcattttcttcagaattatccattacgtgcatttaaactctgccagaaaaaaataactattttgttttaatctactttttgtatttagtagttatttgtataaattaaataaactgttttcaagtc

SEQ ID NO: 104226 - DNA, 564 bp, Homo sapiens
  Payload ID: 474
  Gene Symbol: ACVR1
  Gene Name: activin A receptor, type I
  ENST ID: ENST00000539637
  CDS Start-End: 347-564
actccgcctcccccggctcagcccccggccgcggcgggacccgagggtcttactctgtcgcccagtctgtaatgcagtgctgtgaccatagcccactgcagcctccacctcccaggctcaagcagtccttcccccctcgccctcatgaatagctgggactacagcctggagcattggtaagcgtcacactgccaaagtgagagctgctggagaactcataatcccaggaacgcctcttctactctccgagtaccccagtgaccagagtgagagaagctctgaacgagggcacgcggcttgaaggactgtgggcagatgtgaccaagagcctgcattaagttgtacaatggtagatggagtgatgattcttcctgtgcttatcatgattgctctcccctcccctagtatggaagatgagaagcccaaggtcaaccccaaactctacatgtgtgtgtgtgaaggtctctcctgcggtaatgaggaccactgtgaaggccagcagtgcttttcctcactgagcatcaacgatggcttccacgtctaccagaaaggctgcttccaggt

SEQ ID NO: 104227 - DNA, 4563 bp, Homo sapiens
  Payload ID: 475
  Gene Symbol: ACVR1B
  Gene Name: activin A receptor, type IB
  Uniprot ID: P36896
  ENST ID: ENST00000257963
  CDS Start-End: 78-1595
ggggaggcgccgggggcgcgcgcgcgcgcgctgggcgctgctgggctgcggcggcggcggcggcggcggtggttactatggcggagtcggccggagcctcctccttcttcccccttgttgtcctcctgctcgccggcagcggcgggtccgggccccggggggtccaggctctgctgtgtgcgtgcaccagctgcctccaggccaactacacgtgtgagacagatggggcctgcatggtttccattttcaatctggatgggatggagcaccatgtgcgcacctgcatccccaaagtggagctggtccctgccgggaagcccttctactgcctgagctcggaggacctgcgcaacacccactgctgctacactgactactgcaacaggatcgacttgagggtgcccagtggtcacctcaaggagcctgagcacccgtccatgtggggcccggtggagctggtaggcatcatcgccggcccggtgttcctcctgttcctcatcatcatcattgttttccttgtcattaactatcatcagcgtgtctatcacaaccgccagagactggacatggaagatccctcatgtgagatgtgtctctccaaagacaagacgctccaggatcttgtctacgatctctccacctcagggtctggctcagggttacccctctttgtccagcgcacagtggcccgaaccatcgttttacaagagattattggcaagggtcggtttggggaagtatggcggggccgctggaggggtggtgatgtggctgtgaaaatattctcttctcgtgaagaacggtcttggttcagggaagcagagatataccagacggtcatgctgcgccatgaaaacatccttggatttattgctgctgacaataaagataatggcacctggacacagctgtggcttgtttctgactatcatgagcacgggtccctgtttgattatctgaaccggtacacagtgacaattgaggggatgattaagctggccttgtctgctgctagtgggctggcacacctgcacatggagatcgtgggcacccaagggaagcctggaattgctcatcgagacttaaagtcaaagaacattctggtgaagaaaaatggcatgtgtgccatagcagacctgggcctggctgtccgtcatgatgcagtcactgacaccattgacattgccccgaatcagagggtggggaccaaacgatacatggcccctgaagtacttgatgaaaccattaatatgaaacactttgactcctttaaatgtgctgatatttatgccctcgggcttgtatattgggagattgctcgaagatgcaattctggaggagtccatgaagaatatcagctgccatattacgacttagtgccctctgacccttccattgaggaaatgcgaaaggttgtatgtgatcagaagctgcgtcccaacatccccaactggtggcagagttatgaggcactgcgggtgatggggaagatgatgcgagagtgttggtatgccaacggcgcagcccgcctgacggccctgcgcatcaagaagaccctctcccagctcagcgtgcaggaagacgtgaagatctaactgctccctctctccacacggagctcctggcagcgagaactacgcacagctgccgcgttgagcgtacgatggaggcctacctctcgtttctgcccagccctctgtggccaggagccctggcccgcaagagggacagagcccgggagagactcgctcactcccatgttgggtttgagacagacaccttttctatttacctcctaatggcatggagactctgagagcgaattgtgtggagaactcagtgccacacctcgaactggttgtagtgggaagtcccgcgaaacccggtgcatctggcacgtggccaggagccatgacaggggcgcttgggaggggccggaggaaccgaggtgttgccagtgctaagctgccctgagggtttccttcggggaccagcccacagcacaccaaggtggcccggaagaaccagaagtgcagcccctctcacaggcagctctgagccgcgctttcccctcctccctgggatggacgctgccgggagactgccagtggagacggaatctgccgctttgtctgtccagccgtgtgtgcatgtgccgaggtgcgtcccccgttgtgcctggttcgtgccatgcccttacacgtgcgtgtgagtgtgtgtgtgtgtctgtaggtgcgcacttacctgcttgagctttctgtgcatgtgcaggtcgggggtgtggtcgtcatgctgtccgtgcttgctggtgcctcttttcagtagtgagcagcatctagtttccctggtgcccttccctggaggtctctccctcccccagagcccctcatgccacagtggtactctgtgtctggcaggctactctgcccaccccagcatcagcacagctctcctcctccatctcagactgtggaaccaaagctggcccagttgtccatgacaaaagaggcttttgggccaaaatgtgagggtggtgggtgggatgggcagggaaggaatcctggtggaagtcttgggtgttagtgtcagccatgggaaatgagccagcccaagggcatcatcctcagcagcatcgaggaagggccgaggaatgtgaagccagatctcgggactcagattggaatgttacatctgtctttcatctcccagatcctggaaacagcagtgtatatttttggtggtggtgggtttggggtggggaagggaagggcgggcaaggagtggggagggagtctggggtgggagggaggcatctgcatgggtcttcttttactggactgtctgatcagggtggagggaaggtgagaggtttgcatccacttcaggagccctactgaagggaacagcctgagccgaacatgttatttaacctgagtatagtatttaacgaagcctagaagcacggctgtgggtggtgatttggtcagcatatcttaggtatataataactttgaagccataacttttaactggagtggtttgatttctttttttaattttattgggagggtttggattttaactttttttaatgttgttaaatattaagtttttgtaaaaggaaaaccatctctgtgattacctctcaatctatttgtttttaaagaaatccctaaaaaaaaaaattatccaattgaacgcacatagctcaatcacactggaaatgtttgtccttgcacctgagcctgttcccactcagcagtgagagttcctctttgccctgaggctcagtctctctcgtattttgtccccacccccaattccttgagtggtttttgctctagggccctttcttgcactgtccagctggttgtaccctctccaggcatttattcaacaaatgtgggtgaagtgcctgctgggtgccaggtgctgggaatacatctgtggacaagacatgcttgggtcctactcctggagcactgtaaaaagagctgattcaagtaagtagatgcctgttttgagaccagaaggtttcataattggttctacgacccttttgagcctagaattattgttcttatataagatcactgaagaaagaggaacccccacaaccccctccacaaagagaccaggggcgggtgatgagacctggggtttagaaccccaggtgagacctcaaatcactgcattcattctgagcccccttcctgtccccaggggaggtgtattgtgtatgtagccttagagcatctctgcctccaacccagcagttctctgccaaagcttgtggaggagggagagccctgtccctgccctcaggctccccagtgctcctggcccttctatttatttgactgattattgcttctttccttgcattaaaggagatcttcccctaacctttgggccaatttactggccactaatttcgtttaaataccattgtgtcattggggggaccgtctttacccctgctgacctcccacctatccgccctgcagcagaaccttggcggtttataggtaatgatggaacttagactcctcttcccagagtcacaagtagcctctgggatctgccaacacacgtccactcccaagccactagcccactccccagttggcccttctgcccttaccccacacacagtccaactcttccacctctggggaagatggagcaggtctttgggaagctcccacacccacctctgccactcttaacactaagtgagagttggggagaaactgaagccgtgtttttggccccccgaggctaaccctgatccatagtgctacctgcacctctggattctggattcacagaccaagtccaagcccgttcttacgtcgccataaaggcccccgaacggcattctcggtacttctgtttgtttttgtacattttattagaaaggactgtaaaatagccacttagacactttacctcttcagtatgcaaatgtaaataaattgtaatataggaaatcttttgttttaatataagaatgagcctgtccaatttctgctgtacattattaaaagttttattcacaga

SEQ ID NO: 104228 - DNA, 1782 bp, Homo sapiens
  Payload ID: 475
  Gene Symbol: ACVR1B
  Gene Name: activin A receptor, type IB
  Uniprot ID: P36896
  ENST ID: ENST00000426655
  CDS Start-End: 43-1473
cgctgctgggctgcggcggcggcggcggcggcggtggttactatggcggagtcggccggagcctcctccttcttcccccttgttgtcctcctgctcgccggcagcggcgggtccgggccccggggggtccaggctctgctgtgtgcgtgcaccagctgcctccaggccaactacacgtgtgagacagatggggcctgcatggtttccattttcaatctggatgggatggagcaccatgtgcgcacctgcatccccaaagtggagctggtccctgccgggaagcccttctactgcctgagctcggaggacctgcgcaacacccactgctgctacactgactactgcaacaggatcgacttgagggtgcccagtggtcacctcaaggagcctgagcacccgtccatgtggggcccggtggagctggtaggcatcatcgccggcccggtgttcctcctgttcctcatcatcatcattgttttccttgtcattaactatcatcagcgtgtctatcacaaccgccagagactggacatggaagatccctcatgtgagatgtgtctctccaaagacaagacgctccaggatcttgtctacgatctctccacctcagggtctggctcagggttacccctctttgtccagcgcacagtggcccgaaccatcgttttacaagagattattggcaagggtcggtttggggaagtatggcggggccgctggaggggtggtgatgtggctgtgaaaatattctcttctcgtgaagaacggtcttggttcagggaagcagagatataccagacggtcatgctgcgccatgaaaacatccttggatttattgctgctgacaataaagataatggcacctggacacagctgtggcttgtttctgactatcatgagcacgggtccctgtttgattatctgaaccggtacacagtgacaattgaggggatgattaagctggccttgtctgctgctagtgggctggcacacctgcacatggagatcgtgggcacccaagggaagcctggaattgctcatcgagacttaaagtcaaagaacattctggtgaagaaaaatggcatgtgtgccatagcagacctgggcctggctgtccgtcatgatgcagtcactgacaccattgacattgccccgaatcagagggtggggaccaaacgatacatggcccctgaagtacttgatgaaaccattaatatgaaacactttgactcctttaaatgtgctgatatttatgccctcgggcttgtatattgggagattgctcgaagatgcaattctggaggagtccatgaagaatatcagctgccatattacgacttagtgccctctgacccttccattgaggaaatgcgaaaggttgtatgtgatcagaagctgcgtcccaacatccccaactggtggcagagttatgaggtaagaagctggcctcctgcggctttcccatcagcctgatttctccaccttagaaaagggtttcttgacaatggggtcaggccccagaggagccccctgagagtgtcagttattatttactattacgtgctattttacatatcccaagccctttagggctacagtctcttgtcctggaccctgtagggtgccatttggagttcacagcctagaagaagaaaaggctttgggcctggtgtggtggcataggcctgtaatcgtagcgctttgagaggctgaggcaggaagatagcttgagctcagaagttcgagacaaacctgggcaatgtggggagaccccatctctac

SEQ ID NO: 104229 - DNA, 1665 bp, Homo sapiens
  Payload ID: 475
  Gene Symbol: ACVR1B
  Gene Name: activin A receptor, type IB
  Uniprot ID: P36896
  ENST ID: ENST00000415850
  CDS Start-End: 1-1464
atggcggagtcggccggagcctcctccttcttcccccttgttgtcctcctgctcgccggcagcggcgggtccgggccccggggggtccaggctctgctgtgtgcgtgcaccagctgcctccaggccaactacacgtgtgagacagatggggcctgcatggtttccattttcaatctggatgggatggagcaccatgtgcgcacctgcatccccaaagtggagctggtccctgccgggaagcccttctactgcctgagctcggaggacctgcgcaacacccactgctgctacactgactactgcaacaggatcgacttgagggtgcccagtggtcacctcaaggagcctgagcacccgtccatgtggggcccggtggagctggtaggcatcatcgccggcccggtgttcctcctgttcctcatcatcatcattgttttccttgtcattaactatcatcagcgtgtctatcacaaccgccagagactggacatggaagatccctcatgtgagatgtgtctctccaaagacaagacgctccaggatcttgtctacgatctctccacctcagggtctggctcagggttacccctctttgtccagcgcacagtggcccgaaccatcgttttacaagagattattggcaagggtcggtttggggaagtatggcggggccgctggaggggtggtgatgtggctgtgaaaatattctcttctcgtgaagaacggtcttggttcagggaagcagagatataccagacggtcatgctgcgccatgaaaacatccttggatttattgctgctgacaataaagataatggcacctggacacagctgtggcttgtttctgactatcatgagcacgggtccctgtttgattatctgaaccggtacacagtgacaattgaggggatgattaagctggccttgtctgctgctagtgggctggcacacctgcacatggagatcgtgggcacccaagggaagcctggaattgctcatcgagacttaaagtcaaagaacattctggtgaagaaaaatggcatgtgtgccatagcagacctgggcctggctgtccgtcatgatgcagtcactgacaccattgacattgccccgaatcagagggtggggaccaaacgatacatggcccctgaagtacttgatgaaaccattaatatgaaacactttgactcctttaaatgtgctgatatttatgccctcgggcttgtatattgggagattgctcgaagatgcaattctggaggtacctttcttttttgcctttgctcctacctcccattccaggatgctggatcacccaaagctgttttactgccccctttctttttacaacctgttggatgcctgttgccagagcctgaatcatcgtttaaggttgccatcaaaggtgtggaggtagctgtgcttagggtgcgtttattcttcagggatcagtttgttgaatagcgttgtgtgttatggtaaccattctgaaggctcgtttggctttataaacaaacaaacattgttttattagtccgtggcggggagtgccccggtgcgcatagcacgggattcatgcagtggtctccttcacatcagaagcagtatattctaacgcggtggctcccaagccacattcatgggaaaccctgctgtttcattgtt

SEQ ID NO: 104230 - DNA, 1791 bp, Homo sapiens
  Payload ID: 475
  Gene Symbol: ACVR1B
  Gene Name: activin A receptor, type IB
  Uniprot ID: P36896
  ENST ID: ENST00000541224
  CDS Start-End: 44-1684
gcgctgctgggctgcggcggcggcggcggcggcggtggttactatggcggagtcggccggagcctcctccttcttcccccttgttgtcctcctgctcgccggcagcggcgggtccgggccccggggggtccaggctctgctgtgtgcgtgcaccagctgcctccaggccaactacacgtgtgagacagatggggcctgcatggtttccattttcaatctggatgggatggagcaccatgtgcgcacctgcatccccaaagtggagctggtccctgccgggaagcccttctactgcctgagctcggaggacctgcgcaacacccactgctgctacactgactactgcaacaggatcgacttgagggtgcccagtggtcacctcaaggagcctgagcacccgtccatgtggggcccggtggagctggtaggcatcatcgccggcccggtgttcctcctgttcctcatcatcatcattgttttccttgtcattaactatcatcagcgtgtctatcacaaccgccagagactggacatggaagatccctcatgtgagatgtgtctctccaaagacaagacgctccaggatcttgtctacgatctctccacctcagggtctggctcagggttacccctctttgtccagcgcacagtggcccgaaccatcgttttacaagagattattggcaagggtcggtttggggaagtatggcggggccgctggaggggtggtgatgtggctgtgaaaatattctcttctcgtgaagaacggtcttggttcagggaagcagagatataccagacggtcatgctgcgccatgaaaacatccttggatttattgctgctgacaataaagcagactgctcattcctcacattgccatgggaagttgtaatggtctctgctgcccccaagctgaggagccttagactccaatacaagggaggaaggggaagagcaagatttttattcccactgaataatggcacctggacacagctgtggcttgtttctgactatcatgagcacgggtccctgtttgattatctgaaccggtacacagtgacaattgaggggatgattaagctggccttgtctgctgctagtgggctggcacacctgcacatggagatcgtgggcacccaagggaagcctggaattgctcatcgagacttaaagtcaaagaacattctggtgaagaaaaatggcatgtgtgccatagcagacctgggcctggctgtccgtcatgatgcagtcactgacaccattgacattgccccgaatcagagggtggggaccaaacgatacatggcccctgaagtacttgatgaaaccattaatatgaaacactttgactcctttaaatgtgctgatatttatgccctcgggcttgtatattgggagattgctcgaagatgcaattctggaggagtccatgaagaatatcagctgccatattacgacttagtgccctctgacccttccattgaggaaatgcgaaaggttgtatgtgatcagaagctgcgtcccaacatccccaactggtggcagagttatgaggcactgcgggtgatggggaagatgatgcgagagtgttggtatgccaacggcgcagcccgcctgacggccctgcgcatcaagaagaccctctcccagctcagcgtgcaggaagacgtgaagatctaactgctccctctctccacacggagctcctggcagcgagaactacgcacagctgccgcgttgagcgtacgatggaggcctacctctcgtttctgcccagccctctgtgg

SEQ ID NO: 104231 - DNA, 2362 bp, Homo sapiens
  Payload ID: 475
  Gene Symbol: ACVR1B
  Gene Name: activin A receptor, type IB
  Uniprot ID: P36896
  ENST ID: ENST00000542485
  CDS Start-End: 186-1547
aatgcttctcctaagcacctcgtgtgtgttcttcggcctcactgctctgtggcttaggtatctgtgctgtggggtttgagaaacatggtgaaggtgtatgaacagagcttgacatttgtgctctgctgtgtgcgtgcaccagctgcctccaggccaactacacgtgtgagacagatggggcctgcatggtttccattttcaatctggatgggatggagcaccatgtgcgcacctgcatccccaaagtggagctggtccctgccgggaagcccttctactgcctgagctcggaggacctgcgcaacacccactgctgctacactgactactgcaacaggatcgacttgagggtgcccagtggtcacctcaaggagcctgagcacccgtccatgtggggcccggtggagctggtaggcatcatcgccggcccggtgttcctcctgttcctcatcatcatcattgttttccttgtcattaactatcatcagcgtgtctatcacaaccgccagagactggacatggaagatccctcatgtgagatgtgtctctccaaagacaagacgctccaggatcttgtctacgatctctccacctcagggtctggctcagggttacccctctttgtccagcgcacagtggcccgaaccatcgttttacaagagattattggcaagggtcggtttggggaagtatggcggggccgctggaggggtggtgatgtggctgtgaaaatattctcttctcgtgaagaacggtcttggttcagggaagcagagatataccagacggtcatgctgcgccatgaaaacatccttggatttattgctgctgacaataaagataatggcacctggacacagctgtggcttgtttctgactatcatgagcacgggtccctgtttgattatctgaaccggtacacagtgacaattgaggggatgattaagctggccttgtctgctgctagtgggctggcacacctgcacatggagatcgtgggcacccaagggaagcctggaattgctcatcgagacttaaagtcaaagaacattctggtgaagaaaaatggcatgtgtgccatagcagacctgggcctggctgtccgtcatgatgcagtcactgacaccattgacattgccccgaatcagagggtggggaccaaacgatacatggcccctgaagtacttgatgaaaccattaatatgaaacactttgactcctttaaatgtgctgatatttatgccctcgggcttgtatattgggagattgctcgaagatgcaattctggaggagtccatgaagaatatcagctgccatattacgacttagtgccctctgacccttccattgaggaaatgcgaaaggttgtatgtgatcagaagctgcgtcccaacatccccaactggtggcagagttatgaggcactgcgggtgatggggaagatgatgcgagagtgttggtatgccaacggcgcagcccgcctgacggccctgcgcatcaagaagaccctctcccagctcagcgtgcaggaagacgtgaagatctaactgctccctctctccacacggagctcctggcagcgagaactacgcacagctgccgcgttgagcgtacgatggaggcctacctctcgtttctgcccagccctctgtggccaggagccctggcccgcaagagggacagagcccgggagagactcgctcactcccatgttgggtttgagacagacaccttttctatttacctcctaatggcatggagactctgagagcgaattgtgtggagaactcagtgccacacctcgaactggttgtagtgggaagtcccgcgaaacccggtgcatctggcacgtggccaggagccatgacaggggcgcttgggaggggccggaggaaccgaggtgttgccagtgctaagctgccctgagggtttccttcggggaccagcccacagcacaccaaggtggcccggaagaaccagaagtgcagcccctctcacaggcagctctgagccgcgctttcccctcctccctgggatggacgctgccgggagactgccagtggagacggaatctgccgctttgtctgtccagccgtgtgtgcatgtgccgaggtgcgtcccccgttgtgcctggttcgtgccatgcccttacacgtgcgtgtgagtgtgtgtgtgtgtctgtaggtgcgcacttacctgcttgagctttctgtgcatgtgcaggtcgggggtgtggtcgtcatgctgtccgtgcttgctggtgcctcttttcagtagtgagcagcatctagtttccctggtgcccttccctggaggtctctccctcccccagagcccctcatgccacagtggtactctgtgt

SEQ ID NO: 104232 - DNA, 539 bp, Homo sapiens
  Payload ID: 475
  Gene Symbol: ACVR1B
  Gene Name: activin A receptor, type IB
  ENST ID: ENST00000536420
  CDS Start-End: 327-539
gctgggctgcggcggcggcggcggcggcggtggttactatggcggagtcggccggagcctcctccttcttcccccttgttgtcctcctgctcgccggcagcggcgggtccgggccccggggggtccagggatgtgcctagcaccaagctgaatgctgagagggatcctgaggaaagagtctgtccttgccctttggaagtttacacacagagaccggccacagtggctcatgcctgtaatcccaacactttggagaatgagctctgctgtgtgcgtgcaccagctgcctccaggccaactacacgtgtgagacagatggggcctgcatggtttccattttcaatctggatgggatggagcaccatgtgcgcacctgcatccccaaagtggagctggtccctgccgggaagcccttctactgcctgagctcggaggacctgcgcaacacccactgctgctacactgactactgcaacaggatcgacttgagggtgcccagtggtcacctcaaggagcctgagcacccgtccatgtggggc

SEQ ID NO: 104233 - DNA, 8994 bp, Homo sapiens
  Payload ID: 476
  Gene Symbol: ACVR1C
  Gene Name: activin A receptor, type IC
  Uniprot ID: Q8NER5
  ENST ID: ENST00000243349
  CDS Start-End: 362-1843
gccgggcacagggccgcctttgcctgcctgccctgcagcagcaggcccgggcggctgcgagagggcgcagggggcggaggcgcggcaggggcgggctctgccgcccgccccaccacccgctccccgcccggctgcggggccagtggcaggagcgccgcgcaccgccagccgcagggggcgtgggatgggggcggccggggaggggggcgcccacactgactagagccaaccgcgcacttcaaaagggtgtcggtgccgcgctcccctcccgcggcccgggaacttcaaagcgggccgtgctgccccggctgcctcgctctgctctggggcctcgcagccccggcgcggccgcctggtggcgatgacccgggcgctctgctcagcgctccgccaggctctcctgctgctcgcagcggccgccgagctctcgccaggactgaagtgtgtatgtcttttgtgtgattcttcaaacttcacctgccaaacagaaggagcatgttgggcatcagtcatgctaaccaatggaaaagagcaggtgatcaaatcctgtgtctcccttccagaactgaatgctcaagtcttctgtcatagttccaacaatgttaccaaaaccgaatgctgcttcacagatttttgcaacaacataacactgcaccttccaacagcatcaccaaatgccccaaaacttggacccatggagctggccatcattattactgtgcctgtttgcctcctgtccatagctgcgatgctgacagtatgggcatgccagggtcgacagtgctcctacaggaagaaaaagagaccaaatgtggaggaaccactctctgagtgcaatctggtaaatgctggaaaaactctgaaagatctgatttatgatgtgaccgcctctggatctggctctggtctacctctgttggttcaaaggacaattgcaaggacgattgtgcttcaggaaatagtaggaaaaggtagatttggtgaggtgtggcatggaagatggtgtggggaagatgtggctgtgaaaatattctcctccagagatgaaagatcttggtttcgtgaggcagaaatttaccagacggtcatgctgcgacatgaaaacatccttggtttcattgctgctgacaacaaagataatggaacttggactcaactttggctggtatctgaatatcatgaacagggctccttatatgactatttgaatagaaatatagtgaccgtggctggaatgatcaagctggcgctctcaattgctagtggtctggcacaccttcatatggagattgttggtacacaaggtaaacctgctattgctcatcgagacataaaatcaaagaatatcttagtgaaaaagtgtgaaacttgtgccatagcggacttagggttggctgtgaagcatgattcaatactgaacactatcgacatacctcagaatcctaaagtgggaaccaagaggtatatggctcctgaaatgcttgatgatacaatgaatgtgaatatctttgagtccttcaaacgagctgacatctattctgttggtctggtttactgggaaatagcccggaggtgttcagtcggaggaattgttgaggagtaccaattgccttattatgacatggtgccttcagatccctcgatagaggaaatgagaaaggttgtttgtgaccagaagtttcgaccaagtatcccaaaccagtggcaaagttgtgaagcactccgagtcatggggagaataatgcgtgagtgttggtatgccaacggagcggcccgcctaactgctcttcgtattaagaagactatatctcaactttgtgtcaaagaagactgcaaagcctaatgatgataattatgttaaaaagaaatctctcatagctttcttttccattttcccctttatgtgaatgtttttgccattttttttttgttctacctcaaagataagacagtacagtatttaagtgcccataaggcagcatgaaaagataactctaaagttaagcatgggcaggagttgacttcatccaatctctatgttatgtttaattttattttgaaagcaacacctcaactcatctttttatttaataaggaagaaatatattacaaaagtataaaataagctctataaaaatgttatagtcattaagtttttattttacttgaaccaagagcacatgaatgaacaggaaaagatgtaaaaacatttttttctgagatgaaaacatattaattaaacatgcaaattagagcatgctatctttaggtgatgcaatctatgtttccccctttttaagttagcaggactttttaaaaataaatattgctctaaactttaatatatcgaacgtgagagtggagctgcttagtggaagatgtaagtgaggtgggtgtcccatgtgcttggtctccccttctgctgttctcctgttcttcataatccactactgcagcagtccctgaaccactaaacttgttcctttcatttacaaaagagatacctgacatcctgagacactgagaaatgtcctgaagtcacacagctaatggcagaactggcactaggtccaaatcttgtgataatgaacaccgtaaggttagctagcttcctactttcccttgaatagtgcttttctccctatgtaatatcttttattatgatatttgtggtttagaaggcatattgagttattttgcagaatcataatggacccgcacaaaatctcagaaccatatctgttgacattttttctcatagaaatatcatggttaccccatttgttaatgagcattaatgttttctgaacacttccaaagattaatcaaacataaatattcattgtctgaaaatgtctttaagatacaattcagaggtccctatttcctttgtacatacacacttagaaagaaaagacagaaaaggaagaggaaggaaggaaatattttgagaatatattgagaagaattaagaaaactcttcaatgaagtgttaacaaccaaaccctacagacggtatcagaaacagcaaatagatattcctctaccctttcacagtgagtgagtgagtacagaagaatgctcatgatagttttgccttcattctactttctgtggacacagagtaatgaatatttaatgggacattaaatatgcccttcaaatctataattttactttggtaaacgagatttaacatgatgtcttttatgctcctaaaacatcttttttcaaactccattccttagaacattcttctactgagatgatccaagaccaaaagtgttctttggtacttgcttataaagtgatagtacatgttagcatataatgtattttgaagagtgaagtaaatgctattgataacagtaaaaaaaaaaaaaaaaactaataacagtaaagaaatgctacttgatttttttttaaactggattgctcagattacctgatcgtggtggaacccttttattaagaggaggggaaactttttactatcccatatttaactgttctataaagcaaagcacagcttgggtaatagcgttctgaaggatatacttctgtattttctcatagagtacaatttagtgattatgcttcatttcactatggaaatatgttactgaatctatcttcattttactgagttgaaataaggaaggcaaaaaactgacagctatggagtttgcgtgtacttccatactcgttaatgctctcatccacttattaaataatcatagagcacccatatcttgcttgccacaatatcgggtacaagagggaatacaaagatagataggtcctgccctcagggattttaaagtctaatttgggaatgggaatagggatgtgagtgtgtgggggaagagattaaattgacagataaaatacgaagtgggatgtcttgagttctgcatgacagtgggtttctaggataggtctgaaaattgctttcatttgcaacacatttagaaagtagctttatttggatattacagacaatctaaatatatcatcagtttttaaaagtgcctatgtgaagtgatttttaaaaagagcctatgtgaaggggtaatcttgcttgttcttgttactaatttctcatagattgtttttctgcatatataagaacgaaattatttatttactatggttgtacgtgcctcaaataaacaagaatgatatttcctgttttatttacttatgttgggtaaatatgcttattgaatttttaagagaggattttttaccatctccatttttcttgtcattatgttttgtagcttatttgagggtgtctaaatataatttcatattttattggttcaactttcactctgaagaaatccgtatgttagtacattttgaggtatttttcttgttcttgtgttgtttaactatgactcctaactgagtagtcttatatttcaattacaaaatacattttttaagaaagggaatagagcagcaaaaatgataaggaaaatgttaaaagttgtaatatttcctttactcttaacaggattatatatagaacatgctcacttacaaaaataggatgatgaagtttagagcataaggcaggcttcttgtatatacttatgctgtcaaatgttatattgtttttaatggagtcccattgtgtaatatttatttcttttacattttgttataagcaaaaaaaaaaaaaattctccttaggttatgttcagagtatcagtgttctttactccttacagatattttggctttggggtataatacaagacttgggaaaacactattatgaattttcagtactgtataaagtggtgatgggatttaaatgcagcatcactttctgaaaataagagaaacattatttgttgtcagtatttcagcatgaacttgttgccttgtaaattttgcctttaagtttgtaattggtacagattctgttgtatgctttcttctatgtctaaaatatttggcatgtcacatctagaattcttaatttatgttctgacttgagagttaagtgaaacatgactgtcgtgcactattttaggcatagcacttgcttttcatctttatactttcaattaactttgcattttaaatttccatgattgtatgaaaatagtaacctggttgcagtatctgaaaaaattaaaattagcttttatttaaaaatgaaaatctacaatagattcattaggttagaagttccagaataatttattattttattacacctactattgtagaattactaataaaacaaaacaaaactactcctattttcctggaattttgccaccatgtgacttattggggcagagaaaactcagggttgtctttgagtctgcacaaaagcaccagggaacctgcttagcaaatcgtctgaaaacagggagctgatgtttgccattatacaaagtttgagtaaacaacttaaaattgcttgttagggcatagtctttgattgaaataagtatgagaatgtatttggctaaataaatgtatttaaaatatacaaattttatttcccactggaaaattaagaaagtagcagtaccaaatgaataaaagctggcagttgatgtcttcaataatcattcctttaaaataaattcacaaacacatcattacaagctacttagaaatgtttagtattcgtatcttaaaatggcaccattgtggttttcaaagatattttaaacatcttttgtgaaacatactatttctgtttgacaatgctttgttctagctctgtgtgctgatacctacatggagtttttctgctattttagtgaaaacagtaattcttttatcttgagagctgcttctaaataacaaaaaagttaattggaatgtaagtttttaaaaaatgttaatattaaatagaatttttataatatgggcatttttcaaaacattttaatgaaaatatatagatatttgactttctttttttcatctagccttgctttatatttcattatttttctcactttttttcttaatattccctcactatctttcaacattatcattagttcctaattttaaaaataactcttatttaacttaaccgtctggaatttagccttctaatgaaagagaatcccttagtactctcagagattatataaagttattccaattttgtgtagatgacgaaaccaaggatcagagattaaatgactactagttactagcagaactcttatgaaagcctggtggtgacacccagcactgttccctgccatatccccaacttttactgattaaaaattaattcgcatgcatctaaacctaccttgaatgcacactaacgtaatgtgccattcaatgatgatgataaaatcccacttttctttgggtttctactaaaataatttactcactcagagtgaggtcaatgagaaaaactaaactaggctaagaaagagttgtagaatggttgttgagctaagtaggcaaccactggggtgctgataaaattaatggataaaatttaggaactgtgagagtatagaatttcttagtgcaagtaatgattagagaagcttcctgacatcccccaccctttctgtaaggactgttctttctctttgtaccttggaatgggggtgaaaggtgatttgatagctgaatttgggactatgtccagtgggatattatctaacttttctctctttctcttttttttcccctcagtttctcattagtttgtctttggcattcatcttcttttagtgcattaaaaaatgtttggcagatctcatcaatcccaagtcactctataattcctgtatttctttagttgtcgtttaacctgtccaaacttctacacaatgaacttcttaacaagattttaagttctctgtataagaggtttcacctcataacttctccagtaatccttcatttggcactatagagtatttgttaatggcagagatgatttttcttttaaaacctaaaaagactagctgttatttgtattctagcttttagctaacatataaagaatgtctacttttgctttaatgctaaattccgcttgagaaatagtaactgggaaagacaatttgaaatatatgccccataatgtgattgttaaatttatttctgctgttccataccattgctttgttttgcttttgacaaactaagccattatgctattagtttggaatataatactacagcaaaattaggtaacaatccctattttaaaattcccctaacaataatagaactgccagcatacttttctctttcagttgtagatgaatacattcgagagaatatgagctgtatttcatcctagattttaatattttcagatgtgactgtatttcctgatcattggtccaagttgtcctaaaagaaatttttctctccagacctaacagttttaactgcaagagtttactgtgggttatgttaatctgaattttaatagggccactaagaatctgagtgccttaggagattacccttatacccactgccatcacatccagtcaggcctgttgtgctctatataaatcttcccagctgaggggcaggtgcgggctaaaatccaactgcaattggctcccagacataattttatattttacagagaagcatcttattggcttatatgtgtttaaagaatggtctggcttatacatcttcagaaaatgagaattaaaaagtcaaaataattcttgacatctacagattgaacaaagaacttagaagaaataatactttatcttttcatcctggcattcctgagagaagagaaattgattgtttatcatgttggtttaatttttcaacccagacaatctgcagcaaggcacatggaccccaattttgatatcgtccatacagttttcattctatgcatggagctaattactgactttgcctgtaaagagaggattgtgtgcctaaattttgtctaacaaatgcaagcgtagaatgacatttactaatatttctatttcttccataggctaaataatagtaactaagtatttttaaggacacagccctttttttctctttatacaaaatgagagtatctgagccaaaatattaaattctagttcttttccgcaatgactagtgtcaagctcatgtactcttctgattctagactggagaagattattcaaacttgatctgtgtttcaggtttttaaatgtcctaaaaacagaaaattagattcagatctcaaaaaaggaattttggattgactttcaaagtactaatactaattatacttttcttttggtagcgtgactcttcttatacctaagaacatattacaaatgtcaaaaccattgcattttgacattgcaaaacatgccttgaactcttgaactactgtgaaaagaatcaccgttgtaaagactttttgtaagctagctgatactcttaagtatgtaaaaagattgtctttcagccgacaggcccaaaggaatgtatataaggaaggaatatgaaaaaataaattaggttttaaaataggaattgggcaataaactgtatcaaaaatatgtagatggattttagtagttgtaatttaaatgtggaaggtgaagagaatttcaaactccaaagagaaatgaatgatattcagatgtttcattaatttctagtctgtgaaaatatgcattttatagtaatatgtatagacttattttatttagaaataatagtgttttagaatttattaaaaactcagtgatagcctttataccaaaatgtttaactttaccaacagcaagtcataaaagtatttattttaaagctttttaatattatcgtgtaactttcatctgtcttcagatgtaaataattatctgcctaaatgttatatttttatgtatgcattttctgaaaatgtattgttttgtaaagtgggaaagataataaatcaagcacttcttgcacttgtttctgtgaagcatatagaactctattttaaataaaggaagatgtgtcgta

SEQ ID NO: 104234 - DNA, 1270 bp, Homo sapiens
  Payload ID: 476
  Gene Symbol: ACVR1C
  Gene Name: activin A receptor, type IC
  Uniprot ID: Q8NER5
  ENST ID: ENST00000348328
  CDS Start-End: 84-1094
ggaacttcaaagcgggccgtgctgccccggctgcctcgctctgctctggggcctcgcagccccggcgcggccgcctggtggcgatgacccgggcgctctgctcagcgctccgccaggctctcctgctgctcgcagcggccgccgagctctcgccaggactgaagtgtgtatgtcttttgtgtgattcttcaaacttcacctgccaaacagaaggagcatgttgggcatcagtcatgctaaccaatggaaaagagcaggtgatcaaatcctgtgtctcccttccagaactgaatgctcaagtcttctgtcatagttccaacaatgttaccaaaaccgaatgctgcttcacagatttttgcaacaacataacactgcaccttccaacagataatggaacttggactcaactttggctggtatctgaatatcatgaacagggctccttatatgactatttgaatagaaatatagtgaccgtggctggaatgatcaagctggcgctctcaattgctagtggtctggcacaccttcatatggagattgttggtacacaaggtaaacctgctattgctcatcgagacataaaatcaaagaatatcttagtgaaaaagtgtgaaacttgtgccatagcggacttagggttggctgtgaagcatgattcaatactgaacactatcgacatacctcagaatcctaaagtgggaaccaagaggtatatggctcctgaaatgcttgatgatacaatgaatgtgaatatctttgagtccttcaaacgagctgacatctattctgttggtctggtttactgggaaatagcccggaggtgttcagtcggaggaattgttgaggagtaccaattgccttattatgacatggtgccttcagatccctcgatagaggaaatgagaaaggttgtttgtgaccagaagtttcgaccaagtatcccaaaccagtggcaaagttgtgaagcactccgagtcatggggagaataatgcgtgagtgttggtatgccaacggagcggcccgcctaactgctcttcgtattaagaagactatatctcaactttgtgtcaaagaagactgcaaagcctaatgatgataattatgttaaaaagaaatctctcatagctttcttttccattttcccctttatgtgaatgtttttgccattttttttttgttctacctcaaagataagacagtacagtatttaagtgcccataaggcagcatgaaaagataactctaaagttaagcatgggcaggagtt

SEQ ID NO: 104235 - DNA, 1501 bp, Homo sapiens
  Payload ID: 476
  Gene Symbol: ACVR1C
  Gene Name: activin A receptor, type IC
  Uniprot ID: Q8NER5
  ENST ID: ENST00000335450
  CDS Start-End: 84-1325
ggaacttcaaagcgggccgtgctgccccggctgcctcgctctgctctggggcctcgcagccccggcgcggccgcctggtggcgatgacccgggcgctctgctcagcgctccgccaggctctcctgctgctcgcagcggccgccgagctctcgccaggactgaagtgtgtatgtcttttgtgtgattcttcaaacttcacctgccaaacagaaggagcatgttgggcatcagtcatgctaaccaatggaaaagagcaggtgatcaaatcctgtgtctcccttccagaactgaatgctcaagtcttctgtcatagttccaacaatgttaccaaaaccgaatgctgcttcacagatttttgcaacaacataacactgcaccttccaacaggtctacctctgttggttcaaaggacaattgcaaggacgattgtgcttcaggaaatagtaggaaaaggtagatttggtgaggtgtggcatggaagatggtgtggggaagatgtggctgtgaaaatattctcctccagagatgaaagatcttggtttcgtgaggcagaaatttaccagacggtcatgctgcgacatgaaaacatccttggtttcattgctgctgacaacaaagataatggaacttggactcaactttggctggtatctgaatatcatgaacagggctccttatatgactatttgaatagaaatatagtgaccgtggctggaatgatcaagctggcgctctcaattgctagtggtctggcacaccttcatatggagattgttggtacacaaggtaaacctgctattgctcatcgagacataaaatcaaagaatatcttagtgaaaaagtgtgaaacttgtgccatagcggacttagggttggctgtgaagcatgattcaatactgaacactatcgacatacctcagaatcctaaagtgggaaccaagaggtatatggctcctgaaatgcttgatgatacaatgaatgtgaatatctttgagtccttcaaacgagctgacatctattctgttggtctggtttactgggaaatagcccggaggtgttcagtcggaggaattgttgaggagtaccaattgccttattatgacatggtgccttcagatccctcgatagaggaaatgagaaaggttgtttgtgaccagaagtttcgaccaagtatcccaaaccagtggcaaagttgtgaagcactccgagtcatggggagaataatgcgtgagtgttggtatgccaacggagcggcccgcctaactgctcttcgtattaagaagactatatctcaactttgtgtcaaagaagactgcaaagcctaatgatgataattatgttaaaaagaaatctctcatagctttcttttccattttcccctttatgtgaatgtttttgccattttttttttgttctacctcaaagataagacagtacagtatttaagtgcccataaggcagcatgaaaagataactctaaagttaagcatgggcaggagtt

SEQ ID NO: 104236 - DNA, 1786 bp, Homo sapiens
  Payload ID: 476
  Gene Symbol: ACVR1C
  Gene Name: activin A receptor, type IC
  Uniprot ID: Q8NER5
  ENST ID: ENST00000409680
  CDS Start-End: 279-1610
gttgcgctgccgtcgggcaggtggccgagccccgcgggagctgtcgtcggggccgaattcactgcgccaaggtccagcggaaagctggggcatcccggcgaccgcagggtgtcccttcgcaaattcatcaggcgaaggggaggcggaagctcctggccgctgctctgggggagggctccgagctccaacctgcaagtccaggactgaagtgtgtatgtcttttgtgtgattcttcaaacttcacctgccaaacagaaggagcatgttgggcatcagtcatgctaaccaatggaaaagagcaggtgatcaaatcctgtgtctcccttccagaactgaatgctcaagtcttctgtcatagttccaacaatgttaccaaaaccgaatgctgcttcacagatttttgcaacaacataacactgcaccttccaacagcatcaccaaatgccccaaaacttggacccatggagctggccatcattattactgtgcctgtttgcctcctgtccatagctgcgatgctgacagtatgggcatgccagggtcgacagtgctcctacaggaagaaaaagagaccaaatgtggaggaaccactctctgagtgcaatctggtaaatgctggaaaaactctgaaagatctgatttatgatgtgaccgcctctggatctggctctggtctacctctgttggttcaaaggacaattgcaaggacgattgtgcttcaggaaatagtaggaaaaggtagatttggtgaggtgtggcatggaagatggtgtggggaagatgtggctgtgaaaatattctcctccagagatgaaagatcttggtttcgtgaggcagaaatttaccagacggtcatgctgcgacatgaaaacatccttggtttcattgctgctgacaacaaagataatggaacttggactcaactttggctggtatctgaatatcatgaacagggctccttatatgactatttgaatagaaatatagtgaccgtggctggaatgatcaagctggcgctctcaattgctagtggtctggcacaccttcatatggagattgttggtacacaaggtaaacctgctattgctcatcgagacataaaatcaaagaatatcttagtgaaaaagtgtgaaacttgtgccatagcggacttagggttggctgtgaagcatgattcaatactgaacactatcgacatacctcagaatcctaaagtgggaaccaagaggtatatggctcctgaaatgcttgatgatacaatgaatgtgaatatctttgagtccttcaaacgagctgacatctattctgttggtctggtttactgggaaatagcccggaggtgttcagtcggaggaattgttgaggagtaccaattgccttattatgacatggtgccttcagatccctcgatagaggaaatgagaaaggttgtttgtgaccagaagtttcgaccaagtatcccaaaccagtggcaaagttgtgaagcactccgagtcatggggagaataatgcgtgagtgttggtatgccaacggagcggcccgcctaactgctcttcgtattaagaagactatatctcaactttgtgtcaaagaagactgcaaagcctaatgatgataattatgttaaaaagaaatctctcatagctttcttttccattttcccctttatgtgaatgtttttgccattttttttttgttctacctcaaagataagacagtacagtatttaagtgcccataaggcagcatgaaaagataactctaaagttaagcatgggcaggagtt

SEQ ID NO: 104237 - DNA, 5728 bp, Homo sapiens
  Payload ID: 477
  Gene Symbol: ACVR2A
  Gene Name: activin A receptor, type IIA
  Uniprot ID: P27037
  ENST ID: ENST00000241416
  CDS Start-End: 637-2178
aggagaccgaaaacgcggccgagcccggagcccggagctggagccagagcctggaccagaacttggccgccgcctgcaccgccgccgccgctgccgcccgccgccccttccccgcgccgcagccgcctcgccgccaccgccgcgagctcggccgccagtggtcctcggactttaggtgtctgggttgaaggtcggtccggacatcggacccagtcagttcccagactgtccgggcggcagcggacgccgctgccgccgccgcctcttcgtcgcctcagcctggcgttttgttccgagagacgggagaggcgagcggagctgacagtgattttgacagtgatttaaacccgcttttgttgttgttggcttttcgttgtttggttttgtgtgttgtgcgtgtgtgtggcggtttttcccccgtggtgcattttattttttatcgttgtgctcttttttttcttttttttttttaacccagtgagcgtttttttttttttttttttttttttttggtctgggcttccgaatatgttttatgacggttgattttacaccaggaggtttgtctccgaggaagacccagggaactggatatctagcgagaacttcctccggattccccggcgcctcgggaaaatgggagctgctgcaaagttggcgtttgccgtctttcttatctcctgttcttcaggtgctatacttggtagatcagaaactcaggagtgtcttttctttaatgctaattgggaaaaagacagaaccaatcaaactggtgttgaaccgtgttatggtgacaaagataaacggcggcattgttttgctacctggaagaatatttctggttccattgaaatagtgaaacaaggttgttggctggatgatatcaactgctatgacaggactgattgtgtagaaaaaaaagacagccctgaagtatatttttgttgctgtgagggcaatatgtgtaatgaaaagttttcttattttccggagatggaagtcacacagcccacttcaaatccagttacacctaagccaccctattacaacatcctgctctattccttggtgccacttatgttaattgcggggattgtcatttgtgcattttgggtgtacaggcatcacaagatggcctaccctcctgtacttgttccaactcaagacccaggaccacccccaccttctccattactaggtttgaaaccactgcagttattagaagtgaaagcaaggggaagatttggttgtgtctggaaagcccagttgcttaacgaatatgtggctgtcaaaatatttccaatacaggacaaacagtcatggcaaaatgaatacgaagtctacagtttgcctggaatgaagcatgagaacatattacagttcattggtgcagaaaaacgaggcaccagtgttgatgtggatctttggctgatcacagcatttcatgaaaagggttcactatcagactttcttaaggctaatgtggtctcttggaatgaactgtgtcatattgcagaaaccatggctagaggattggcatatttacatgaggatatacctggcctaaaagatggccacaaacctgccatatctcacagggacatcaaaagtaaaaatgtgctgttgaaaaacaacctgacagcttgcattgctgactttgggttggccttaaaatttgaggctggcaagtctgcaggcgatacccatggacaggttggtacccggaggtacatggctccagaggtattagagggtgctataaacttccaaagggatgcatttttgaggatagatatgtatgccatgggattagtcctatgggaactggcttctcgctgtactgctgcagatggacctgtagatgaatacatgttgccatttgaggaggaaattggccagcatccatctcttgaagacatgcaggaagttgttgtgcataaaaaaaagaggcctgttttaagagattattggcagaaacatgctggaatggcaatgctctgtgaaaccattgaagaatgttgggatcacgacgcagaagccaggttatcagctggatgtgtaggtgaaagaattacccagatgcagagactaacaaatattattaccacagaggacattgtaacagtggtcacaatggtgacaaatgttgactttcctcccaaagaatctagtctatgatggttgcgccatctgtgcacactaagaaatgggactctgaactggagctgctaagctaaagaaactgcttacagtttattttctgtgtaaaatgagtaggatgtctcttggaaatgttaagaaagaagaccctttgttgaaaaatgttgctctgggagacttactgcattgccgacagcacagatgtgaaggacatgagactaagagaaaccttgcaaactctataaagaaacttttgaaaaagtgtacatgaagaatgtagccctctccaaatcaaggatcttttggacctggctaatggagtgtttgaaaactgacatcagatttcttaatgtctgtcagaagacactaattccttaaatgaactactgctattttttttaaatcaaaaacttttcatttcagattttaaaaagggtaacttgtttttattgcatttgctgttgtttctataaatgactattgtaatgccaatatgacacagcttgtgaatgtttagtgtgctgctgttctgtgtacataaagtcatcaaagtggggtacagtaaagaggcttccaagcattactttaacctccctcaacaaggtatacctcagttccacggttgctaaattataaaattgaaaacactaacaaaatttgaataataaatcgatccatgttttgtaacaaattcactgtgttatttaaggaaaaaaaggtaagctatgcttagtgccaacaataagtggccattcgtaaagcagtgttttagcatttcttgtgctggcttgtaatgtagggaaaaaaagtgctgttttttgaaaagatggtgtcatttcccccttcttcccatgttttaaagccccatcttatatccagttcccaaaatttgcatacttacctaagtattttttttaggtgtgctgtgtttggggaatatttgaaaatttaaagcatgatttaaaattttttaaagtgagctgtgacactggaaagctcttcattttatcttttaaaatagagttttttctatttatatatgtaaaattgtagtgtatttcttttcaccaaacagtgtgtgggacattctttatcactgttttaggatcacctcaggaagtgtcgttacccagaattccccactgtctgctatgagacttgtaactttatcactatacttctgcttggtgccatcttgtcagagtaatatttgatgtctgtgatatgtaaagaattatcctaggataaagatattaaactttaagcagatttcagatgttactgctttaaaacaaatcagggataacaaattaaacgtataacttaaaatatgcaatgacatttagaggtaaccaatgttgatataggtagcatagcctagcctcctccccaaaattgcttttacaactaacactgatactaatttaggatagttcatgccttatccttgctaagaaaatggaattgatggtaggcaggtgctaaagtgcttttcaaaacaatattacgttagaatacaattggattcttcctcaaatttatacaggccaaaaagtaaaacattaattttctgaatttccagattaccaatcaattaatcaacaaatagccagtattatgctgtgtatttctgtcaggtcattttaaaatccatgttaattttataaaagaattttttacatgtcactgtcaggagctcactgtgaatgtgttgtcttcaaatggttatttaaccacacagtacactacattttacatatatgtacgtaatctctgggaatagtaaattaattatgttatttataaacaatacataggtcaacagactttaagcagggaggaaaagaagagtaatagcgtctgtgtgctgcagaccattcagaactgtcacgtgtgtccccatggtctcattcattgtattcctagcaattcccttttcaatgttgagttcacctctttatttcacaaagtacttggtctctcaatttcttgatctggttttgcttccatttaaaaactaatcaagaagggaaaatattgagaatgtgcatacaagaaaatcattaatttcctgaagatgaatttctacctgttgtgaacatttaactttctttttaaaagttaaacaaaaataaacaagggatattatgatgaatgtttggcttatgtgagtactagagataaaatttttaaacccagttattcacaatataaaatgttttcaagttagaaaaaatttttagaaatcctgggtattgtatttaactgtagctaaccaattttaaaacttgtattcttttgagaactattattaatagaaaaactttttataagcagtaaaataagaatgttccagtgactacctgtccttatacctagtcttgttaaaactttcttttgcagggtatttagtgtttggtttacagtcagtgcagagtgggcaagttaacagaaagtttgagctagagatactggaaaaaaaaaagatcaaagaatgagaaaaatggtgatccattttggggcaaactgagaccccccaaataactctttcctcatgtgtatggtgctcctcatgactcgtcttgtattttgcctttctgatacccatcagaactgctgctgctctaacttatactctttaccttgcccagatctccgcgtaaggaatgctttatgatcaacttgccataggactgatggattaaccagtgttcggctttatttgaagtctatgccctgcacagctcttgtatgtattttagatgctagaagtttttttagcatgtgatgtgtgattcttgtttgaattctaggtaccttgtgaattccagaaaaagagactgtgcttcacgattgttagtcccatgaacttgcactatctatctttcatggtgatgttttgaaaatacaatcaggaaaaaacccaacacctttggaatttaaaatagaatcatatcatgaaatttaaaaagaatctcttctgttgcatttcctcacccctaagtaacagctacatttaagtaaaatgcaggtggtaggggaaaaaaaaccatggcgagatggtggtttagtggaataaactgattactggtttttttgtttttttttttttttttaaagaaagaagcttcatcacagatactttccagtttctcttttatacttttttgaaagattactttttaggaacatttggtatgatatgcataaaattatttatccatttatgggcaaaatgatacaagtagcatcttgattgaacatcatttacctcagatattcaaccagcagtacgttttttatgcagtctcaacccatatcccatttgttacctctcagaatattggtaagcagttattttcgctttactctgtatttcttgtgttttgggcacaggttattgtactactgtcaaatcgtacttgctattttttctgcaagtatttaacagaaagcttaaaatccccataaaaccccaccttggataagtgattgttaaatattgtacaaataaaatgtatgctatccccattccatccccaagttaaataaaaaaatgaatacggta

SEQ ID NO: 104238 - DNA, 2367 bp, Homo sapiens
  Payload ID: 477
  Gene Symbol: ACVR2A
  Gene Name: activin A receptor, type IIA
  Uniprot ID: P27037
  ENST ID: ENST00000404590
  CDS Start-End: 171-1712
gccgccccttccccgcgccgcagccgcctcgccgccaccgccgcgagctcggccgccagtggtcctcggactttaggtgtctgggttgaaggaggtttgtctccgaggaagacccagggaactggatatctagcgagaacttcctccggattccccggcgcctcgggaaaatgggagctgctgcaaagttggcgtttgccgtctttcttatctcctgttcttcaggtgctatacttggtagatcagaaactcaggagtgtcttttctttaatgctaattgggaaaaagacagaaccaatcaaactggtgttgaaccgtgttatggtgacaaagataaacggcggcattgttttgctacctggaagaatatttctggttccattgaaatagtgaaacaaggttgttggctggatgatatcaactgctatgacaggactgattgtgtagaaaaaaaagacagccctgaagtatatttttgttgctgtgagggcaatatgtgtaatgaaaagttttcttattttccggagatggaagtcacacagcccacttcaaatccagttacacctaagccaccctattacaacatcctgctctattccttggtgccacttatgttaattgcggggattgtcatttgtgcattttgggtgtacaggcatcacaagatggcctaccctcctgtacttgttccaactcaagacccaggaccacccccaccttctccattactaggtttgaaaccactgcagttattagaagtgaaagcaaggggaagatttggttgtgtctggaaagcccagttgcttaacgaatatgtggctgtcaaaatatttccaatacaggacaaacagtcatggcaaaatgaatacgaagtctacagtttgcctggaatgaagcatgagaacatattacagttcattggtgcagaaaaacgaggcaccagtgttgatgtggatctttggctgatcacagcatttcatgaaaagggttcactatcagactttcttaaggctaatgtggtctcttggaatgaactgtgtcatattgcagaaaccatggctagaggattggcatatttacatgaggatatacctggcctaaaagatggccacaaacctgccatatctcacagggacatcaaaagtaaaaatgtgctgttgaaaaacaacctgacagcttgcattgctgactttgggttggccttaaaatttgaggctggcaagtctgcaggcgatacccatggacaggttggtacccggaggtacatggctccagaggtattagagggtgctataaacttccaaagggatgcatttttgaggatagatatgtatgccatgggattagtcctatgggaactggcttctcgctgtactgctgcagatggacctgtagatgaatacatgttgccatttgaggaggaaattggccagcatccatctcttgaagacatgcaggaagttgttgtgcataaaaaaaagaggcctgttttaagagattattggcagaaacatgctggaatggcaatgctctgtgaaaccattgaagaatgttgggatcacgacgcagaagccaggttatcagctggatgtgtaggtgaaagaattacccagatgcagagactaacaaatattattaccacagaggacattgtaacagtggtcacaatggtgacaaatgttgactttcctcccaaagaatctagtctatgatggttgcgccatctgtgcacactaagaaatgggactctgaactggagctgctaagctaaagaaactgcttacagtttattttctgtgtaaaatgagtaggatgtctcttggaaatgttaagaaagaagaccctttgttgaaaaatgttgctctgggagacttactgcattgccgacagcacagatgtgaaggacatgagactaagagaaaccttgcaaactctataaagaaacttttgaaaaagtgtacatgaagaatgtagccctctccaaatcaaggatcttttggacctggctaatggagtgtttgaaaactgacatcagatttcttaatgtctgtcagaagacactaattccttaaatgaactactgctattttttttaaatcaaaaacttttcatttcagattttaaaaagggtaacttgtttttattgcatttgctgttgtttctataaatgactattgtaatgccaatatgacacagcttgtgaatgtttagtgtgctgctgttctgtgtacataaagtcatcaaagtggggtacagtaaagaggcttccaagcattactttaacctccctcaacaaggtatacctcagttccacggttgctaaattataaaattgaaaacactaacaaaatttgaataataaatcga

SEQ ID NO: 104239 - DNA, 5166 bp, Homo sapiens
  Payload ID: 477
  Gene Symbol: ACVR2A
  Gene Name: activin A receptor, type IIA
  Uniprot ID: P27037
  ENST ID: ENST00000535787
  CDS Start-End: 397-1614
aggagaccgaaaacgcggccgagcccggagcccggagctggagccagagcctggaccagaacttggccgccgcctgcaccgccgccgccgctgccgcccgccgccccttccccgcgccgcagccgcctcgccgccaccgccgcgagctcggccgccagtggtcctcggactttaggtgtctgggttgaagacagaaccaatcaaactggtgttgaaccgtgttatggtgacaaagataaacggcggcattgttttgctacctggaagaatatttctggttccattgaaatagtgaaacaaggttgttggctggatgatatcaactgctatgacaggactgattgtgtagaaaaaaaagacagccctgaagtatatttttgttgctgtgagggcaatatgtgtaatgaaaagttttcttattttccggagatggaagtcacacagcccacttcaaatccagttacacctaagccaccctattacaacatcctgctctattccttggtgccacttatgttaattgcggggattgtcatttgtgcattttgggtgtacaggcatcacaagatggcctaccctcctgtacttgttccaactcaagacccaggaccacccccaccttctccattactaggtttgaaaccactgcagttattagaagtgaaagcaaggggaagatttggttgtgtctggaaagcccagttgcttaacgaatatgtggctgtcaaaatatttccaatacaggacaaacagtcatggcaaaatgaatacgaagtctacagtttgcctggaatgaagcatgagaacatattacagttcattggtgcagaaaaacgaggcaccagtgttgatgtggatctttggctgatcacagcatttcatgaaaagggttcactatcagactttcttaaggctaatgtggtctcttggaatgaactgtgtcatattgcagaaaccatggctagaggattggcatatttacatgaggatatacctggcctaaaagatggccacaaacctgccatatctcacagggacatcaaaagtaaaaatgtgctgttgaaaaacaacctgacagcttgcattgctgactttgggttggccttaaaatttgaggctggcaagtctgcaggcgatacccatggacaggttggtacccggaggtacatggctccagaggtattagagggtgctataaacttccaaagggatgcatttttgaggatagatatgtatgccatgggattagtcctatgggaactggcttctcgctgtactgctgcagatggacctgtagatgaatacatgttgccatttgaggaggaaattggccagcatccatctcttgaagacatgcaggaagttgttgtgcataaaaaaaagaggcctgttttaagagattattggcagaaacatgctggaatggcaatgctctgtgaaaccattgaagaatgttgggatcacgacgcagaagccaggttatcagctggatgtgtaggtgaaagaattacccagatgcagagactaacaaatattattaccacagaggacattgtaacagtggtcacaatggtgacaaatgttgactttcctcccaaagaatctagtctatgatggttgcgccatctgtgcacactaagaaatgggactctgaactggagctgctaagctaaagaaactgcttacagtttattttctgtgtaaaatgagtaggatgtctcttggaaatgttaagaaagaagaccctttgttgaaaaatgttgctctgggagacttactgcattgccgacagcacagatgtgaaggacatgagactaagagaaaccttgcaaactctataaagaaacttttgaaaaagtgtacatgaagaatgtagccctctccaaatcaaggatcttttggacctggctaatggagtgtttgaaaactgacatcagatttcttaatgtctgtcagaagacactaattccttaaatgaactactgctattttttttaaatcaaaaacttttcatttcagattttaaaaagggtaacttgtttttattgcatttgctgttgtttctataaatgactattgtaatgccaatatgacacagcttgtgaatgtttagtgtgctgctgttctgtgtacataaagtcatcaaagtggggtacagtaaagaggcttccaagcattactttaacctccctcaacaaggtatacctcagttccacggttgctaaattataaaattgaaaacactaacaaaatttgaataataaatcgatccatgttttgtaacaaattcactgtgttatttaaggaaaaaaaggtaagctatgcttagtgccaacaataagtggccattcgtaaagcagtgttttagcatttcttgtgctggcttgtaatgtagggaaaaaaagtgctgttttttgaaaagatggtgtcatttcccccttcttcccatgttttaaagccccatcttatatccagttcccaaaatttgcatacttacctaagtattttttttaggtgtgctgtgtttggggaatatttgaaaatttaaagcatgatttaaaattttttaaagtgagctgtgacactggaaagctcttcattttatcttttaaaatagagttttttctatttatatatgtaaaattgtagtgtatttcttttcaccaaacagtgtgtgggacattctttatcactgttttaggatcacctcaggaagtgtcgttacccagaattccccactgtctgctatgagacttgtaactttatcactatacttctgcttggtgccatcttgtcagagtaatatttgatgtctgtgatatgtaaagaattatcctaggataaagatattaaactttaagcagatttcagatgttactgctttaaaacaaatcagggataacaaattaaacgtataacttaaaatatgcaatgacatttagaggtaaccaatgttgatataggtagcatagcctagcctcctccccaaaattgcttttacaactaacactgatactaatttaggatagttcatgccttatccttgctaagaaaatggaattgatggtaggcaggtgctaaagtgcttttcaaaacaatattacgttagaatacaattggattcttcctcaaatttatacaggccaaaaagtaaaacattaattttctgaatttccagattaccaatcaattaatcaacaaatagccagtattatgctgtgtatttctgtcaggtcattttaaaatccatgttaattttataaaagaattttttacatgtcactgtcaggagctcactgtgaatgtgttgtcttcaaatggttatttaaccacacagtacactacattttacatatatgtacgtaatctctgggaatagtaaattaattatgttatttataaacaatacataggtcaacagactttaagcagggaggaaaagaagagtaatagcgtctgtgtgctgcagaccattcagaactgtcacgtgtgtccccatggtctcattcattgtattcctagcaattcccttttcaatgttgagttcacctctttatttcacaaagtacttggtctctcaatttcttgatctggttttgcttccatttaaaaactaatcaagaagggaaaatattgagaatgtgcatacaagaaaatcattaatttcctgaagatgaatttctacctgttgtgaacatttaactttctttttaaaagttaaacaaaaataaacaagggatattatgatgaatgtttggcttatgtgagtactagagataaaatttttaaacccagttattcacaatataaaatgttttcaagttagaaaaaatttttagaaatcctgggtattgtatttaactgtagctaaccaattttaaaacttgtattcttttgagaactattattaatagaaaaactttttataagcagtaaaataagaatgttccagtgactacctgtccttatacctagtcttgttaaaactttcttttgcagggtatttagtgtttggtttacagtcagtgcagagtgggcaagttaacagaaagtttgagctagagatactggaaaaaaaaaagatcaaagaatgagaaaaatggtgatccattttggggcaaactgagaccccccaaataactctttcctcatgtgtatggtgctcctcatgactcgtcttgtattttgcctttctgatacccatcagaactgctgctgctctaacttatactctttaccttgcccagatctccgcgtaaggaatgctttatgatcaacttgccataggactgatggattaaccagtgttcggctttatttgaagtctatgccctgcacagctcttgtatgtattttagatgctagaagtttttttagcatgtgatgtgtgattcttgtttgaattctaggtaccttgtgaattccagaaaaagagactgtgcttcacgattgttagtcccatgaacttgcactatctatctttcatggtgatgttttgaaaatacaatcaggaaaaaacccaacacctttggaatttaaaatagaatcatatcatgaaatttaaaaagaatctcttctgttgcatttcctcacccctaagtaacagctacatttaagtaaaatgcaggtggtaggggaaaaaaaaccatggcgagatggtggtttagtggaataaactgattactggtttttttgtttttttttttttttttaaagaaagaagcttcatcacagatactttccagtttctcttttatacttttttgaaagattactttttaggaacatttggtatgatatgcataaaattatttatccatttatgggcaaaatgatacaagtagcatcttgattgaacatcatttacctcagatattcaaccagcagtacgttttttatgcagtctcaacccatatcccatttgttacctctcagaatattggtaagcagttattttcgctttactctgtatttcttgtgttttgggcacaggttattgtactactgtcaaatcgtacttgctattttttctgcaagtatttaacagaaagcttaaaatccccataaaaccccaccttggataagtgattgttaaatattgtacaaataaaatgtatgctatccccattccatccccaagttaaataaaaaaatgaatacggtatg

SEQ ID NO: 104240 - DNA, 11821 bp, Homo sapiens
  Payload ID: 478
  Gene Symbol: ACVR2B
  Gene Name: activin A receptor, type IIB
  Uniprot ID: Q13705
  ENST ID: ENST00000352511
  CDS Start-End: 473-2011
cgcccgcctctttgtatccaacatccgggtttccccgctggctcggctccgtggccgccgctcaggagccattttggactcggttcagctcccctcccccccacccctccccccgttcatggcccctccggactcggcccctgcgcccggggcccgggcccagccccgccgcgctatgcctgagtcgggcgcgccccggcccgtgccccgccgccgccccccggcccccgcgtcgccccggagcccgggccgcagcctgcgccgcccgcagcggccctgagcccggccccgccgaccggcccttggagcccgaacgctgctcggggacgaaggcgcaggaagcgcgcagggaacgagaccgaaggaaggagcgggaaggagagcgcagccgccgcctggccctgcgcgccccgggagcgccgtgcggccctgcccgcgggctccgggtgtgcgcggggcggcgccgcggaacatgacggcgccctgggtggccctcgccctcctctggggatcgctgtgcgccggctctgggcgtggggaggctgagacacgggagtgcatctactacaacgccaactgggagctggagcgcaccaaccagagcggcctggagcgctgcgaaggcgagcaggacaagcggctgcactgctacgcctcctggcgcaacagctctggcaccatcgagctcgtgaagaagggctgctggctagatgacttcaactgctacgataggcaggagtgtgtggccactgaggagaacccccaggtgtacttctgctgctgtgaaggcaacttctgcaacgaacgcttcactcatttgccagaggctgggggcccggaagtcacgtacgagccacccccgacagcccccaccctgctcacggtgctggcctactcactgctgcccatcgggggcctttccctcatcgtcctgctggccttttggatgtaccggcatcgcaagcccccctacggtcatgtggacatccatgaggaccctgggcctccaccaccatcccctctggtgggcctgaagccactgcagctgctggagatcaaggctcgggggcgctttggctgtgtctggaaggcccagctcatgaatgactttgtagctgtcaagatcttcccactccaggacaagcagtcgtggcagagtgaacgggagatcttcagcacacctggcatgaagcacgagaacctgctacagttcattgctgccgagaagcgaggctccaacctcgaagtagagctgtggctcatcacggccttccatgacaagggctccctcacggattacctcaaggggaacatcatcacatggaacgaactgtgtcatgtagcagagacgatgtcacgaggcctctcatacctgcatgaggatgtgccctggtgccgtggcgagggccacaagccgtctattgcccacagggactttaaaagtaagaatgtattgctgaagagcgacctcacagccgtgctggctgactttggcttggctgttcgatttgagccagggaaacctccaggggacacccacggacaggtaggcacgagacggtacatggctcctgaggtgctcgagggagccatcaacttccagagagatgccttcctgcgcattgacatgtatgccatggggttggtgctgtgggagcttgtgtctcgctgcaaggctgcagacggacccgtggatgagtacatgctgccctttgaggaagagattggccagcacccttcgttggaggagctgcaggaggtggtggtgcacaagaagatgaggcccaccattaaagatcactggttgaaacacccgggcctggcccagctttgtgtgaccatcgaggagtgctgggaccatgatgcagaggctcgcttgtccgcgggctgtgtggaggagcgggtgtccctgattcggaggtcggtcaacggcactacctcggactgtctcgtttccctggtgacctctgtcaccaatgtggacctgccccctaaagagtcaagcatctaagcccaggacatgagtgtctgtccagactcagtggatctgaagaaaaaaggaaaaaaagttgtgttttgttttggaaatcccataaaaccaacaaacacataaaatgcagctgctattttaccttgactttttattattattattataattattataattattattattaatattattttttggattggatcagtttttaccagcatattgctctactgtatcacaaacagcggacacgtcagcaggcgttgaggtgctgagctgtggatgcagaaccagcgccatgctgaagagcctcagccacctcctgtcctttgggattcgtttttcccgctttctctttgtttgtcgtctcagaatctgtgacacaaagaaacccatctcctgtcttaggaaacctaatgctgcaaactctacctagaggaacctttgaagactgttacataagaacataccttcctcagaagaggagtttcctctgccctctgcccttctcccctgcctccctccctcccctccttttattttgttttagtgagcttaagaaacagcagatgtgtctttcacggatctaacgggtgttgtcctgatcgagaaaaaaactgggatgagaatggtttggactggagttggaaggggaggacggtactgggggtagggtttggaacagagctacactggactcgggcacattcggagcagcatcctttagtatggaggctacttctcaggtaaccaggaattgaggggaaggaccttgtggaggccgagcattaacagcaagagcggggtttggagaaagtctgagattgggtgcagccctgacttacctgctggccctgaccagtttcttttcactaacttggccttgggcataggatgaaacattttttctgccctaattttaaaactaggtgagggtagaatcatcacaggttaggaatacattcttcataagacacgatgctgtaaatacccttaatggacgaaaagttgaaatacttttgtttcctcttggagcagttcagggaaatgcccacaggggattgtcctgcacagatagggcaagaggatttcctgggtggagtctgccaaggcctgcctcgctggggaccccagagtcctgcacctctggttccgccccaggtggtgacattactgtccccgttctgtggctcgtggacaagactttctccagaccccttaaagtggtacatattctaaaaaactgtttttctattatgccataaccttgctctagtcagtgaatgttcctaatgctgctgtttcaacatttgaattctttttaatttatgaaacatgctaaattttttttttcaaacaaaacacacacatccacatatacacatgcttcgctatgtggcttccaaggtttaaattttgaaaagtaaaagaattaaaacttcacgaccacagatcacctcaaaccagaaatacctcagaattttctacttatgtaaggtttattatatattttgttagttgtgttgtcttgtagtaagtatattttaatgtaagttggcttttgtgacaaggaagtttaaaagaaatagagaaaaagaaaaaagtttgcatcttctagggagtgctaccatttttgtttgataacgcccccttgtaaataattgtcatcaactgtaggttggctgtctgggccaagtctgggcatttatcagtcttgtttgtgaaggcttttccttctggtttctttagatcattttatttaaaaacagtgcatctcttcatcgtgagggtaggcaaggcgggggccgtggggagaggttgacctgggtgagaactgaagaggccgcctcctcttgggttgtttggagcttcacatgtaattcacatgtaacatgtaacttgatcggtcagtgttcagaatgacaagtaaccccgcttaaacttggtagaaggatggcccttagacctgaatggggtgattttacttgggatttaacttcttcagcaaattaacagcaacgttggaagagatctgtggcgcctctgtgaagcacaccgtgactcaggccagtcttttagtgcagcgtgtctgggagtgaagggttttgcccttgctggtcttggagtccacagtgtgaggggcactgcacatgcctgggcatctacctagtgtgctatgttcagtgtctggggcttactgccccggggtcctttcctctgggtgttggggcacagggtgctatgggaggcccatttgcttccctctcggagctcagtttttgcttcatgggtcaaaatgtgggctggccaagtggttacaggaacagggtttcggtaagctatgttgtctttttttttttttttttttttttttttaatggtttgattttgtgctgtggtattttttttcccttagaataatttttaatggcaaaacaggccttacagcagttgcttttctttaccatttatttctttaagaagctttaaaatatttattgaaaagtgccatatctaatttctttagctttcgcctcaggcagtgcaggcatctttacttttcatcctcagaagaaacaaacgactaacaaatgtagcaaatttactgcaggaatagttaggtcatgatactacctgaacactaaaccccagcctctttgtttggttttagttcctctgggtggtttttcttttgtgtgctggcttgattcttgtgagaagttttgacctggccaagggagggttgagccatggttctggtgtgggactttgcggtcaagacacagtacagacaggtcaggcctgcgtgccttttctctgggtggcctccccgttaggcccaccgtacgctcagccactatagtgtccctgtggggccttgccatcagattgtgtgtcaggagatggtacctttttggtgtggctggggaggagtgtggtccatgccagttctttgggcttcaggccactcttcccctcatgctgtggtgtaaagtgcacccatcaggtggtatatctggttctgatggcaagaagaaggtgggggatctccttatagggcatgggtctaggagcacagatgggccttttgccccgggtaaatgcttgtctgtttgctgtcatgtgttctttgaggagtgagccatctcgagccctgctttgaatttactgggtcatagagcctctgcctgtgctcttttccataatgacttcatgtgacatgcacttttggtgggctcagataattggtttctttttgtttttgacctcaggctctgtggcagactggggaaaatggggcctggcatcattttccctgtcaatgggaggggctgttccatgcagggtgggaggggaccaagttagcagagagtagccaaggatccttgcttcttcctttctagtgtgctgtcatccaagcaggctcctggctgtagggatgggccttggggaagaatcttctttgaaagcatctatgataactgagaagtcatccctagttggagaaatccagtaatgagcagaaggaggaagcaagtgaggacagaggccattgtattacagtgtcacgcagagggccctcaatgatggggcattggggaaggctgtagacatagtcatcagaacatcctggcctggcataagctgggttttctcctgggaccattggtcctcagcaggagttctttgcatgagttgctcaggggcaagggctgcaagtgggctgtgcttaggagaaagtgacacctggcagtgagggaagatggtgagcattattagcctttgttgtccagcatggccttcttgtcctgtctgctctggagaggagcctgtgggaccagtcctgcctggggagggcatacccacacgtgccagctgattctgactctgaatacatcatgtccggacttgggggtgtttctgcagaaaaaggaggttgtttttcagccttgaacatcttcaggaggatagagactcttgctcacatattcttagcaaagggaagggtctctcatctccaggccacagagatagttcttccattgccctaagaggctaggctaaccctcttgacataacttagacagcaaagcacttcatcctgtagttgggctctgtcacctttctcttcagttggccacattctcgtttcctccatcctgctatgctttgtgtgctcgggctgtgtgtggggtttttccctggtggaaggaagcccagctgtgtattgaatgtccttcatgtgttgtgtgtggctcagaaagcctgtcacttggcccctgtgctctgagccgtgagggtggggaggtggctgttccattaaagtgggagtattggatggccctcttgaaactagaattttgccttttttagtatgcagtataaagtttccagcatctattggtaacacaaagatttgctggtttttaaaataatacagtaagcataagtatgtaagtttttagaattggtactagaagttggacagctagttattctcgagaactttatttcactagaaaaatatactaattggaaagcagtttccaggagttaactcagtttaattttcagtctcagttattttagcctgttgagtttttgatggcacacctttggagagatggccacgcctgattcccatttcaggggcatcagaccatacctttttaagaagctccgtgaatctagtcatctacccttcatcctgggcgaacagccaaaaagagaaggggacaaggtgtctttttctccttctcactggggtgacatgaattcttttagttaatggctgtttgcaaattctaaactaatgaaatacttagcagctaacatgttcaatctagtaatgatgagtttaaatctcaattgacagtaatgttttagataaacaggcccagtaattcagttgatgaactgtatatcttctcagtctagatttgtaaatgtttaatgaattcagggttataagcatagttctttaagtaagattccagatagttgatttgcaaccagcagtctacctatgaatgtatcccaaacctttagaagattggaaaagatttttgaaataatgatttagttttgtaggaaaaacacccccttgaaaattaattcggttgacccagtaacattttttaaaacaattggtggctccaaaaggcctgccaacaaagaaaagtccaaattatctagtgggacattttgaatgttttatgtttattttgggtccactgtaaactttggttcaaaaaagaatttgaatttaaagaatttaccattatttaaattattaccaagtttttacattttcatgatggtattttccaggtatgaatgaaacatgactttttgattgtggtacttcctgtatcccctgtagtgccaaaaccagtgatactttatttgctcctatggcagctcatagaggtaaccgaagtgatttttcctcagtaattgaaacacatattctctaaatgccaatgtgtggtgatgggccctgcactgccttcatttctctagggcagtgtctttggattgtctagggcctaggtaattctgagaactactgtaaaccaaccacagggcactaaagcaatgtacacaccactctttgtgtgtatggaaggggttatataaacctgggctatgctggacatctacagaagagtattacattcacttgcaaagtttacatttttgagctcacagttatgaaaaatatgacccacaagtttttcaggcaggtgaggatgggtcttcttgcaaatgcatgagttctgtcttgagtcctgggaacttctctgttggttgagtgtgggctcattccctgactctcctaatcatgtttgcgtcagaatgttagcattgtaaataaaagaataggttgtataatagatacacaacacttgaaactttactttaaaaaaatcgatagttctacatatatatttagttatatcacttgacagatttcttctacacagtgtggagattgttttataccacagattatttttataaagttagtgaatttgaatgattttgtaatcagagctaatgagctttacctttcaagagaaacgtacactggagcatgagtggtgtggaacttttacttagtgtttatatggattcttgtgatacactggcagactggagtcaatttgcgggtcttttttggccaaaactccacttgtggttgtgtaggacagtgatattcagctcagcttcttgtggattgggaggagagagggcctgcaatgtgttttacattggtgcttcctcctgagatttctgttgaacaaagggttctgaggtcaaaaattagtttgtaagcctttgccataggacatagtcatgtgagagtgtttgggggaacagaaattgtataggggtgcctattggggtgggatgggactcgaataagattcaggtacaaaaactttgaaatgagaatctggtggtttgagtaatccaccagactgaattatctaagatcacattatccaggttggggggcagaattacccagttaagtaattgttcagaaaagtggggagggtggcatgtggatgcagtgatccaattaaatggagagctgccaggcacattttgtcctctctggtcagtgagaatggttgggttggctcgctgcttcaatctgtggaatcagccaggagcccagtgaggaagctcagaaccccagtaacagcagagcatctttcagatagctccagagttttcctgcttttctgaggaagctcagcatcactgccacaatacggaaagtggtcttcattttagcctatttatttttaggcagagagtggatggttatttgtgtgggacttttggtggcgatatataatgaataattaagttaatttctggtatgcataatggccagtcctgaggcccagctgaagacctgtcccccagaccctgcccgctggcttcaggctgctgcttctagacagaggtgcactggacgggatagttttatcaagagaatccctaatgtgtcattttaaaccagctgtgctttttattcattctggttgagcgtataggtttacactttaccctttttatacttggaataaatttagttccagcagatctagtagcactccagaaaccaaccccatctgttccccataaaaagaacattttctctgctctccagccacgtgtcttggaatgtaattctgttgtgcctttgtttttatcactctcttcgccccaaaagcaactgctgtaagcttttttctacttgtcttttctagtccccaacctctacctttttcctttttcccagccctaatttctggatgcacttctgtgatccaggtattttaagaaccagttacctcagacctcatgttgaacagtgtcgccatctgggtcctcttgatactgcagacttttaacgtacacatgcaggaaccctgctgagcgtgggcacttgttttaaagcaaaactcttcccaaggactgaagaaagggcttctggcaagctcgtcatggcattgtggtgggatgggtctagagtgtcatctgaatggtgcttcctgtgttcctctttgaattctgccattttcagtattcttgtgtgtctgaataggcaaagcgatttaattggctggtcttgcacgcaaattagttccaaagataagctctttgtaacacatttccagtcgctaatgctcaaatgtagaacattcctttaaatggcaggataaaaaacccactatccaccatagtgcattttgggaagatgtctgtagcatatgttgctgtgaaattaggccttgtgggatatggctgtttgtcattttgatgtattttaaataaatatatatattttttaaagagccttttttaccagttcaaaaagtttaattaaccagcagtcaccgcatctgaatttttgtctctggggcatagatggcagaccaagattaaaagtggtaactcagctatacgagcatgggctaccttcctgggctctcctgcagtcctgtagacctgctgttccgcagaccatgggacacaaggtcagtgtgttcccagtgagggtcccaagtcagtcatcttaagtgtttgttctctgccccattcagtggactgttgacttcagtccctgcaagtgctttagcccgagtggggttttctcagagcactgccacgagttaagtgtgtgtttagccaaataatttctccgtaagggaaaaatgcagtcacccaaattttaccaacaatgacagagatgagagtagaaaagattaggcaacatctgagttttaacttgaaaagtgtccaagtcatcatgaaaggccgactgggagcaagtgattattagagattcttcaggagacctcatctgaaaatgttaagactgccagtgagggaaggaattgttaaaatgccagcggcttttttttcctctttttttctgtaattctgtaaaaatgcagagaaagttgagtggtacttcagaattgagggagagggttaccgcagagtagaaatatatttctagatttcagttccacaccacaaatccacaacaatgccatttttcaactgtacaaaaatctgcttatgaactggacatgatcttaatggtagtgtcaaaggccaagtttttcacctgttaatatttttccacatttgtccttgaatctgaataactttatacagtactgtaaatttaacttacatcgagtttgttgtcaattcttatgaaaagagctttctgcatgtaacacatacggttaaagaacacagcaaaggacaaaatttgcaggaacagttttggaaccaacagaaaatgtcaccttttatttgccatcttatatatatctatcagttttaccagctacttctaaatttgtacattatttgtaagggaaagaaggaaaaccctaagacttgtctaacttagtggagaatgtgtgtgttgggcttaggatggatagctaagtcttattgagctgtgttacctaacttgtatataaaaattgtaattaaaagtttgggttcacctgtttctcacagtttaaaatgatgagtaattgcaaactctggaaatgtgactagtatatgatttaaggctgtagaagcaaggaagctctttcaagtgctaaaactaaagacttctagtttttggctcaaataagtactgtttgtataccaggatatgtgagatgtaaatgtagtaggtcacttttcacccttgtagctataaaataaaaattttgtagaacagaaatagcttgtactactgaattaacaaaagttatactaaagtatcatgtttaaaaaaaatatatatatatatacagagttaagcttgttgctgttaccctgtctggatttgaaaagtgtgctgatttatatatatatattacacacacacacacacacacacacacacacacacacacacacacacacacacacacacacacacacacacacatacacctaaaatggcctaaagcagacatccatgtaattacagttgcaaaatgaaaacattttggaaagaacattgtatcatagttcattcatttgcagtggatctttgttcctttttactgtggtaattttagaaatgagtgtcaagtttgaaattagatctgctaagttggggttttgctgcttgaactctgcactgggtcctcaaataaaccgatgtgaatgtagttttttccccctgtgtgaagaagcagttacaccccaacaataggaggaaaaatctagaactatttcaagttttatctttttgtatatgaaaataaaataataataaaacaa

SEQ ID NO: 104241 - DNA, 5963 bp, Homo sapiens
  Payload ID: 479
  Gene Symbol: ADNP
  Gene Name: activity-dependent neuroprotector homeobox
  Uniprot ID: Q9H2P0
  ENST ID: ENST00000349014
  CDS Start-End: 298-3606
aatattcttaactagtcaaactgagtcatgtgtactctgctctgctggaaaagtgactttctgtcttccatcaatcgtggcagaggcgtttccaagaggaggctgggcaggcaaaaacaggtgtctaaaccctactgattgagggctggctatgtgtattctaagctggaagaaatggactgttgaaggggaagaagaaccatgtcttactcatctctctattcctagcacagttgagtggctaagtgcaagtgctctgaaaatgattgtctaacagatgaacaatatatagaaactatgttccaacttcctgtcaacaatcttggcagtttaagaaaagcccggaaaactgtgaaaaaaatacttagtgacattgggttggaatactgtaaagaacatatagaagattttaaacaatttgaacctaatgacttttatttgaaaaacactacatgggaggatgtaggactgtgggacccatcacttacgaaaaaccaggactatcggacaaaacctttctgctgcagcgcttgtccattttcctcaaaattcttctctgcctacaaaagtcatttccgcaatgtccatagtgaagactttgaaaataggattctccttaattgcccctactgtaccttcaatgcagacaaaaagactttggaaacacacattaaaatatttcatgctccgaacgccagcgcaccaagtagcagcctcagcactttcaaagataaaaacaaaaatgatggccttaaacctaagcaggctgacagtgtagagcaagctgtttattactgtaagaagtgcacttaccgagatcctctttatgaaatagttaggaagcacatttacagggaacattttcagcatgtggcagcaccttacatagcaaaggcaggagaaaaatcactcaatggggcagtccccttaggctcgaatgcccgagaagagagtagtattcactgcaagcgatgccttttcatgccaaagtcctatgaagctttggtacagcatgtcatcgaagaccatgaacgtataggctatcaggtcactgccatgattgggcacacaaatgtagtggttccccgatccaaacccttgatgctaattgctcccaaacctcaagacaagaagagcatgggactcccaccaaggatcggttcccttgcttctggaaatgtccggtctttaccatcacagcagatggtgaatcgactctcaataccaaagcctaacttaaattctacaggagtcaacatgatgtccagtgttcatctgcagcagaacaactatggagtcaaatctgtaggccagggttacagtgttggtcagtcaatgagactgggtctaggtggcaacgcaccagtttccattcctcaacaatctcagtctgtaaagcagttacttccaagtggaaacggaaggtcttatgggcttgggtcagagcagaggtcccaggcaccagcaagatactccctgcagtctgctaatgcctcttctctctcatcgggccagttaaagtctccttccctctctcagtcacaggcatccagagtgttaggtcagtccagttccaaacctgctgcagctgccacaggccctcccccaggtaacacttcctcaactcaaaagtggaaaatatgtacaatctgtaatgagctttttcctgaaaatgtctatagtgtgcacttcgaaaaagaacataaagctgagaaagtcccagcagtagccaactacattatgaaaatacacaattttactagcaaatgcctctactgtaatcgctatttacccacagatactctgctcaaccatatgttaattcatggtctgtcttgtccatattgccgttcaactttcaatgatgtggaaaagatggccgcacacatgcggatggttcacattgatgaagagatgggacctaaaacagattctactttgagttttgatttgacattgcagcagggtagtcacactaacatccatctcctggtaactacatacaatctgagggatgccccagctgaatctgttgcttaccatgcccaaaataatcctccagttcctccaaagccacagccaaaggttcaggaaaaggcagatatccctgtaaaaagttcacctcaagctgcagtgccctataaaaaagatgttgggaaaaccctttgtcctctttgcttttcaatcctaaaaggacccatatctgatgcacttgcacatcacttacgagagaggcaccaagttattcagacggttcatccagttgagaaaaagctcacctacaaatgtatccattgccttggtgtgtataccagcaacatgaccgcctcaactatcactctgcatctagttcactgcaggggcgttggaaagacccaaaatggccaggataagacaaatgcaccctctcggcttaatcagtctccaagtctggcacctgtgaagcgcacttacgagcaaatggaatttcccttactgaaaaaacgaaagttagatgatgatagtgattcacccagcttctttgaagagaagcctgaagagcctgttgttttagctttagaccccaagggtcatgaagatgattcctatgaagccaggaaaagctttctaacaaagtatttcaacaaacagccctatcccaccaggagagaaattgagaagctagcagccagtttatggttatggaagagtgacatcgcttcccattttagtaacaaaaggaagaagtgtgtccgtgattgtgaaaagtacaagcctggcgtgttgctggggtttaacatgaaagaattaaataaagtcaagcatgagatggattttgatgctgagtggctatttgaaaatcatgatgagaaggattccagagtcaatgctagtaagactgctgacaaaaagctcaaccttgggaaggaagatgacagttcctcagacagttttgaaaatttggaagaagaatccaatgaaagtggtagcccttttgaccctgtttttgaagttgaacctaaaatctctaacgataacccagaggaacatgtactgaaggtaattcctgaggatgcttcagaatctgaggagaagctagaccaaaaagaggatggttcaaaatacgaaactattcatttgactgaggaaccaaccaaactaatgcacaatgcatctgatagtgaggttgaccaagacgatgttgttgagtggaaagacggtgcttctccatctgagagtgggcctggatcccaacaagtgtcagactttgaggacaatacctgcgaaatgaaaccaggaacctggtctgacgagtcttcccaaagcgaagatgcaaggagcagtaagccagctgccaaaaaaaaggctaccatgcaaggtgacagagagcagttgaaatggaagaatagttcctatggaaaagttgaagggttttggtctaaggaccagtcacagtggaagaatgcatctgagaatgatgagcgcttatctaacccccagattgagtggcagaatagcacaattgacagtgaggatggggaacagtttgacaacatgactgatggagtagctgagcccatgcatggcagcttagccggagttaaactgagcagccaacaggcctaagtgccaggttccctggcgttggtgacatgctgcagcctggaactctgatatccagtgtgactgcaaagctgtcttctcactggtactgccttgtgagtactggttggactgtggggcatgtggccgctgcagttccagtggttatttctaagtctatgacaggacaggctgttcttgcttcagaaccttctctgacagacacggtaactaaatgtgaaaaaccaataagctggtgactcatgaatacacacgaggaaaagcagaggtttattttatctgccttttcaacatttctttccctctgtgaaatgattggtcagatgtctttgagaagtgttaaactaattcacatggtagtgtagggccaacatacaagctaccagtctaatgtgtatagtagactttgggaaaagcgattttttttcatgtattcattctgaatagttgaaatgtatatttgtacagtcttttagacctattcaagtgatgctcatgatcctgttactgtgtgcccatcatagatttctttttttagtgttgcccttgctgtgtaataaacgctctatctagtttacctagcaaaagctcaaaactgcgctagtatggactttttggacagacttagtttttgcacataaccttgtacaatcttgcaacagaggccagccacgtaagatatatatctggactctcttgtattataggatttttcttgttctgaatatccttgacattacagctgtcaaaaacaaaaactggtatttcagatctgttttctgaaatcttttaagctaaaatcacatgcaagaattgactttgcagctactaattttgacaccttttagatctgtataaaagtgtgttgtgttgaagcagcaaaccaatgagtgctgcattttggatatttagttttatctttagttcaacaccatcatggtggattcatttataccatctaatatatgacacactgttgtagtatgtataattttgtgatctttattttccctttgtattcattttaagcatctaaataaattgctgtattgtgcttaatgtaaatatttgctttattacacatgacagtcctgtgtgtccattatatcttttgccatttaatgccataactctttcatcagagatggcagccacagtcacagaggaaacttgtggaaaacccaagatctgtcatctgcaaatagaatgctttctcttgaggcacctggtacaaaatctgtttttcttttttttttttttttttttttttttttttaactgaaaaacaaacacccttgagtttttcagttcaccttttgttaaggagcagagcctgcatatatatgtaaatgtctcaatgataaaaaaaaaaatgtaaacatggattggcattaatttgcaagcagaatcttaatagcctgatgggttttttgtttgttttttcttctagatgaagttaaacgttcgttttcaccttacgatgggaacaactgtagtgcaggcggctctgcctctatttgccactcttggccctcttgctattaagggaaaggctttgaagagcacagcactgacagggctgtaaagatggaaggagctggtatttttaccatgcgtagattcccaagagaacttgtactaaaaagcagaaagttacaaggaagcagaattaggccaacatttccagcaattaaaacaatgatgggaaactccaatccatgaggaggctggtcagtcacctcaaggatagtggcctaaagaagtctgaagtggctgatgtccataacttctgagtctgtttccaaaagaaagactcttgttaatgctgttaccagagagtagagatttgaccagcctctccctaaaatgtaagcttctcaacaacagtacaggaagaagtgcaagagtagactagaacctttaaggaatttggggctggaacggagctatgttgcatctgttgttatacaggtagattataagttctacatgcaccagccaaaacttaggacaggatgtccccaaattaagatactacagattaccaaatcagaaataaccagctggatttaggccagctcacatttatttggaaattaccctccctgattaacaggcttctgagttgtacgtggaggactaatgagacttgtacaagacaccacggggcttggggtccaggtcccagttggatatcggaacagacacagataagtgtgtttcctcattaaggtggtgagagtgtgccttttggcattcagaaaagggtttagccaccctaagagttggaaataaagattcccaactggaaatgttgcagaatccctacaagtgtctcaataaaagccattttaaaagaa

SEQ ID NO: 104242 - DNA, 6115 bp, Homo sapiens
  Payload ID: 479
  Gene Symbol: ADNP
  Gene Name: activity-dependent neuroprotector homeobox
  Uniprot ID: Q9H2P0
  ENST ID: ENST00000371602
  CDS Start-End: 321-3629
ttgagcccagaaggttgaggctatggtgaatcgtgagtgcactgcagtcaatgaaccatgagtgcactgcactccagcctgcgcgacagagtaagactctgtcttaagaaaaggaaggaaggatggatggatggatatatcaagccatatgcacatgaaagcaggtgtgtgtctgtgtgtgtacacactagatgaggatatctatgcaccttttttgtcagatgggtaggttttatgatcctatcatcagtggaattagtaaatattacaagttgtacgtgttttgactttgacttaaatttttttttccaatagaaactatgttccaacttcctgtcaacaatcttggcagtttaagaaaagcccggaaaactgtgaaaaaaatacttagtgacattgggttggaatactgtaaagaacatatagaagattttaaacaatttgaacctaatgacttttatttgaaaaacactacatgggaggatgtaggactgtgggacccatcacttacgaaaaaccaggactatcggacaaaacctttctgctgcagcgcttgtccattttcctcaaaattcttctctgcctacaaaagtcatttccgcaatgtccatagtgaagactttgaaaataggattctccttaattgcccctactgtaccttcaatgcagacaaaaagactttggaaacacacattaaaatatttcatgctccgaacgccagcgcaccaagtagcagcctcagcactttcaaagataaaaacaaaaatgatggccttaaacctaagcaggctgacagtgtagagcaagctgtttattactgtaagaagtgcacttaccgagatcctctttatgaaatagttaggaagcacatttacagggaacattttcagcatgtggcagcaccttacatagcaaaggcaggagaaaaatcactcaatggggcagtccccttaggctcgaatgcccgagaagagagtagtattcactgcaagcgatgccttttcatgccaaagtcctatgaagctttggtacagcatgtcatcgaagaccatgaacgtataggctatcaggtcactgccatgattgggcacacaaatgtagtggttccccgatccaaacccttgatgctaattgctcccaaacctcaagacaagaagagcatgggactcccaccaaggatcggttcccttgcttctggaaatgtccggtctttaccatcacagcagatggtgaatcgactctcaataccaaagcctaacttaaattctacaggagtcaacatgatgtccagtgttcatctgcagcagaacaactatggagtcaaatctgtaggccagggttacagtgttggtcagtcaatgagactgggtctaggtggcaacgcaccagtttccattcctcaacaatctcagtctgtaaagcagttacttccaagtggaaacggaaggtcttatgggcttgggtcagagcagaggtcccaggcaccagcaagatactccctgcagtctgctaatgcctcttctctctcatcgggccagttaaagtctccttccctctctcagtcacaggcatccagagtgttaggtcagtccagttccaaacctgctgcagctgccacaggccctcccccaggtaacacttcctcaactcaaaagtggaaaatatgtacaatctgtaatgagctttttcctgaaaatgtctatagtgtgcacttcgaaaaagaacataaagctgagaaagtcccagcagtagccaactacattatgaaaatacacaattttactagcaaatgcctctactgtaatcgctatttacccacagatactctgctcaaccatatgttaattcatggtctgtcttgtccatattgccgttcaactttcaatgatgtggaaaagatggccgcacacatgcggatggttcacattgatgaagagatgggacctaaaacagattctactttgagttttgatttgacattgcagcagggtagtcacactaacatccatctcctggtaactacatacaatctgagggatgccccagctgaatctgttgcttaccatgcccaaaataatcctccagttcctccaaagccacagccaaaggttcaggaaaaggcagatatccctgtaaaaagttcacctcaagctgcagtgccctataaaaaagatgttgggaaaaccctttgtcctctttgcttttcaatcctaaaaggacccatatctgatgcacttgcacatcacttacgagagaggcaccaagttattcagacggttcatccagttgagaaaaagctcacctacaaatgtatccattgccttggtgtgtataccagcaacatgaccgcctcaactatcactctgcatctagttcactgcaggggcgttggaaagacccaaaatggccaggataagacaaatgcaccctctcggcttaatcagtctccaagtctggcacctgtgaagcgcacttacgagcaaatggaatttcccttactgaaaaaacgaaagttagatgatgatagtgattcacccagcttctttgaagagaagcctgaagagcctgttgttttagctttagaccccaagggtcatgaagatgattcctatgaagccaggaaaagctttctaacaaagtatttcaacaaacagccctatcccaccaggagagaaattgagaagctagcagccagtttatggttatggaagagtgacatcgcttcccattttagtaacaaaaggaagaagtgtgtccgtgattgtgaaaagtacaagcctggcgtgttgctggggtttaacatgaaagaattaaataaagtcaagcatgagatggattttgatgctgagtggctatttgaaaatcatgatgagaaggattccagagtcaatgctagtaagactgctgacaaaaagctcaaccttgggaaggaagatgacagttcctcagacagttttgaaaatttggaagaagaatccaatgaaagtggtagcccttttgaccctgtttttgaagttgaacctaaaatctctaacgataacccagaggaacatgtactgaaggtaattcctgaggatgcttcagaatctgaggagaagctagaccaaaaagaggatggttcaaaatacgaaactattcatttgactgaggaaccaaccaaactaatgcacaatgcatctgatagtgaggttgaccaagacgatgttgttgagtggaaagacggtgcttctccatctgagagtgggcctggatcccaacaagtgtcagactttgaggacaatacctgcgaaatgaaaccaggaacctggtctgacgagtcttcccaaagcgaagatgcaaggagcagtaagccagctgccaaaaaaaaggctaccatgcaaggtgacagagagcagttgaaatggaagaatagttcctatggaaaagttgaagggttttggtctaaggaccagtcacagtggaagaatgcatctgagaatgatgagcgcttatctaacccccagattgagtggcagaatagcacaattgacagtgaggatggggaacagtttgacaacatgactgatggagtagctgagcccatgcatggcagcttagccggagttaaactgagcagccaacaggcctaagtgccaggttccctggcgttggtgacatgctgcagcctggaactctgatatccagtgtgactgcaaagctgtcttctcactggtactgccttgtgagtactggttggactgtggggcatgtggccgctgcagttccagtggttatttctaagtctatgacaggacaggctgttcttgcttcagaaccttctctgacagacacggtaactaaatgtgaaaaaccaataagctggtgactcatgaatacacacgaggaaaagcagaggtttattttatctgccttttcaacatttctttccctctgtgaaatgattggtcagatgtctttgagaagtgttaaactaattcacatggtagtgtagggccaacatacaagctaccagtctaatgtgtatagtagactttgggaaaagcgattttttttcatgtattcattctgaatagttgaaatgtatatttgtacagtcttttagacctattcaagtgatgctcatgatcctgttactgtgtgcccatcatagatttctttttttagtgttgcccttgctgtgtaataaacgctctatctagtttacctagcaaaagctcaaaactgcgctagtatggactttttggacagacttagtttttgcacataaccttgtacaatcttgcaacagaggccagccacgtaagatatatatctggactctcttgtattataggatttttcttgttctgaatatccttgacattacagctgtcaaaaacaaaaactggtatttcagatctgttttctgaaatcttttaagctaaaatcacatgcaagaattgactttgcagctactaattttgacaccttttagatctgtataaaagtgtgttgtgttgaagcagcaaaccaatgagtgctgcattttggatatttagttttatctttagttcaacaccatcatggtggattcatttataccatctaatatatgacacactgttgtagtatgtataattttgtgatctttattttccctttgtattcattttaagcatctaaataaattgctgtattgtgcttaatgtaaatatttgctttattacacatgacagtcctgtgtgtccattatatcttttgccatttaatgccataactctttcatcagagatggcagccacagtcacagaggaaacttgtggaaaacccaagatctgtcatctgcaaatagaatgctttctcttgaggcacctggtacaaaatctgtttttcttttttttttttttttttttttttttttttaactgaaaaacaaacacccttgagtttttcagttcaccttttgttaaggagcagagcctgcatatatatgtaaatgtctcaatgataaaaaaaaaaatgtaaacatggattggcattaatttgcaagcagaatcttaatagcctgatgggttttttgtttgttttttcttctagatgaagttaaacgttcgttttcaccttacgatgggaacaactgtagtgcaggcggctctgcctctatttgccactcttggccctcttgctattaagggaaaggctttgaagagcacagcactgacagggctgtaaagatggaaggagctggtatttttaccatgcgtagattcccaagagaacttgtactaaaaagcagaaagttacaaggaagcagaattaggccaacatttccagcaattaaaacaatgatgggaaactccaatccatgaggaggctggtcagtcacctcaaggatagtggcctaaagaagtctgaagtggctgatgtccataacttctgagtctgtttccaaaagaaagactcttgttaatgctgttaccagagagtagagatttgaccagcctctccctaaaatgtaagcttctcaacaacagtacaggaagaagtgcaagagtagactagaacctttaaggaatttggggctggaacggagctatgttgcatctgttgttatacaggtagattataagttctacatgcaccagccaaaacttaggacaggatgtccccaaattaagatactacagattaccaaatcagaaataaccagctggatttaggccagctcacatttatttggaaattaccctccctgattaacaggcttctgagttgtacgtggaggactaatgagacttgtacaagacaccacggggcttggggtccaggtcccagttggatatcggaacagacacagataagtgtgtttcctcattaaggtggtgagagtgtgccttttggcattcagaaaagggtttagccaccctaagagttggaaataaagattcccaactggaaatgttgcagaatccctacaagtgtctcaataaaagccattttaaaagaatattgttgctactgtttgcttttcaaataatctggagatcgttggctatggcaacgtgctgccacctaattagagaatgcctgtaaatgtaggctgaacacttctaacatgagaaaacctaagtatcct

SEQ ID NO: 104243 - DNA, 6261 bp, Homo sapiens
  Payload ID: 479
  Gene Symbol: ADNP
  Gene Name: activity-dependent neuroprotector homeobox
  Uniprot ID: Q9H2P0
  ENST ID: ENST00000396029
  CDS Start-End: 596-3904
atcttgtgccccctccccctcccgcaggcagcgctaagggggattttggcgtcttctcagacacagctccctctctcggtccccgctgctgaggagcgagaggagcgcggccgccgccgcccgcgccggtgaagccgcctctcccacaccctccgtctcctccctccgcccctcctttgtctgcaccgctcgacgacgccgccgccgcccgccgctctgctgcgcccgccgcgccccccggcagcacccgcggccgcggcgcgagccggagtccgccgagccggagcgcgacgaggccccgggcgcgccctccccgctgccgccaccgccgtgccgccgccatccgcccgccgccgccgccgctgtccggcccccgagcacgccggccccgcgcgcgcctcgaggccgagtcaaggtgtgagatgcacaatgcgaaacctaggccccagcttttacaccatgatgcgcagggttgtactttttgtactgaactgataggtggcctagtggttatgccctgtactaccattttgaggatctggactccgtttcctgccttgctctttggaccacattgtcaattcacaccgaaactatgttccaacttcctgtcaacaatcttggcagtttaagaaaagcccggaaaactgtgaaaaaaatacttagtgacattgggttggaatactgtaaagaacatatagaagattttaaacaatttgaacctaatgacttttatttgaaaaacactacatgggaggatgtaggactgtgggacccatcacttacgaaaaaccaggactatcggacaaaacctttctgctgcagcgcttgtccattttcctcaaaattcttctctgcctacaaaagtcatttccgcaatgtccatagtgaagactttgaaaataggattctccttaattgcccctactgtaccttcaatgcagacaaaaagactttggaaacacacattaaaatatttcatgctccgaacgccagcgcaccaagtagcagcctcagcactttcaaagataaaaacaaaaatgatggccttaaacctaagcaggctgacagtgtagagcaagctgtttattactgtaagaagtgcacttaccgagatcctctttatgaaatagttaggaagcacatttacagggaacattttcagcatgtggcagcaccttacatagcaaaggcaggagaaaaatcactcaatggggcagtccccttaggctcgaatgcccgagaagagagtagtattcactgcaagcgatgccttttcatgccaaagtcctatgaagctttggtacagcatgtcatcgaagaccatgaacgtataggctatcaggtcactgccatgattgggcacacaaatgtagtggttccccgatccaaacccttgatgctaattgctcccaaacctcaagacaagaagagcatgggactcccaccaaggatcggttcccttgcttctggaaatgtccggtctttaccatcacagcagatggtgaatcgactctcaataccaaagcctaacttaaattctacaggagtcaacatgatgtccagtgttcatctgcagcagaacaactatggagtcaaatctgtaggccagggttacagtgttggtcagtcaatgagactgggtctaggtggcaacgcaccagtttccattcctcaacaatctcagtctgtaaagcagttacttccaagtggaaacggaaggtcttatgggcttgggtcagagcagaggtcccaggcaccagcaagatactccctgcagtctgctaatgcctcttctctctcatcgggccagttaaagtctccttccctctctcagtcacaggcatccagagtgttaggtcagtccagttccaaacctgctgcagctgccacaggccctcccccaggtaacacttcctcaactcaaaagtggaaaatatgtacaatctgtaatgagctttttcctgaaaatgtctatagtgtgcacttcgaaaaagaacataaagctgagaaagtcccagcagtagccaactacattatgaaaatacacaattttactagcaaatgcctctactgtaatcgctatttacccacagatactctgctcaaccatatgttaattcatggtctgtcttgtccatattgccgttcaactttcaatgatgtggaaaagatggccgcacacatgcggatggttcacattgatgaagagatgggacctaaaacagattctactttgagttttgatttgacattgcagcagggtagtcacactaacatccatctcctggtaactacatacaatctgagggatgccccagctgaatctgttgcttaccatgcccaaaataatcctccagttcctccaaagccacagccaaaggttcaggaaaaggcagatatccctgtaaaaagttcacctcaagctgcagtgccctataaaaaagatgttgggaaaaccctttgtcctctttgcttttcaatcctaaaaggacccatatctgatgcacttgcacatcacttacgagagaggcaccaagttattcagacggttcatccagttgagaaaaagctcacctacaaatgtatccattgccttggtgtgtataccagcaacatgaccgcctcaactatcactctgcatctagttcactgcaggggcgttggaaagacccaaaatggccaggataagacaaatgcaccctctcggcttaatcagtctccaagtctggcacctgtgaagcgcacttacgagcaaatggaatttcccttactgaaaaaacgaaagttagatgatgatagtgattcacccagcttctttgaagagaagcctgaagagcctgttgttttagctttagaccccaagggtcatgaagatgattcctatgaagccaggaaaagctttctaacaaagtatttcaacaaacagccctatcccaccaggagagaaattgagaagctagcagccagtttatggttatggaagagtgacatcgcttcccattttagtaacaaaaggaagaagtgtgtccgtgattgtgaaaagtacaagcctggcgtgttgctggggtttaacatgaaagaattaaataaagtcaagcatgagatggattttgatgctgagtggctatttgaaaatcatgatgagaaggattccagagtcaatgctagtaagactgctgacaaaaagctcaaccttgggaaggaagatgacagttcctcagacagttttgaaaatttggaagaagaatccaatgaaagtggtagcccttttgaccctgtttttgaagttgaacctaaaatctctaacgataacccagaggaacatgtactgaaggtaattcctgaggatgcttcagaatctgaggagaagctagaccaaaaagaggatggttcaaaatacgaaactattcatttgactgaggaaccaaccaaactaatgcacaatgcatctgatagtgaggttgaccaagacgatgttgttgagtggaaagacggtgcttctccatctgagagtgggcctggatcccaacaagtgtcagactttgaggacaatacctgcgaaatgaaaccaggaacctggtctgacgagtcttcccaaagcgaagatgcaaggagcagtaagccagctgccaaaaaaaaggctaccatgcaaggtgacagagagcagttgaaatggaagaatagttcctatggaaaagttgaagggttttggtctaaggaccagtcacagtggaagaatgcatctgagaatgatgagcgcttatctaacccccagattgagtggcagaatagcacaattgacagtgaggatggggaacagtttgacaacatgactgatggagtagctgagcccatgcatggcagcttagccggagttaaactgagcagccaacaggcctaagtgccaggttccctggcgttggtgacatgctgcagcctggaactctgatatccagtgtgactgcaaagctgtcttctcactggtactgccttgtgagtactggttggactgtggggcatgtggccgctgcagttccagtggttatttctaagtctatgacaggacaggctgttcttgcttcagaaccttctctgacagacacggtaactaaatgtgaaaaaccaataagctggtgactcatgaatacacacgaggaaaagcagaggtttattttatctgccttttcaacatttctttccctctgtgaaatgattggtcagatgtctttgagaagtgttaaactaattcacatggtagtgtagggccaacatacaagctaccagtctaatgtgtatagtagactttgggaaaagcgattttttttcatgtattcattctgaatagttgaaatgtatatttgtacagtcttttagacctattcaagtgatgctcatgatcctgttactgtgtgcccatcatagatttctttttttagtgttgcccttgctgtgtaataaacgctctatctagtttacctagcaaaagctcaaaactgcgctagtatggactttttggacagacttagtttttgcacataaccttgtacaatcttgcaacagaggccagccacgtaagatatatatctggactctcttgtattataggatttttcttgttctgaatatccttgacattacagctgtcaaaaacaaaaactggtatttcagatctgttttctgaaatcttttaagctaaaatcacatgcaagaattgactttgcagctactaattttgacaccttttagatctgtataaaagtgtgttgtgttgaagcagcaaaccaatgagtgctgcattttggatatttagttttatctttagttcaacaccatcatggtggattcatttataccatctaatatatgacacactgttgtagtatgtataattttgtgatctttattttccctttgtattcattttaagcatctaaataaattgctgtattgtgcttaatgtaaatatttgctttattacacatgacagtcctgtgtgtccattatatcttttgccatttaatgccataactctttcatcagagatggcagccacagtcacagaggaaacttgtggaaaacccaagatctgtcatctgcaaatagaatgctttctcttgaggcacctggtacaaaatctgtttttcttttttttttttttttttttttttttttttaactgaaaaacaaacacccttgagtttttcagttcaccttttgttaaggagcagagcctgcatatatatgtaaatgtctcaatgataaaaaaaaaaatgtaaacatggattggcattaatttgcaagcagaatcttaatagcctgatgggttttttgtttgttttttcttctagatgaagttaaacgttcgttttcaccttacgatgggaacaactgtagtgcaggcggctctgcctctatttgccactcttggccctcttgctattaagggaaaggctttgaagagcacagcactgacagggctgtaaagatggaaggagctggtatttttaccatgcgtagattcccaagagaacttgtactaaaaagcagaaagttacaaggaagcagaattaggccaacatttccagcaattaaaacaatgatgggaaactccaatccatgaggaggctggtcagtcacctcaaggatagtggcctaaagaagtctgaagtggctgatgtccataacttctgagtctgtttccaaaagaaagactcttgttaatgctgttaccagagagtagagatttgaccagcctctccctaaaatgtaagcttctcaacaacagtacaggaagaagtgcaagagtagactagaacctttaaggaatttggggctggaacggagctatgttgcatctgttgttatacaggtagattataagttctacatgcaccagccaaaacttaggacaggatgtccccaaattaagatactacagattaccaaatcagaaataaccagctggatttaggccagctcacatttatttggaaattaccctccctgattaacaggcttctgagttgtacgtggaggactaatgagacttgtacaagacaccacggggcttggggtccaggtcccagttggatatcggaacagacacagataagtgtgtttcctcattaaggtggtgagagtgtgccttttggcattcagaaaagggtttagccaccctaagagttggaaataaagattcccaactggaaatgttgcagaatccctacaagtgtctcaataaaagccattttaaaagaa

SEQ ID NO: 104244 - DNA, 4581 bp, Homo sapiens
  Payload ID: 479
  Gene Symbol: ADNP
  Gene Name: activity-dependent neuroprotector homeobox
  Uniprot ID: Q9H2P0
  ENST ID: ENST00000396032
  CDS Start-End: 171-3479
cggccgcggcgcgagccggagtccgccgagccggagcgcgacgaggccccgggcgcgccctccccgctgccgccaccgccgtgccgccgccatccgcccgccgccgccgccgctgtccggcccccgagcacgccggccccgcgcgcgcctcgaggccgagtcaagaaactatgttccaacttcctgtcaacaatcttggcagtttaagaaaagcccggaaaactgtgaaaaaaatacttagtgacattgggttggaatactgtaaagaacatatagaagattttaaacaatttgaacctaatgacttttatttgaaaaacactacatgggaggatgtaggactgtgggacccatcacttacgaaaaaccaggactatcggacaaaacctttctgctgcagcgcttgtccattttcctcaaaattcttctctgcctacaaaagtcatttccgcaatgtccatagtgaagactttgaaaataggattctccttaattgcccctactgtaccttcaatgcagacaaaaagactttggaaacacacattaaaatatttcatgctccgaacgccagcgcaccaagtagcagcctcagcactttcaaagataaaaacaaaaatgatggccttaaacctaagcaggctgacagtgtagagcaagctgtttattactgtaagaagtgcacttaccgagatcctctttatgaaatagttaggaagcacatttacagggaacattttcagcatgtggcagcaccttacatagcaaaggcaggagaaaaatcactcaatggggcagtccccttaggctcgaatgcccgagaagagagtagtattcactgcaagcgatgccttttcatgccaaagtcctatgaagctttggtacagcatgtcatcgaagaccatgaacgtataggctatcaggtcactgccatgattgggcacacaaatgtagtggttccccgatccaaacccttgatgctaattgctcccaaacctcaagacaagaagagcatgggactcccaccaaggatcggttcccttgcttctggaaatgtccggtctttaccatcacagcagatggtgaatcgactctcaataccaaagcctaacttaaattctacaggagtcaacatgatgtccagtgttcatctgcagcagaacaactatggagtcaaatctgtaggccagggttacagtgttggtcagtcaatgagactgggtctaggtggcaacgcaccagtttccattcctcaacaatctcagtctgtaaagcagttacttccaagtggaaacggaaggtcttatgggcttgggtcagagcagaggtcccaggcaccagcaagatactccctgcagtctgctaatgcctcttctctctcatcgggccagttaaagtctccttccctctctcagtcacaggcatccagagtgttaggtcagtccagttccaaacctgctgcagctgccacaggccctcccccaggtaacacttcctcaactcaaaagtggaaaatatgtacaatctgtaatgagctttttcctgaaaatgtctatagtgtgcacttcgaaaaagaacataaagctgagaaagtcccagcagtagccaactacattatgaaaatacacaattttactagcaaatgcctctactgtaatcgctatttacccacagatactctgctcaaccatatgttaattcatggtctgtcttgtccatattgccgttcaactttcaatgatgtggaaaagatggccgcacacatgcggatggttcacattgatgaagagatgggacctaaaacagattctactttgagttttgatttgacattgcagcagggtagtcacactaacatccatctcctggtaactacatacaatctgagggatgccccagctgaatctgttgcttaccatgcccaaaataatcctccagttcctccaaagccacagccaaaggttcaggaaaaggcagatatccctgtaaaaagttcacctcaagctgcagtgccctataaaaaagatgttgggaaaaccctttgtcctctttgcttttcaatcctaaaaggacccatatctgatgcacttgcacatcacttacgagagaggcaccaagttattcagacggttcatccagttgagaaaaagctcacctacaaatgtatccattgccttggtgtgtataccagcaacatgaccgcctcaactatcactctgcatctagttcactgcaggggcgttggaaagacccaaaatggccaggataagacaaatgcaccctctcggcttaatcagtctccaagtctggcacctgtgaagcgcacttacgagcaaatggaatttcccttactgaaaaaacgaaagttagatgatgatagtgattcacccagcttctttgaagagaagcctgaagagcctgttgttttagctttagaccccaagggtcatgaagatgattcctatgaagccaggaaaagctttctaacaaagtatttcaacaaacagccctatcccaccaggagagaaattgagaagctagcagccagtttatggttatggaagagtgacatcgcttcccattttagtaacaaaaggaagaagtgtgtccgtgattgtgaaaagtacaagcctggcgtgttgctggggtttaacatgaaagaattaaataaagtcaagcatgagatggattttgatgctgagtggctatttgaaaatcatgatgagaaggattccagagtcaatgctagtaagactgctgacaaaaagctcaaccttgggaaggaagatgacagttcctcagacagttttgaaaatttggaagaagaatccaatgaaagtggtagcccttttgaccctgtttttgaagttgaacctaaaatctctaacgataacccagaggaacatgtactgaaggtaattcctgaggatgcttcagaatctgaggagaagctagaccaaaaagaggatggttcaaaatacgaaactattcatttgactgaggaaccaaccaaactaatgcacaatgcatctgatagtgaggttgaccaagacgatgttgttgagtggaaagacggtgcttctccatctgagagtgggcctggatcccaacaagtgtcagactttgaggacaatacctgcgaaatgaaaccaggaacctggtctgacgagtcttcccaaagcgaagatgcaaggagcagtaagccagctgccaaaaaaaaggctaccatgcaaggtgacagagagcagttgaaatggaagaatagttcctatggaaaagttgaagggttttggtctaaggaccagtcacagtggaagaatgcatctgagaatgatgagcgcttatctaacccccagattgagtggcagaatagcacaattgacagtgaggatggggaacagtttgacaacatgactgatggagtagctgagcccatgcatggcagcttagccggagttaaactgagcagccaacaggcctaagtgccaggttccctggcgttggtgacatgctgcagcctggaactctgatatccagtgtgactgcaaagctgtcttctcactggtactgccttgtgagtactggttggactgtggggcatgtggccgctgcagttccagtggttatttctaagtctatgacaggacaggctgttcttgcttcagaaccttctctgacagacacggtaactaaatgtgaaaaaccaataagctggtgactcatgaatacacacgaggaaaagcagaggtttattttatctgccttttcaacatttctttccctctgtgaaatgattggtcagatgtctttgagaagtgttaaactaattcacatggtagtgtagggccaacatacaagctaccagtctaatgtgtatagtagactttgggaaaagcgattttttttcatgtattcattctgaatagttgaaatgtatatttgtacagtcttttagacctattcaagtgatgctcatgatcctgttactgtgtgcccatcatagatttctttttttagtgttgcccttgctgtgtaataaacgctctatctagtttacctagcaaaagctcaaaactgcgctagtatggactttttggacagacttagtttttgcacataaccttgtacaatcttgcaacagaggccagccacgtaagatatatatctggactctcttgtattataggatttttcttgttctgaatatccttgacattacagctgtcaaaaacaaaaactggtatttcagatctgttttctgaaatcttttaagctaaaatcacatgcaagaattgactttgcagctactaattttgacaccttttagatctgtataaaagtgtgttgtgttgaagcagcaaaccaatgagtgctgcattttggatatttagttttatctttagttcaacaccatcatggtggattcatttataccatctaatatatgacacactgttgtagtatgtataattttgtgatctttattttccctttgtattcattttaagcatctaaataaattgctgtattgtgcttaatgtaaatatttgctttattacacatgacagtcctgtgtgtccatta

SEQ ID NO: 104245 - DNA, 773 bp, Homo sapiens
  Payload ID: 479
  Gene Symbol: ADNP
  Gene Name: activity-dependent neuroprotector homeobox
  ENST ID: ENST00000534467
  CDS Start-End: 256-773
gcacaatgcgaaacctaggccccagcttttacaccatgatgcgcagggttgtactttttgtactgaactgataggtggcctagtggttatgccctgtactaccattttgaggatctggactccgtttcctgccttgctctttggaccacattgtcaattcacaccgaataccgtagcagtaggcaggacagttccaattcaacaaaaacctctttaccctggcactcaaaactgtaatgatgatgaactgaaactatgttccaacttcctgtcaacaatcttggcagtttaagaaaagcccggaaaactgtgaaaaaaatacttagtgacattgggttggaatactgtaaagaacatatagaagattttaaacaatttgaacctaatgacttttatttgaaaaacactacatgggaggatgtaggactgtgggacccatcacttacgaaaaaccaggactatcggacaaaacctttctgctgcagcgcttgtccattttcctcaaaattcttctctgcctacaaaagtcatttccgcaatgtccatagtgaagactttgaaaataggattctccttaattgcccctactgtaccttcaatgcagacaaaaagactttggaaacacacattaaaatatttcatgctccgaacgccagcgcaccaagtagcagcctcagcactttcaaagataaaaacaaaaatgatggccttaaacctaagcaggctgacagtgtagagcaagctgtttattactgtaagaagtgcacttaccg

SEQ ID NO: 104246 - DNA, 6224 bp, Homo sapiens
  Payload ID: 479
  Gene Symbol: ADNP
  Gene Name: activity-dependent neuroprotector homeobox
  Uniprot ID: Q9H2P0
  ENST ID: ENST00000621696
  CDS Start-End: 430-3738
cggccgcggcgcgagccggagtccgccgagccggagcgcgacgaggccccgggcgcgccctccccgctgccgccaccgccgtgccgccgccatccgcccgccgccgccgccgctgtccggcccccgagcacgccggccccgcgcgcgcctcgaggccgagtcaaggtgtgagatgcacaatgcgaaacctaggccccagcttttacaccatgatgcgcagggttgtactttttgtactgaactgataggtggcctagtggttatgccctgtactaccattttgaggatctggactccgtttcctgccttgctctttggaccacattgtcaattcacaccgaataccgtagcagtaggcaggacagttccaattcaacaaaaacctctttaccctggcactcaaaactgtaatgatgatgaactgaaactatgttccaacttcctgtcaacaatcttggcagtttaagaaaagcccggaaaactgtgaaaaaaatacttagtgacattgggttggaatactgtaaagaacatatagaagattttaaacaatttgaacctaatgacttttatttgaaaaacactacatgggaggatgtaggactgtgggacccatcacttacgaaaaaccaggactatcggacaaaacctttctgctgcagcgcttgtccattttcctcaaaattcttctctgcctacaaaagtcatttccgcaatgtccatagtgaagactttgaaaataggattctccttaattgcccctactgtaccttcaatgcagacaaaaagactttggaaacacacattaaaatatttcatgctccgaacgccagcgcaccaagtagcagcctcagcactttcaaagataaaaacaaaaatgatggccttaaacctaagcaggctgacagtgtagagcaagctgtttattactgtaagaagtgcacttaccgagatcctctttatgaaatagttaggaagcacatttacagggaacattttcagcatgtggcagcaccttacatagcaaaggcaggagaaaaatcactcaatggggcagtccccttaggctcgaatgcccgagaagagagtagtattcactgcaagcgatgccttttcatgccaaagtcctatgaagctttggtacagcatgtcatcgaagaccatgaacgtataggctatcaggtcactgccatgattgggcacacaaatgtagtggttccccgatccaaacccttgatgctaattgctcccaaacctcaagacaagaagagcatgggactcccaccaaggatcggttcccttgcttctggaaatgtccggtctttaccatcacagcagatggtgaatcgactctcaataccaaagcctaacttaaattctacaggagtcaacatgatgtccagtgttcatctgcagcagaacaactatggagtcaaatctgtaggccagggttacagtgttggtcagtcaatgagactgggtctaggtggcaacgcaccagtttccattcctcaacaatctcagtctgtaaagcagttacttccaagtggaaacggaaggtcttatgggcttgggtcagagcagaggtcccaggcaccagcaagatactccctgcagtctgctaatgcctcttctctctcatcgggccagttaaagtctccttccctctctcagtcacaggcatccagagtgttaggtcagtccagttccaaacctgctgcagctgccacaggccctcccccaggtaacacttcctcaactcaaaagtggaaaatatgtacaatctgtaatgagctttttcctgaaaatgtctatagtgtgcacttcgaaaaagaacataaagctgagaaagtcccagcagtagccaactacattatgaaaatacacaattttactagcaaatgcctctactgtaatcgctatttacccacagatactctgctcaaccatatgttaattcatggtctgtcttgtccatattgccgttcaactttcaatgatgtggaaaagatggccgcacacatgcggatggttcacattgatgaagagatgggacctaaaacagattctactttgagttttgatttgacattgcagcagggtagtcacactaacatccatctcctggtaactacatacaatctgagggatgccccagctgaatctgttgcttaccatgcccaaaataatcctccagttcctccaaagccacagccaaaggttcaggaaaaggcagatatccctgtaaaaagttcacctcaagctgcagtgccctataaaaaagatgttgggaaaaccctttgtcctctttgcttttcaatcctaaaaggacccatatctgatgcacttgcacatcacttacgagagaggcaccaagttattcagacggttcatccagttgagaaaaagctcacctacaaatgtatccattgccttggtgtgtataccagcaacatgaccgcctcaactatcactctgcatctagttcactgcaggggcgttggaaagacccaaaatggccaggataagacaaatgcaccctctcggcttaatcagtctccaagtctggcacctgtgaagcgcacttacgagcaaatggaatttcccttactgaaaaaacgaaagttagatgatgatagtgattcacccagcttctttgaagagaagcctgaagagcctgttgttttagctttagaccccaagggtcatgaagatgattcctatgaagccaggaaaagctttctaacaaagtatttcaacaaacagccctatcccaccaggagagaaattgagaagctagcagccagtttatggttatggaagagtgacatcgcttcccattttagtaacaaaaggaagaagtgtgtccgtgattgtgaaaagtacaagcctggcgtgttgctggggtttaacatgaaagaattaaataaagtcaagcatgagatggattttgatgctgagtggctatttgaaaatcatgatgagaaggattccagagtcaatgctagtaagactgctgacaaaaagctcaaccttgggaaggaagatgacagttcctcagacagttttgaaaatttggaagaagaatccaatgaaagtggtagcccttttgaccctgtttttgaagttgaacctaaaatctctaacgataacccagaggaacatgtactgaaggtaattcctgaggatgcttcagaatctgaggagaagctagaccaaaaagaggatggttcaaaatacgaaactattcatttgactgaggaaccaaccaaactaatgcacaatgcatctgatagtgaggttgaccaagacgatgttgttgagtggaaagacggtgcttctccatctgagagtgggcctggatcccaacaagtgtcagactttgaggacaatacctgcgaaatgaaaccaggaacctggtctgacgagtcttcccaaagcgaagatgcaaggagcagtaagccagctgccaaaaaaaaggctaccatgcaaggtgacagagagcagttgaaatggaagaatagttcctatggaaaagttgaagggttttggtctaaggaccagtcacagtggaagaatgcatctgagaatgatgagcgcttatctaacccccagattgagtggcagaatagcacaattgacagtgaggatggggaacagtttgacaacatgactgatggagtagctgagcccatgcatggcagcttagccggagttaaactgagcagccaacaggcctaagtgccaggttccctggcgttggtgacatgctgcagcctggaactctgatatccagtgtgactgcaaagctgtcttctcactggtactgccttgtgagtactggttggactgtggggcatgtggccgctgcagttccagtggttatttctaagtctatgacaggacaggctgttcttgcttcagaaccttctctgacagacacggtaactaaatgtgaaaaaccaataagctggtgactcatgaatacacacgaggaaaagcagaggtttattttatctgccttttcaacatttctttccctctgtgaaatgattggtcagatgtctttgagaagtgttaaactaattcacatggtagtgtagggccaacatacaagctaccagtctaatgtgtatagtagactttgggaaaagcgattttttttcatgtattcattctgaatagttgaaatgtatatttgtacagtcttttagacctattcaagtgatgctcatgatcctgttactgtgtgcccatcatagatttctttttttagtgttgcccttgctgtgtaataaacgctctatctagtttacctagcaaaagctcaaaactgcgctagtatggactttttggacagacttagtttttgcacataaccttgtacaatcttgcaacagaggccagccacgtaagatatatatctggactctcttgtattataggatttttcttgttctgaatatccttgacattacagctgtcaaaaacaaaaactggtatttcagatctgttttctgaaatcttttaagctaaaatcacatgcaagaattgactttgcagctactaattttgacaccttttagatctgtataaaagtgtgttgtgttgaagcagcaaaccaatgagtgctgcattttggatatttagttttatctttagttcaacaccatcatggtggattcatttataccatctaatatatgacacactgttgtagtatgtataattttgtgatctttattttccctttgtattcattttaagcatctaaataaattgctgtattgtgcttaatgtaaatatttgctttattacacatgacagtcctgtgtgtccattatatcttttgccatttaatgccataactctttcatcagagatggcagccacagtcacagaggaaacttgtggaaaacccaagatctgtcatctgcaaatagaatgctttctcttgaggcacctggtacaaaatctgtttttcttttttttttttttttttttttttttttttaactgaaaaacaaacacccttgagtttttcagttcaccttttgttaaggagcagagcctgcatatatatgtaaatgtctcaatgataaaaaaaaaaatgtaaacatggattggcattaatttgcaagcagaatcttaatagcctgatgggttttttgtttgttttttcttctagatgaagttaaacgttcgttttcaccttacgatgggaacaactgtagtgcaggcggctctgcctctatttgccactcttggccctcttgctattaagggaaaggctttgaagagcacagcactgacagggctgtaaagatggaaggagctggtatttttaccatgcgtagattcccaagagaacttgtactaaaaagcagaaagttacaaggaagcagaattaggccaacatttccagcaattaaaacaatgatgggaaactccaatccatgaggaggctggtcagtcacctcaaggatagtggcctaaagaagtctgaagtggctgatgtccataacttctgagtctgtttccaaaagaaagactcttgttaatgctgttaccagagagtagagatttgaccagcctctccctaaaatgtaagcttctcaacaacagtacaggaagaagtgcaagagtagactagaacctttaaggaatttggggctggaacggagctatgttgcatctgttgttatacaggtagattataagttctacatgcaccagccaaaacttaggacaggatgtccccaaattaagatactacagattaccaaatcagaaataaccagctggatttaggccagctcacatttatttggaaattaccctccctgattaacaggcttctgagttgtacgtggaggactaatgagacttgtacaagacaccacggggcttggggtccaggtcccagttggatatcggaacagacacagataagtgtgtttcctcattaaggtggtgagagtgtgccttttggcattcagaaaagggtttagccaccctaagagttggaaataaagattcccaactggaaatgttgcagaatccctacaagtgtctcaataaaagccattttaaaagaatattgttgctactgtttgcttttcaaataatctggagatcgttggctatggcaacgtgctgccacctaattagagaatgcctgtaaatgtaggctgaacacttctaacatgagaaaacctaagtatcct

SEQ ID NO: 104247 - DNA, 2948 bp, Homo sapiens
  Payload ID: 480
  Gene Symbol: ARC
  Gene Name: activity-regulated cytoskeleton-associated protein
  Uniprot ID: Q7LC44
  ENST ID: ENST00000356613
  CDS Start-End: 202-1392
tcgggcgcggcgtcctccctccgcagcagccgagccggacctgcctccccgggcgtgctccgccggccccgccgccggcccgcagcgacagacaggcgctccccgcagctccgcacgggacccaggccgccggaccccagcgccggaccaccctctgtccgccccgaggagtttgccgcctgccggagcacctgcgcacagatggagctggaccaccggaccagcggcgggctccacgcctaccccgggccgcggggcgggcaggtggccaagcccaacgtgatcctgcagatcgggaagtgccgggccgagatgctggagcacgtgcggcggacgcaccggcacctgctggccgaggtgtccaagcaggtggagcgcgagctgaaggggctgcaccggtcggtcgggaagctggagagcaacctggacggctacgtgcccacgagcgactcgcagcgctggaagaagtccatcaaggcctgcctgtgccgctgccaggagaccatcgccaacctggagcgctgggtcaagcgcgagatgcacgtgtggcgcgaggtgttctaccgcctggagcgctgggccgaccgcctggagtccacgggcggcaagtacccggtgggcagcgagtcagcccgccacaccgtttccgtgggcgtggggggtcccgagagctactgccacgaggcagacggctacgactacaccgtcagcccctacgccatcaccccgcccccagccgctggcgagctgcccgggcaggagcccgccgaggcccagcagtaccagccgtgggtccccggcgaggacgggcagcccagccccggcgtggacacgcagatcttcgaggaccctcgagagttcctgagccacctagaggagtacttgcggcaggtgggcggctctgaggagtactggctgtcccagatccagaatcacatgaacgggccggccaagaagtggtgggagttcaagcagggctccgtgaagaactgggtggagttcaagaaggagttcctgcagtacagcgagggcacgctgtcccgagaggccatccagcgcgagctggacctgccgcagaagcagggcgagccgctggaccagttcctgtggcgcaagcgggacctgtaccagacgctctacgtggacgcggacgaggaggagatcatccagtacgtggtgggcaccctgcagcccaagctcaagcgtttcctgcgccaccccctgcccaagaccctggagcagctcatccagaggggcatggaggtgcaggatgacctggagcaggcggccgagccggccggcccccacctcccggtggaggatgaggcggagaccctcacgcccgcccccaacagcgagtccgtggccagtgaccggacccagcccgagtagagggcatcccggagcccccagcctgcccactacatccagcctgtggctttgcccaccaggacttttgagctggggctgactcctgcaggggaagccctggtccagctgggtgccccctcgagctccgggcggactcgcacacactcgtgtcatccagatgtgagcaccgcacccagcggcaaagagccctcccccctgcagggctccacccatcaccctccctccgtctgtctttccggcctggaccccaccctccacactctcaggccatcacagaacaccccagcttcctcattctgctacaacacccaggccctctggacatccagaaaaccaagtgtccggatggcaggggccagcggccaccaagctcatgggacacccagagcagaagctagggcagagccaatgctgagggagcctcgacttccggcgccgccgccctctcccggcatccgcagagccagctgacgccctccctgcctcccagggcagctggccagcctcgggcagcgcggccccctcctcccaggggagagtagaagtcgcacacgcagcagagcagacctgatgtcccggtgcttcctggcccctcagctccagtgattcacgcccgcctggagaagaatcagagctcagctcatgactcacccatggcaggcggagggtcccagaggggctgagtcctcaaatccggctgaggcagcagctggcaccatcagagccaggagagtgacaacaggtctcaaggttcccacaaagtctttgctgctgtgctgggcaccacccacccctcaccttgcaggctgcctgcgtgggaggcgaagtcccaggacagcccagaggggggctacagagaggagtcggctgcagcagagggcaggagccccagcttagccctgagcgccagcgcgaggaccagggcctgccactaagcccgccccgctggccgccagctgcccgtccccagagccactgcagcaggagtcgggccctgcctccctcccagcagggaaaccccgcccgctgccaggccatcctctctgccagaggctttcatgagccccaaggctggggccacagctcctacccctgcccagcagccctgagctcagctgcaggaaggacatcccagaagccatggctcctggggcgcttccaggcattctgccctgccccgacaccagaaccctggtgctggtgggccactagcgtctgcagcctaagcaggtgctggctcagggttcatcgttctgccttgtccactgggggaccagccctgcagaccactctgacaagtcttcagcccacaccctgccagccccacagattttatttttgcacataagccataaccaatcctcaaggctggcacaggctttggggaagccctggagcctgtgaagaccctggaaacctcatgaggctgtggccaacccctgccccttgccccacacagaccaggccttaaatgtcggtccaggccctgtgcaccttaccccagagacagactctttttgtaagattttgttaataaaacactgaaacttcctgga

SEQ ID NO: 104248 - DNA, 3220 bp, Homo sapiens
  Payload ID: 481
  Gene Symbol: APEH
  Gene Name: acylaminoacyl-peptide hydrolase
  Uniprot ID: P13798
  ENST ID: ENST00000296456
  CDS Start-End: 401-2599
ctcaaccccttctctcgtaggcccttctaccctccccgaagccgggctcccgggttccgcttccacagggccgccccctctcctccgagatccaacgcctcgcccctcggtaagaggcccaggactcagcccacggccccgccccccacttggctagtccgcccctggcgagacccctgctctcacccacccaggacttctcgctcccaggccgggtcctctcaccgtcaaggcccgccccctgccaacggtcctcacccattagccgaaggccccgcccctcacagattgccgcagggcaggggcggagacagcccgggccgtcccaggctccgcccccggaagcctcacttccgggcgcgagcacgccccgcctcgccccggcggcagagaggagactatggaacgtcaggtgctgctgagcgagcccgaggaggcggcggctctgtatcggggccttagccgccagcccgcgctgagcgccgcctgcctgggcccggaggtcaccacgcagtacggcggccaataccggacggtgcacactgagtggacccagagggacctggaacgcatggagaacattcgattctgccgccaatacctggtgttccatgacggggactcagtggtgtttgcaggacctgcaggcaacagtgtggagacccggggggaactgctgagcagagagtctccttcaggcaccatgaaagctgtgctgcgcaaggctggaggcacgggccctggggaagagaagcagttcctggaggtctgggagaagaaccggaagctcaagagcttcaacctgtcagcgctggagaaacatgggcctgtttatgaggatgactgctttggctgcctgtcctggtcgcactcggagacacacttgttgtatgtggcagagaagaagcgccccaaggccgagtccttctttcagaccaaagccttggacgtcagtgccagcgatgatgagatagccaggctgaagaagccagaccaagccatcaagggggatcagtttgtgttttatgaagactggggagaaaacatggtttccaaaagcatccctgtgctctgcgtgctggatgtcgagagtggcaacatctctgtgcttgagggggtccctgagaatgtgtcccctggacaggcattttgggcccctggagatgctggtgtggtgtttgtgggctggtggcatgagcccttccggttgggcatccgcttttgcaccaatcgcaggtcagccctgtattatgtggacctcatcggggggaagtgtgagctcctctcggatgactccctggctgtctcttctccccggctgagcccagaccaatgtcgcattgtctacctgcagtacccatctctgatcccccatcaccaatgcagccagctgtgcctgtatgactggtataccaaggttacctcagtggtggtagatgttgtgcctcggcagctgggagagaacttctctgggatctactgcagccttctgcctttgggatgctggtcagctgacagccagagagtggtctttgactcggctcagcgcagccggcaggacctgtttgctgtggacacccaagtgggcactgtgacctccctcacagctggagggtcaggtgggagctggaagttgctcacaattgaccaggacctcatggtggcacagttttccacacccagcctacctccaaccctgaaagttgggttcctgccttctgcagggaaggagcagtcagtgttgtgggtgtccctggaggaggccgagcccattcccgacatccactggggcatccgggtgctacagccacccccagagcaagagaatgtgcagtatgctggccttgactttgaagcaatcctgctgcagcctggcagccctccagataagacccaagtgcccatggtggtcatgccccacggggggccccattcatcctttgtcactgcctggatgctgttcccagccatgctttgcaagatgggctttgcggtactactagtgaactatcgtggctccacgggctttggccaggacagcatcctctccctcccaggcaatgtgggccaccaggatgtgaaggatgtccagtttgcagtggaacaggtgctccaggaggaacactttgatgcaagccatgtggcccttatgggtggttcccatggtggcttcatttcctgccacttgattggtcagtacccagagacctacagggcctgcgtggcccggaaccccgtgatcaacatcgcctccatgttgggctccactgacatccctgactggtgcgtggtggaggctggctttcctttcagcagtgactgcctgccagacctcagcgtgtgggctgagatgctggacaaatcgcccatcagatacatccctcaggtgaagacaccactgttactgatgttgggccaggaggaccggcgtgtgcccttcaagcagggcatggagtattaccgtgccctcaagacccggaatgtgcctgttcggctcctgctctatcccaaaagcacccacgcattatcagaggtggaggtggagtcagacagcttcatgaatgctgtgctctggctacgcacacacttgggcagctgaagccctgccattctgcatgagctgatcagcctgtgccacacttcgctcttgaggagctcaacggtctggcagggcagcaggaggctttctgggctctggactccacggatgcgtgggcagaggaatgtgggctatgtagtcataataaattaggacacagagcctggttcctgctggtactttgtaccaaaccatccccaaccccacctcccactctggggtgcagagaccctaggttctgggtgtggcagccacaagggcttcatctgcctccagtgtgagaagggagggaacagtgagaggcttagcctctgcctgtcctggcaaccaggactctgtaccagcctagcttccctgctgcagccccttccattagcaactactctgtaccacccttcccaagagtatgtctggaggactagtgtgaggccctgtctttccacggcacccatgggcaaaagtagtcccagggacattgccttggttggggaagcccctaggctggacagatcacctagcccagggtgtgctgggctcaagccacccgagccctagcaaggagtcactgacacatttcctggaagcaaaggctaagaagcatctgtacaggcataaagagga

SEQ ID NO: 104249 - DNA, 963 bp, Homo sapiens
  Payload ID: 481
  Gene Symbol: APEH
  Gene Name: acylaminoacyl-peptide hydrolase
  ENST ID: ENST00000447436
  CDS Start-End: 18-170
gcggcagagaggagactatggaacgtcaggtgctgctgagcgagcccgaggaggcggcggctctgtatcggggccttagccgccagcccgcgctgagcgccgcctgcctgggcccggaggtcaccacgcagtacggcggccaataccggacggtgcacactgactgctgagcagagagtctccttcaggcaccatgaaagctgtgctgcgcaaggctggaggcacgggccctggggaagagaagcagttcctggaggtctgggagaagaaccggaagctcaagagcttcaacctgtcagcgctggagaaacatgggcctgtttatgaggatgactgctttggctgcctgtcctggtcgcactcggagacacacttgttgtatgtggcagagaagaagcgccccaaggccgagtccttctttcagaccaaagccttggacgtcagtgccagcgatgatgagatagccaggctgaagaagccagaccaagccatcaaggcattttgggcccctggagatgctggtgtggtgtttgtgggctggtggcatgagcccttccggttgggcatccgcttttgcaccaatcgcaggtcagccctgtattatgtggacctcatcggggggaagtgtgagctcctctcggatgactccctggctgtctcttctccccggctgagcccagaccaatgtcgcattgtctacctgcagtacccatctctgatcccccatcaccaatgcagccagctgtgcctgtatgactggtataccaaggttacctcagtggtggtagatgttgtgcctcggcagctgggagagaacttctctgggatctactgcagccttctgcctttgggatgctggtcagctgacagccagagagtggtctttgactcggctcagcgcagccggcaggacctgtttgctgtggacacccaagtgggcactgtgacctccctcacagctgg

SEQ ID NO: 104250 - DNA, 924 bp, Homo sapiens
  Payload ID: 481
  Gene Symbol: APEH
  Gene Name: acylaminoacyl-peptide hydrolase
  ENST ID: ENST00000442186
  CDS Start-End: 1-924
acgccccgcctcgccccggcggcagagaggagactatggaacgtcagactgctgagcagagagtctccttcaggcaccatgaaagctgtgctgcgcaaggctggaggcacgggccctggggaagagaagcagttcctggaggtctgggagaagaaccggaagctcaagagcttcaacctgtcagcgctggagaaacatgggcctgtttatgaggatgactgctttggctgcctgtcctggtcgcactcggagacacacttgttgtatgtggcagagaagaagcgccccaaggccgagtccttctttcagaccaaagccttggacgtcagtgccagcgatgatgagatagccaggctgaagaagccagaccaagccatcaagggggatcagtttgtgttttatgaagactggggagaaaacatggtttccaaaagcatccctgtgctctgcgtgctggatgtcgagagtggcaacatctctgtgcttgagggggtccctgagaatgtgtcccctggacaggcattttgggcccctggagatgctggtgtggtgtttgtgggctggtggcatgagcccttccggttgggcatccgcttttgcaccaatcgcaggtcagccctgtattatgtggacctcatcggggggaagtgtgagctcctctcggatgactccctggctgtctcttctccccggctgagcccagaccaatgtcgcattgtctacctgcagtacccatctctgatcccccatcaccaatgcagccagctgtgcctgtatgactggtataccaaggttacctcagtggtggtagatgttgtgcctcggcagctgggagagaacttctctgggatctactgcagccttctgcctttgggatgctggtcagctgacagccagagagtggtctttgactcggctcagcgc

SEQ ID NO: 104251 - DNA, 708 bp, Homo sapiens
  Payload ID: 481
  Gene Symbol: APEH
  Gene Name: acylaminoacyl-peptide hydrolase
  ENST ID: ENST00000447541
  CDS Start-End: 1-165
actgctgagcagagagtctccttcaggcaccatgaaagctgtgctgcgcaaggctggaggcacgggccctggggaagagaagcagttcctggaggtctgggagaagaaccggaagctcaagagcttcaacctgtcagcgctggagaaacatgggcctgtttatgaggatgggggatcagtttgtgttttatgaagactggggagaaaacatggtttccaaaagcatccctgtgctctgcgtgctggatgtcgagagtggcaacatctctgtgcttgagggggtccctgagaatgtgtcccctggacaggcattttgggcccctggagatgctggtgtggtgtttgtgggctggtggcatgagcccttccggttgggcatccgcttttgcaccaatcgcaggtcagccctgtattatgtggacctcatcggggggaagtgtgagctcctctcggatgactccctggctgtctcttctccccggctgagcccagaccaatgtcgcattgtctacctgcagtacccatctctgatcccccatcaccaatgcagccagctgtgcctgtatgactggtataccaaggttacctcagtggtggtagatgttgtgcctcggcagctgggagagaacttctctgggatctactgcagccttctgcctttgggatgctggtcagctgacagccagagagtggtctttgactcggctc

SEQ ID NO: 104252 - DNA, 855 bp, Homo sapiens
  Payload ID: 481
  Gene Symbol: APEH
  Gene Name: acylaminoacyl-peptide hydrolase
  ENST ID: ENST00000446089
  CDS Start-End: 43-219
cgcgagcacgccccgcctcgccccggcggcagagaggagactatggaacgtcagactgctgagcagagagtctccttcaggcaccatgaaagctgtgctgcgcaaggctggaggcacgggccctggggaagagaagcagttcctggaggtctgggagaagaaccggaagctcaagagcttcaacctgtcagcgctggagaaacatgggcctgtttatgaggatgactgctttggctgcctgtcctggtcgcactcggagacacacttgttgtatgtggcagagaagaagcgccccaaggccgagtccttctttcagaccaaagccttggacgtcagtgccagcgatgatgagatagccaggctgaagaagccagaccaagccatcaaggcattttgggcccctggagatgctggtgtggtgtttgtgggctggtggcatgagcccttccggttgggcatccgcttttgcaccaatcgcaggtcagccctgtattatgtggacctcatcggggggaagtgtgagctcctctcggatgactccctggctgtctcttctccccggctgagcccagaccaatgtcgcattgtctacctgcagtacccatctctgatcccccatcaccaatgcagccagctgtgcctgtatgactggtataccaaggttacctcagtggtggtagatgttgtgcctcggcagctgggagagaacttctctgggatctactgcagccttctgcctttgggatgctggtcagctgacagccagagagtggtctttgactcggctcagcgcagccggcaggacctgtttgctgtggacacccaagtgggcactgtgacctccctcacagctgg

SEQ ID NO: 104253 - DNA, 853 bp, Homo sapiens
  Payload ID: 481
  Gene Symbol: APEH
  Gene Name: acylaminoacyl-peptide hydrolase
  ENST ID: ENST00000457042
  CDS Start-End: 1-853
caggtgctgctgagcgagcccgaggaggcggcggctctgtatcggggccttagccgccagcccgcgctgagcgccgcctgcctgggcccggaggtcaccacgcagtacggcggccaataccggacggtgcacactgagtggacccagagggacctggaacgcatggagaacattcgattctgccgccaatacctggtgttccatgacggggactcagtggtgtttgcaggacctgcaggcaacagtgtggagacccggggggaactgctgagcagagagtctccttcaggcaccatgaaagctgtgctgcgcaaggctggaggcacgggccctggggaagagaagcagttcctggaggtctgggagaagaaccggaagctcaagagcttcaacctgtcagcgctggagaaacatgggcctgtttatgaggatgactgctttggctgcctgtcctggtcgcactcggagacacacttgttgtatgtggcagagaagaagcgccccaaggccgagtccttctttcagaccaaagccttggacgtcagtgccagcgatgatgagatagccaggctgaagaagccagaccaagccatcaaggcattttgggcccctggagatgctggtgtggtgtttgtgggctggtggcatgagcccttccggttgggcatccgcttttgcaccaatcgcaggtcagccctgtattatgtggacctcatcggggggaagtgtgagctcctctcggatgactccctggctgtctcttctccccggctgagcccagaccaatgtcgcattgtctacctgcagtacccatctctgatcccccatcaccaatgcagccagctgtgcctgg

SEQ ID NO: 104254 - DNA, 825 bp, Homo sapiens
  Payload ID: 481
  Gene Symbol: APEH
  Gene Name: acylaminoacyl-peptide hydrolase
  ENST ID: ENST00000449966
  CDS Start-End: 129-825
tctcgtaggcccttctaccctccccgaagccgggctcccgggttccgcttccacagggccgccccctctcctccgagatccaacgcctcgcccctcgactgctgagcagagagtctccttcaggcaccatgaaagctgtgctgcgcaaggctggaggcacgggccctggggaagagaagcagttcctggaggtctgggagaagaaccggaagctcaagagcttcaacctgtcagcgctggagaaacatgggcctgtttatgaggatgactgctttggctgcctgtcctggtcgcactcggagacacacttgttgtatgtggcagagaagaagcgccccaaggccgagtccttctttcagaccaaagccttggacgtcagtgccagcgatgatgagatagccaggctgaagaagccagaccaagccatcaagggggatcagtttgtgttttatgaagactggggagaaaacatggtttccaaaagcatccctgtgctctgcgtgctggatgtcgagagtggcaacatctctgtgcttgagggggtccctgagaatgtgtcccctggacaggcattttgggcccctggagatgctggtgtggtgtttgtgggctggtggcatgagcccttccggttgggcatccgcttttgcaccaatcgcaggtcagccctgtattatgtggacctcatcggggggaagtgtgagctcctctcggatgactccctggctgtctcttctccccggctgagcccagaccaatgtcgcattgtctacctgcagtacccatctctgatcccccatcaccaatgcagccagctgtgcctgg

SEQ ID NO: 104255 - DNA, 2249 bp, Homo sapiens
  Payload ID: 481
  Gene Symbol: APEH
  Gene Name: acylaminoacyl-peptide hydrolase
  ENST ID: ENST00000438011
  CDS Start-End: 36-2249
acgccccgcctcgccccggcggcagagaggagactatggaacgtcaggtgctgctgagcgagcccgaggaggcggcggctctgtatcggggccttagccgccagcccgcgctgagcgccgcctgcctgggcccggaggtcaccacgcagtacggcggccaataccggacggtgcacactgagtggacccagagggacctggaacgcatggagaacattcgattctgccgccaatacctggtgttccatgacggggactcagtggtgtttgcaggacctgcaggcaacagtgtggagacccggggggaactgctgagcagagagtctccttcaggcaccatgaaagctgtgctgcgcaaggctggaggcacgggccctggggaagagaagcagttcctggaggtctgggagaagaaccggaagctcaagagcttcaacctgtcagcgctggagaaacatgggcctgtttatgaggatgactgctttggctgcctgtcctggtcgcactcggagacacacttgttgtatgtggcagagaagaagcgccccaaggccgagtccttctttcagaccaaagccttggacgtcagtgccagcgatgatgagatagccaggctgaagaagccagaccaagccatcaagggggatcagtttgtgttttatgaagactggggagaaaacatggtttccaaaagcatccctgtgctctgcgtgctggatgtcgagagtggcaacatctctgtgcttgagggggtccctgagaatgtgtcccctggacaggcattttgggcccctggagatgctggtgtggtgtttgtgggctggtggcatgagcccttccggttgggcatccgcttttgcaccaatcgcaggtcagccctgtattatgtggacctcatcggggggaagtgtgagctcctctcggatgactccctggctgtctcttctccccggctgagcccagaccaatgtcgcattgtctacctgcagtacccatctctgatcccccatcaccaatgcagccagctgtgcctgtatgactggtataccaaggttacctcagtggtggtagatgttgtgcctcggcagctgggagagaacttctctgggatctactgcagccttctgcctttgggatgctggtcagctgacagccagagagtggtctttgactcggctcagcgcagccggcaggacctgtttgctgtggacacccaagtgggcactgtgacctccctcacagctggagggtcaggtgggagctggaagttgctcacaattgaccaggacctcatggtggcacagttttccacacccagcctacctccaaccctgaaagttgggttcctgccttctgcagggaaggagcagtcagtgttgtgggtgtccctggaggaggccgagcccattcccgacatccactggggcatccgggtgctacagccacccccagagcaagagaatgtgcagtatgctggccttgactttgaagcaatcctgctgcagcctggcagccctccagataagacccaagtgcccatggtggtcatgccccacggggggccccattcatcctttgtcactgcctggatgctgttcccagccatgctttgcaagatgggctttgcggtactactagtgaactatcgtggctccacgggctttggccaggacagcatcctctccctcccaggcaatgtgggccaccaggatgtgaaggatgtccagtttgcagtggaacaggtgctccaggaggaacactttgatgcaagccatgtggcccttatgggtggttcccatggtggcttcatttcctgccacttgattggtcagtacccagagacctacagggcctgcgtggcccggaaccccgtgatcaacatcgcctccatgttgggctccactgacatccctgactgctcggtgtcttgcaggtgcgtggtggaggctggctttcctttcagcagtgactgcctgccagacctcagcgtgtgggctgagatgctggacaaatcgcccatcagatacatccctcaggtgaagacaccactgttactgatgttgggccaggaggaccggcgtgtgcccttcaagcagggcatggagtattaccgtgccctcaagacccggaatgtgcctgttcggctcctgctctatcccaaaagcacccacgcattatcagaggtggaggtggagtcagacagcttcatgaatgctgtgctctggctacgcacacacttgggcagctga

SEQ ID NO: 104256 - DNA, 830 bp, Homo sapiens
  Payload ID: 481
  Gene Symbol: APEH
  Gene Name: acylaminoacyl-peptide hydrolase
  ENST ID: ENST00000469362
  CDS Start-End: 1-144
cagagagtggtctttgactcggctcagcgcagccggcaggacctgtttgctgtggacacccaagtgggagctggaagttgctcacaattgaccaggacctcatggtggcacagttttccacacccagcctacctccaaccctgaaagttgggttcctgccttctgcagggaaggagcagtcagtgttgtgggtgtccctggaggaggccgagcccattcccgacatccactggggcatccgggtgctacagccacccccagagcaagagaatgtgcagtatgctggccttgactttgaagcaatcctgctgcagcctggcagccctccagataagacccaagtgcccatggtggtcatgccccacggggggccccattcatcctttgtcactgcctggatgctgttcccagccatgctttgcaagatgggctttgcggtactactagtgaactatcgtggctccacgggctttggccaggacagcatcctctccctcccaggcaatgtgggccaccaggatgtgaaggatgtccagtttgcagtggaacaggtgctccaggaggaacactttgatgcaagccatgtggcccttatgggtggttcccatggtggcttcatttcctgccacttgattggtcagtacccagagacctacagggcctgcgtggcccggaaccccgtgatcaacatcgcctccatgttgggctccactgacatccctgactggtgcgtggtggaggctggctttcctttcagcagtgactgcctgccagacctcagcgtgtgggctgagatgctggacaaatcgcccatcagatacatccctcag

SEQ ID NO: 104257 - DNA, 3573 bp, Homo sapiens
  Payload ID: 482
  Gene Symbol: ACBD3
  Gene Name: acyl-CoA binding domain containing 3
  Uniprot ID: Q9H3P7
  ENST ID: ENST00000366812
  CDS Start-End: 56-1642
ggaagtcgatacgtggctgccgtctgtccccgctgaggaggtgcagcagccggagatggcggcggtgctgaacgcagagcgactcgaggtgtccgtcgacggcctcacgctcagcccggacccggaggagcggcctggggcggagggcgccccgctgctgccgccaccgctgccaccgccctcgccacctggatccggtcgcggcccgggcgcctcaggggagcagcccgagcccggggaggcggcggctgggggcgcggcggaggaggcgcggcggctggagcagcgctggggtttcggcctggaggagttgtacggcctggcactgcgcttcttcaaagaaaaagatggcaaagcatttcatccaacttatgaagaaaaattgaagcttgtggcactgcataagcaagttcttatgggcccatataatccagacacttgtcctgaggttggattctttgatgtgttggggaatgacaggaggagagaatgggcagccctgggaaacatgtctaaagaggatgccatggtggagtttgtcaagctcttaaataggtgttgccatctcttttcaacatatgttgcgtcccacaaaatagagaaggaagagcaagaaaaaaaaaggaaggaggaagaggagcgaaggcggcgtgaagaggaagaaagagaacgtctgcaaaaggaggaagagaaacgtaggagagaagaagaggaaaggcttcgacgggaggaagaggaaaggagacggatagaagaagaaaggcttcggttggagcagcaaaagcagcagataatggcagctttaaactcccagactgccgtgcagttccagcagtatgcagcccaacagtatccagggaactacgaacagcagcaaattctcatccgccagttgcaggagcaacactatcagcagtacatgcagcagttgtatcaagtccagcttgcacagcaacaggcagcattacagaaacaacaggaagtagtagtggctgggtcttccttgcctacatcatcaaaagtgaatgcaactgtaccaagtaatatgatgtcagttaatggacaggccaaaacacacactgacagctccgaaaaagaactggaaccagaagctgcagaagaagccctggagaatggaccaaaagaatctcttccagtaatagcagctccatccatgtggacacgacctcagatcaaagacttcaaagagaagattcagcaggatgcagattccgtgattacagtgggccgaggagaagtggtcactgttcgagtacccacccatgaagaaggatcatatctcttttgggaatttgccacagacaattatgacattgggtttggggtgtattttgaatggacagactctccaaacactgctgtcagcgtgcatgtcagtgagtccagcgatgacgacgaggaggaagaagaaaacatcggttgtgaagagaaagccaaaaagaatgccaacaagcctttgctggatgagattgtgcctgtgtaccgacgggactgtcatgaggaggtgtatgctggcagccatcaatatccagggagaggagtctatctcctcaagtttgacaactcctactctttgtggcggtcaaaatcagtctactacagagtctattatactagataaaaatgttgttacaaagtctggagtctagggttgggcagaagatgacatttaatttggaaatttctttttacttttgtggagcattagagtcacagtttaccttattgatattggtctgatggtttgtgaactcttgctgggaatcaaaatttccttgagactctttagcattcatactttggggttaaaggagattcctcagactcatccagcccttgggtgctgaccagcagagtcactagtggatgctgaagttacatgagctacatgttaaatatttaaagtctccaaaataaaacaccccaacgttgaccttacccggctgatggttagccccttgctgcctgctccatgtgtcttatgagagcccgtagttacagtgtcctctaatttgaaatccataagttaacaagtctatatcaggtgcagctggctttgattaaaggccatttttaaaacttaaaaactcaacacctcacagattataatagaaaaagaaatggcctcagtttgatctcgttcagaatgacccagattgtttctgctttgggtgcagctgtttagttcagagttatattacagagaattattttctgagataatcttaaactagaatgttcaaaactaattgataattgaagtatcaagatacgtagaacacctcagagatttttcttcaggaacttccacaaactttgaatccttgtatctttatttggtattcatactactagtagcaaaatacaggttttttgttttgttttgttttgttttggcttcatagagtatctcaaattgaaacttttctgcacaaagaataaaattaaggattttataaactcaaattggcacctactgaattaaaatacataaaatcatttaaatataattcagcatatgggaagtaacattgcactaatatggaaatcactgccagagacagtctattttcttttaatttgttactacttagtcacaaaccccacattattccagtttggaattacttattaaggagaattggaaatacatatgcccatgcttaaattttatagctttaatttgtgttatttctttattgacgggaagaggtacatctttttttccttactgaaaacaaatatggattaattgcctcaaatttgtataagtgattggctagtgattcttgttttcagaagggagagtggtatagatagaaaatgacaaagatggcaatatacacttaatgttgttattgtatgttgttactgaagtacttagatttttaaaatttcaaatcctaaatcacttcttgtaggagggttttcattaactgcagtatatacagttcactacatatgggttgtttgagttttttgtgtgctgtatttctttctgttttttaatacctggttttgtacatatctaactctgttctcttttggttgttcagaaactggattttttttttcttaagcagtgcttaatttgtgttttttaattttgattcagaagtagtcccagctcataggtgttcatactgttacatccagaacatttgtcaggctctctgtcagctttcatgtacatatggtatagaaaccatggagttaggcacttcctggattttttttttatgagaaaaatactgtatttaaaatgtaaaataaacttttaaaaagcaggcactaatatatatttcttccagcctttgattacaaatttgtccttgcacatgttaagatgaattatctcctaaaaatatcattgttcttgggagcagtgtatgttactttacatagcagcggttcctgtcatgtgttcatgtcagaatatttttggttttaaactttcttattgcctttggctgttgattagtacagtacaagtgcgatttcaaaaagatcttgaaagtaatatatttaatcaattaaaatgtttatctgtaa

SEQ ID NO: 104258 - DNA, 1806 bp, Homo sapiens
  Payload ID: 483
  Gene Symbol: ACBD4
  Gene Name: acyl-CoA binding domain containing 4
  Uniprot ID: Q8NC06
  ENST ID: ENST00000321854
  CDS Start-End: 284-1201
ggcgagagaggacccaggtgtcctggcagtgggcgccgcggggcacacgctgggccaaggtgcaggcggccagggtgggagactgttcgccccgccctgagtactcctatcttgtttctccacctgttcgggagttggagatgtgcacctaaaggaggcgcatctggggacggacacatctggcactgaggccctcgccacctgcctcgccacctggcgaccctgaccccaccacactgccttgagagtcgctcaaaagtagggccccagggctcgcagcagcatgggcaccgagaaagaaagcccagagcccgactgccagaaacagttccaggctgcagtgagcgtcatccagaacctgcccaagaacggttcttaccgcccctcctatgaagagatgctgcgattctacagttactacaagcaggccaccatggggccctgcctggtcccccggcccgggttctgggaccccattggacgatataagtgggacgcctggaacagtctgggcaagatgagcagggaggaggccatgtctgcctacatcactgaaatgaaactggtggcacagaaggtgatcgacacagtgcccctgggtgaggtggcagaggacatgtttggttacttcgagcccctgtaccaggtgatccctgacatgccgaggcccccagagaccttcctgagaagggtcacaggttggaaagagcaggttgtgaatggagatgttggggctgtttcagagcctccctgcctccccaaggaaccggcacccccaagcccagagtcccattcacccagggacctggactccgaggttttctgtgattccctggagcagctggagcctgagctggtttggacagagcagcgggcagcatctggaggaaagcgtgatcccaggaacagccccgtgccccccacaaagaaagaggggttgcggggcagcccgccggggccccaggagttggacgtgtggctgctggggacagttcgagcactacaggagagcatgcaggaggtgcaggcgagggtgcagagcctggagagcatgccccggccccctgagcagaggccgcagcccaggcccagtgctcggccatggccccttgggctcccggggcccgcgctgctcttcttcctcctgtggcccttcgtcgtccagtggctcttccgaatgtttcggacccaaaagaggtgactgtcagtggaggggtctctgcagccaactgagactatcttgctgtgccctgagccttcctagggtttagaagaacagcattcaaaattccccgtcctgtcagtgtttgccttcgcacctcctcccctaaagcagcgcggggggcaaataagaccccacccctccctgcagcttcacagggacgcttccttccctccccgcaaccaccccaggctcccctgggaggctgcagttgtggtacacgtccccggtgctgggttggccgtgactcgggggcggggcgatcgggtctcagcccctgccttccccagtctctgggtcacccgaattttcccacccctgcttctccccgaggaggttgagctcttgagcaagttgggacttgggccggggcctggaagaatgattggctgggaggccgcgggagggaggccaggaggcccggaccagttgggaggagtgagcaggccccgggggagggggatgagcgcagtttgctcgctttcctcccctgccggccccctccgcccccacacacactcgggacgtcttcattgaagattcacttacaaaggaatgtttcactaaataaaagaaaaccagaa

SEQ ID NO: 104259 - DNA, 1453 bp, Homo sapiens
  Payload ID: 483
  Gene Symbol: ACBD4
  Gene Name: acyl-CoA binding domain containing 4
  Uniprot ID: Q8NC06
  ENST ID: ENST00000376955
  CDS Start-End: 298-1104
agccgcggggtggtggcgagagaggacccaggtgtcctggcagtgggcgccgcggggcacacgctgggccaaggtgcaggcggccagggtgggagactgttcgccccgccctgagtactcctatcttgtttctccacctgttcgggagttggagatgtgcacctaaaggaggcgcatctggggacggacacatctggcactgaggccctcgccacctgcctcgccacctggcgaccctgaccccaccacactgccttgagagtcgctcaaaagtagggccccagggctcgcagcagcatgggcaccgagaaagaaagcccagagcccgactgccagaaacagttccaggctgcagtgagcgtcatccagaacctgcccaagaacggttcttaccgcccctcctatgaagagatgctgcgattctacagttactacaagcaggccaccatggggccctgcctggtcccccggcccgggttctgggaccccattggacgatataagtgggacgcctggaacagtctgggcaagatgagcagggaggaggccatgtctgcctacatcactgaaatgaaactggtggcacagaaggtgatcgacacagtgcccctgggtgaggtggcagaggacatgtttggttacttcgagcccctgtaccaggtgatccctgacatgccgaggcccccagagaccttcctgagaagggtcacaggttggaaagagcaggttgtgaatggagatgttggggctgtttcagagcctccctgcctccccaaggaaccggcacccccaagcccagagtcccattcacccagggacctggactccgaggttttctgtgattccctggagcagctggagcctgagctgagcagcgggcagcatctggaggaaagcgtgatcccaggaacagccccgtgccccccacaaagaaagaggggttgcggggcagcccgccggggccccaggagttggacgtgtggctgctggggacagttcgagcactacaggagagcatgcaggaggtgcaggcgagggtgcagagcctggagagcatgccccggccccctgagcagtctcactctgtcggtcagactggagtgaagtggcgtgaactcagctcactgcaacctccgcctccccgggttcaagcaattctctgcctcagcctcccgagtagctgggattacaggcgcccaccaccatgcccggctaattttttttgtatttttagtagagacggggtttcaccatcttggccacgctggtcttgaactcctgacctcgtgaccacctgcctcggcctcccaaagtgctgggatgacaggcgtgagccatcccacccggtctgccacagtcattcttttttatgctcagacagtcacaactttggccattcaagaccctttcataccggatcttatgttcttataacacgacctgatgaatcttt

SEQ ID NO: 104260 - DNA, 1986 bp, Homo sapiens
  Payload ID: 483
  Gene Symbol: ACBD4
  Gene Name: acyl-CoA binding domain containing 4
  Uniprot ID: Q8NC06
  ENST ID: ENST00000398322
  CDS Start-End: 459-1376
agtaggaagccgcggggtggtggcgagagaggacccaggtgtcctggcagtgggcgccgcggggcacacgctgggccaaggtgcaggcggccagggtgggagactgttcgccccgccctgagtactcctatcttgtttctccacctgttcgggagttggagatgtgcacctaaaggaggcgcatctggggacggacacatctggcactgaggccctcgccacctgcctcgccacctggcgaccctgaccccaccacactgccttgaggtaggaaaaggaggctcctcaaccacaacttctgacctcccagggtgtctgaggcctctaaagagcttagtttgcccctctgggaagtgaatccttggcttatggtgccggggggaccctggaggccccctcacacgaaggctgcttcttgcagagtcgctcaaaagtagggccccagggctcgcagcagcatgggcaccgagaaagaaagcccagagcccgactgccagaaacagttccaggctgcagtgagcgtcatccagaacctgcccaagaacggttcttaccgcccctcctatgaagagatgctgcgattctacagttactacaagcaggccaccatggggccctgcctggtcccccggcccgggttctgggaccccattggacgatataagtgggacgcctggaacagtctgggcaagatgagcagggaggaggccatgtctgcctacatcactgaaatgaaactggtggcacagaaggtgatcgacacagtgcccctgggtgaggtggcagaggacatgtttggttacttcgagcccctgtaccaggtgatccctgacatgccgaggcccccagagaccttcctgagaagggtcacaggttggaaagagcaggttgtgaatggagatgttggggctgtttcagagcctccctgcctccccaaggaaccggcacccccaagcccagagtcccattcacccagggacctggactccgaggttttctgtgattccctggagcagctggagcctgagctggtttggacagagcagcgggcagcatctggaggaaagcgtgatcccaggaacagccccgtgccccccacaaagaaagaggggttgcggggcagcccgccggggccccaggagttggacgtgtggctgctggggacagttcgagcactacaggagagcatgcaggaggtgcaggcgagggtgcagagcctggagagcatgccccggccccctgagcagaggccgcagcccaggcccagtgctcggccatggccccttgggctcccggggcccgcgctgctcttcttcctcctgtggcccttcgtcgtccagtggctcttccgaatgtttcggacccaaaagaggtgactgtcagtggaggggtctctgcagccaactgagactatcttgctgtgccctgagccttcctagggtttagaagaacagcattcaaaattccccgtcctgtcagtgtttgccttcgcacctcctcccctaaagcagcgcggggggcaaataagaccccacccctccctgcagcttcacagggacgcttccttccctccccgcaaccaccccaggctcccctgggaggctgcagttgtggtacacgtccccggtgctgggttggccgtgactcgggggcggggcgatcgggtctcagcccctgccttccccagtctctgggtcacccgaattttcccacccctgcttctccccgaggaggttgagctcttgagcaagttgggacttgggccggggcctggaagaatgattggctgggaggccgcgggagggaggccaggaggcccggaccagttgggaggagtgagcaggccccgggggagggggatgagcgcagtttgctcgctttcctcccctgccggccccctccgcccccacacacactcgggacgtcttcattgaagattcacttacaaaggaatgtttcactaaataaaagaaaaccagaatcttc

SEQ ID NO: 104261 - DNA, 2026 bp, Homo sapiens
  Payload ID: 483
  Gene Symbol: ACBD4
  Gene Name: acyl-CoA binding domain containing 4
  Uniprot ID: Q8NC06
  ENST ID: ENST00000431281
  CDS Start-End: 470-1495
gcggtgcgagggcggggccaggcggtggcctggaagcccggagcctcagcgctcgcccctgctctgcctaagtgtctagagagctgagtgggttgcctcggatcggccaggcctggatatcagcgaacagatgcggatttccaccagggggcgctaggacgccacgacctttcactatgtgcaccagggggcgctgccgcccgccttggccatcccgggctgggaagtccgacccttcgattaagccccgcctgattgggaaaggctctgagaaactatttgcatgatcttgaaagagctgtgctgaatggttgaggtagttggagatgtgcacctaaaggaggcgcatctggggacggacacatctggcactgaggccctcgccacctgcctcgccacctggcgaccctgaccccaccacactgccttgagagtcgctcaaaagtagggccccagggctcgcagcagcatgggcaccgagaaagaaagcccagagcccgactgccagaaacagttccaggctgcagtgagcgtcatccagaacctgcccaagaacggttcttaccgcccctcctatgaagagatgctgcgattctacagttactacaagcaggccaccatggggccctgcctggtcccccggcccgggttctgggaccccattggacgatataagtgggacgcctggaacagtctgggcaagatgagcagggaggaggccatgtctgcctacatcactgaaatgaaactggtggcacagaaggtgatcgacacagtgcccctgggtgaggtggcagaggacatgtttggttacttcgagcccctgtaccaggtgatccctgacatgccgaggcccccagagaccttcctgagaagggtcacaggttggaaagagcaggttgtgaatggagatgttggggctgtttcagagcctccctgcctccccaaggaaccggcacccccaagcccagcttccctctgggcagtaactctaccaacccctccacagagtcccattcacccagggacctggactccgaggttttctgtgattccctggagcagctggagcctgagctggtttggacagagcagcgggcagcatctggaggaaagcgtgatcccaggaacagccccgtgccccccacaaagaaagaggggttgcggggcagcccgccggggccccaggagttggacgtgtggctgctggggacagttcgagcactacaggagagcatgcaggaggtgcaggcgagggtgcagagcctggagagcatgccccggccccctgagcagaggccgcagcccaggcccagtgctcggccatggccccttgggctcccggggcccgcgctgctcttcttcctcctgtggcccttcgtcgtccagtggctcttccgaatgtttcggacccaaaagaggtgactgtcagtggaggggtctctgcagccaactgagactatcttgctgtgccctgagccttcctagggtttagaagaacagcattcaaaattccccgtcctgtcagtgtttgccttcgcacctcctcccctaaagcagcgcggggggcaaataagaccccacccctccctgcagcttcacagggacgcttccttccctccccgcaaccaccccaggctcccctgggaggctgcagttgtggtacacgtccccggtgctgggttggccgtgactcgggggcggggcgatcgggtctcagcccctgccttccccagtctctgggtcacccgaattttcccacccctgcttctccccgaggaggttgagctcttgagcaagttgggacttgggccggggcctggaagaatgattggctgggaggccgcgggagggaggccaggaggcccggaccagttgggaggagtgagcaggccccgggggagggggatgagcgcagtttgctcgctttcctcccctgccggccccctccgcccccacacacactcgggacgtcttcattgaagattcacttacaaaggaatgtttcactaaataaaagaaaacc

SEQ ID NO: 104262 - DNA, 1579 bp, Homo sapiens
  Payload ID: 483
  Gene Symbol: ACBD4
  Gene Name: acyl-CoA binding domain containing 4
  Uniprot ID: Q8NC06
  ENST ID: ENST00000586346
  CDS Start-End: 345-1370
gatctgcgtcgccatcccggccctgctggaccccggggtcagtaggaagccgcggggtggtggcgagagaggacccaggtgtcctggcagtgggcgccgcggggcacacgctgggccaaggtgcaggcggccagggtgggagactgttcgccccgccctgagtactcctatcttgtttctccacctgttcgggagttggagatgtgcacctaaaggaggcgcatctggggacggacacatctggcactgaggccctcgccacctgcctcgccacctggcgaccctgaccccaccacactgccttgagagtcgctcaaaagtagggccccagggctcgcagcagcatgggcaccgagaaagaaagcccagagcccgactgccagaaacagttccaggctgcagtgagcgtcatccagaacctgcccaagaacggttcttaccgcccctcctatgaagagatgctgcgattctacagttactacaagcaggccaccatggggccctgcctggtcccccggcccgggttctgggaccccattggacgatataagtgggacgcctggaacagtctgggcaagatgagcagggaggaggccatgtctgcctacatcactgaaatgaaactggtggcacagaaggtgatcgacacagtgcccctgggtgaggtggcagaggacatgtttggttacttcgagcccctgtaccaggtgatccctgacatgccgaggcccccagagaccttcctgagaagggtcacaggttggaaagagcaggttgtgaatggagatgttggggctgtttcagagcctccctgcctccccaaggaaccggcacccccaagcccagcttccctctgggcagtaactctaccaacccctccacagagtcccattcacccagggacctggactccgaggttttctgtgattccctggagcagctggagcctgagctggtttggacagagcagcgggcagcatctggaggaaagcgtgatcccaggaacagccccgtgccccccacaaagaaagaggggttgcggggcagcccgccggggccccaggagttggacgtgtggctgctggggacagttcgagcactacaggagagcatgcaggaggtgcaggcgagggtgcagagcctggagagcatgccccggccccctgagcagaggccgcagcccaggcccagtgctcggccatggccccttgggctcccggggcccgcgctgctcttcttcctcctgtggcccttcgtcgtccagtggctcttccgaatgtttcggacccaaaagaggtgactgtcagtggaggggtctctgcagccaactgagactatcttgctgtgccctgagccttcctagggtttagaagaacagcattcaaaattccccgtcctgtcagtgtttgccttcgcacctcctcccctaaagcagcgcggggggcaaataagaccccacccctccctgcagcttcacagggacgcttccttccctccccgcaaccaccccaggctcccctgggaggctgcagttgtggtacacgtccccggtgctgggttggccgtgactcgggggcgg

SEQ ID NO: 104263 - DNA, 1998 bp, Homo sapiens
  Payload ID: 483
  Gene Symbol: ACBD4
  Gene Name: acyl-CoA binding domain containing 4
  Uniprot ID: Q8NC06
  ENST ID: ENST00000591859
  CDS Start-End: 438-1463
ggaagcccggagcctcagcgctcgcccctgctctgcctaagtgtctagagagctgagtgggttgcctcggatcggccaggcctggatatcagcgaacagatgcggatttccaccagggggcgctaggacgccacgacctttcactatgtgcaccagggggcgctgccgcccgccttggccatcccgggctgggaagtccgacccttcgattaagccccgcctgattgggaaaggctctgagaaactatttgcatgatcttgaaagagctgtgctgaatggttgaggagttggagatgtgcacctaaaggaggcgcatctggggacggacacatctggcactgaggccctcgccacctgcctcgccacctggcgaccctgaccccaccacactgccttgagagtcgctcaaaagtagggccccagggctcgcagcagcatgggcaccgagaaagaaagcccagagcccgactgccagaaacagttccaggctgcagtgagcgtcatccagaacctgcccaagaacggttcttaccgcccctcctatgaagagatgctgcgattctacagttactacaagcaggccaccatggggccctgcctggtcccccggcccgggttctgggaccccattggacgatataagtgggacgcctggaacagtctgggcaagatgagcagggaggaggccatgtctgcctacatcactgaaatgaaactggtggcacagaaggtgatcgacacagtgcccctgggtgaggtggcagaggacatgtttggttacttcgagcccctgtaccaggtgatccctgacatgccgaggcccccagagaccttcctgagaagggtcacaggttggaaagagcaggttgtgaatggagatgttggggctgtttcagagcctccctgcctccccaaggaaccggcacccccaagcccagcttccctctgggcagtaactctaccaacccctccacagagtcccattcacccagggacctggactccgaggttttctgtgattccctggagcagctggagcctgagctggtttggacagagcagcgggcagcatctggaggaaagcgtgatcccaggaacagccccgtgccccccacaaagaaagaggggttgcggggcagcccgccggggccccaggagttggacgtgtggctgctggggacagttcgagcactacaggagagcatgcaggaggtgcaggcgagggtgcagagcctggagagcatgccccggccccctgagcagaggccgcagcccaggcccagtgctcggccatggccccttgggctcccggggcccgcgctgctcttcttcctcctgtggcccttcgtcgtccagtggctcttccgaatgtttcggacccaaaagaggtgactgtcagtggaggggtctctgcagccaactgagactatcttgctgtgccctgagccttcctagggtttagaagaacagcattcaaaattccccgtcctgtcagtgtttgccttcgcacctcctcccctaaagcagcgcggggggcaaataagaccccacccctccctgcagcttcacagggacgcttccttccctccccgcaaccaccccaggctcccctgggaggctgcagttgtggtacacgtccccggtgctgggttggccgtgactcgggggcggggcgatcgggtctcagcccctgccttccccagtctctgggtcacccgaattttcccacccctgcttctccccgaggaggttgagctcttgagcaagttgggacttgggccggggcctggaagaatgattggctgggaggccgcgggagggaggccaggaggcccggaccagttgggaggagtgagcaggccccgggggagggggatgagcgcagtttgctcgctttcctcccctgccggccccctccgcccccacacacactcgggacgtcttcattgaagattcacttacaaaggaatgtttcactaaataaaagaaaaccagaa

SEQ ID NO: 104264 - DNA, 1684 bp, Homo sapiens
  Payload ID: 483
  Gene Symbol: ACBD4
  Gene Name: acyl-CoA binding domain containing 4
  ENST ID: ENST00000592162
  CDS Start-End: 302-1111
aggaagccgcggggtggtggcgagagaggacccaggtgtcctggcagtgggcgccgcggggcacacgctgggccaaggtgcaggcggccagggtgggagactgttcgccccgccctgagtactcctatcttgtttctccacctgttcgggagttggagatgtgcacctaaaggaggcgcatctggggacggacacatctggcactgaggccctcgccacctgcctcgccacctggcgaccctgaccccaccacactgccttgagagtcgctcaaaagtagggccccagggctcgcagcagcatgggcaccgagaaagaaagcccagagcccgactgccagaaacagttccaggctgcagtgagcgtcatccagaacctgcccaagaacggttcttaccgcccctcctatgaagagatgctgcgattctacagttactacaagcaggccaccatggggccctgcctggtcccccggcccgggttctgggaccccattggacgatataagtgggacgcctggaacagtctgggcaagatgagcagggaggaggccatgtctgcctacatcactgaaatgaaactggtggcacagaaggtgatcgacacagtgcccctgggtgaggtggcagaggacatgtttggttacttcgagcccctgtaccaggtgatccctgacatgccgaggcccccagagaccttcctgagaagggtcacaggttggaaagagcaggttgtgaatggagatgttggggctgtttcagagcctccctgcctccccaaggaaccggcacccccaagcccagagtcccattcacccagggacctggactccgaggttttctgtgattccctggagcagctggagcctgagctggtttggacagagcagcgggcagcatctggaggaaagcgtgatcccaggaacagccccgtgccccccacaaagaaagaggccgcagcccaggcccagtgctcggccatggccccttgggctcccggggcccgcgctgctcttcttcctcctgtggcccttcgtcgtccagtggctcttccgaatgtttcggacccaaaagaggtgactgtcagtggaggggtctctgcagccaactgagactatcttgctgtgccctgagccttcctagggtttagaagaacagcattcaaaattccccgtcctgtcagtgtttgccttcgcacctcctcccctaaagcagcgcggggggcaaataagaccccacccctccctgcagcttcacagggacgcttccttccctccccgcaaccaccccaggctcccctgggaggctgcagttgtggtacacgtccccggtgctgggttggccgtgactcgggggcggggcgatcgggtctcagcccctgccttccccagtctctgggtcacccgaattttcccacccctgcttctccccgaggaggttgagctcttgagcaagttgggacttgggccggggcctggaagaatgattggctgggaggccgcgggagggaggccaggaggcccggaccagttgggaggagtgagcaggccccgggggagggggatgagcgcagtttgctcgctttcctcccctgccggccccctccgcccccacacacactcgggacgtcttcattgaagattcacttacaaaggaatgtttcactaaataaaagaaaaccagaa

SEQ ID NO: 104265 - DNA, 494 bp, Homo sapiens
  Payload ID: 483
  Gene Symbol: ACBD4
  Gene Name: acyl-CoA binding domain containing 4
  ENST ID: ENST00000589798
  CDS Start-End: 38-154
agtcgctcaaaagtagggccccagggctcgcagcagcatgggcaccgagaaagaaagcccagagcccgactgccagaaacagttccaggctgcagtgagcgtcatccagaacctgcccaagaacgggacgcctggaacagtctgggcaagatgagcagggaggaggccatgtctgcctacatcactgaaatgaaactggtggcacagaaggtgatcgacacagtgcccctgggtgaggtggcagaggacatgtttggttacttcgagcccctgtaccaggtgatccctgacatgccgaggcccccagagaccttcctgagaagggtcacaggttggaaagagcaggttgtgaatggagatgttggggctgtttcagagcctccctgcctccccaaggaaccggcacccccaagcccagagtcccattcacccagggacctggactccgaggttttctgtgattccctggagcagctggagcctgagctggtgag

SEQ ID NO: 104266 - DNA, 1276 bp, Homo sapiens
  Payload ID: 483
  Gene Symbol: ACBD4
  Gene Name: acyl-CoA binding domain containing 4
  Uniprot ID: Q8NC06
  ENST ID: ENST00000619916
  CDS Start-End: 470-1276
gcggtgcgagggcggggccaggcggtggcctggaagcccggagcctcagcgctcgcccctgctctgcctaagtgtctagagagctgagtgggttgcctcggatcggccaggcctggatatcagcgaacagatgcggatttccaccagggggcgctaggacgccacgacctttcactatgtgcaccagggggcgctgccgcccgccttggccatcccgggctgggaagtccgacccttcgattaagccccgcctgattgggaaaggctctgagaaactatttgcatgatcttgaaagagctgtgctgaatggttgaggtagttggagatgtgcacctaaaggaggcgcatctggggacggacacatctggcactgaggccctcgccacctgcctcgccacctggcgaccctgaccccaccacactgccttgagagtcgctcaaaagtagggccccagggctcgcagcagcatgggcaccgagaaagaaagcccagagcccgactgccagaaacagttccaggctgcagtgagcgtcatccagaacctgcccaagaacggttcttaccgcccctcctatgaagagatgctgcgattctacagttactacaagcaggccaccatggggccctgcctggtcccccggcccgggttctgggaccccattggacgatataagtgggacgcctggaacagtctgggcaagatgagcagggaggaggccatgtctgcctacatcactgaaatgaaactggtggcacagaaggtgatcgacacagtgcccctgggtgaggtggcagaggacatgtttggttacttcgagcccctgtaccaggtgatccctgacatgccgaggcccccagagaccttcctgagaagggtcacaggttggaaagagcaggttgtgaatggagatgttggggctgtttcagagcctccctgcctccccaaggaaccggcacccccaagcccagagtcccattcacccagggacctggactccgaggttttctgtgattccctggagcagctggagcctgagctgagcagcgggcagcatctggaggaaagcgtgatcccaggaacagccccgtgccccccacaaagaaagaggggttgcggggcagcccgccggggccccaggagttggacgtgtggctgctggggacagttcgagcactacaggagagcatgcaggaggtgcaggcgagggtgcagagcctggagagcatgccccggccccctgagcagtctcactctgtcggtcagactggagtga

SEQ ID NO: 104267 - DNA, 1747 bp, Homo sapiens
  Payload ID: 484
  Gene Symbol: ACBD5
  Gene Name: acyl-CoA binding domain containing 5
  Uniprot ID: Q5T8D3
  ENST ID: ENST00000375888
  CDS Start-End: 66-1670
ggaactgacccgcttcgctcccgggcctcctccttttggggcatgttgatccgcggctgcgctccatgttccagtttcatgcaggctcttgggaaagctggtgctgctgctgcctgattcccgccgacagaccttgggaccggggccaacactggcagctggagatggcggacacgagatccgtgcacgagactaggtttgaggcggccgtgaaggtgatccagagtttgccgaagaatggttcattccagccaacaaatgaaatgatgcttaaattttatagcttctataagcaggcaactgaaggaccctgtaaactttcaaggcctggattttgggatcctattggaagatataaatgggatgcttggagttcactgggtgatatgaccaaagaggaagccatgattgcatatgttgaagaaatgaaaaagattattgaaactatgccaatgactgagaaagttgaagaattgctgcgtgtcataggtccattttatgaaattgtcgaggacaaaaagagtggcaggagttctgatataacctcagtccgactggagaaaatctctaaatgtttagaagatcttggtaatgttctcacttctactccaaacgccaaaaccgttaatggtaaagctgaaagcagtgacagtggagccgagtctgaggaagaagaggcccaagaagaagtgaaaggagcagaacaaagtgataatgataagaaaatgatgaagaagtcagcagaccataagaatttggaagtcattgtcactaatggctatgataaagatggctttgttcaggatatacagaatgacattcatgccagttcttccctgaatggcagaagcactgaagaagtaaagcccattgatgaaaacttggggcaaactggaaaatctgctgtttgcattcaccaagatataaatgatgatcatgttgaagatgttacaggaattcagcatttgacaagcgattcagacagtgaagtttactgtgattctatggaacaatttggacaagaagagtctttagacagctttacgtccaacaatggaccatttcagtattacttgggtggtcattccagtcaacccatggaaaattctggatttcgtgaagatattcaagtacctcctggaaatggcaacattgggaatatgcaggtggttgcagttgaaggaaaaggtgaagtcaagcatggaggagaagatggcaggaataacagcggagcaccacaccgggagaagcgaggcggagaaactgacgaattctctaatgttagaagaggaagaggacataggatgcaacacttgagcgaaggaaccaagggccggcaggtgggaagtggaggtgatggggagcgctggggctccgacagagggtcccgaggcagcctcaatgagcagatcgccctcgtgctgatgagactgcaggaggacatgcagaatgtccttcagagactgcagaaactggaaacgctgactgctttgcaggcaaaatcatcaacatcaacattgcagactgctcctcagcccacctcacagagaccatcttggtggcccttcgagatgtctcctggtgtgctaacgtttgccatcatatggccttttattgcacagtggttggtgtatttatactatcaaagaaggagaagaaaactgaactgaggaaaatggtgttttcctcaagaagactactggaactggatgacctcagaatgaactggattgtggtgttcacaaga

SEQ ID NO: 104268 - DNA, 4173 bp, Homo sapiens
  Payload ID: 484
  Gene Symbol: ACBD5
  Gene Name: acyl-CoA binding domain containing 5
  ENST ID: ENST00000375897
  CDS Start-End: 387-1958
tgcactgctgctgcggcggcggcggcgccagtgggtcctccggtgactctggggcggggctgtggggagggcacggactgacagacggactccggcggaatggggggtgtggctgctccgccagggtccccagggtgggagagcggctccgcggccaccgatgcccggaccccctctgtcttctgctagacatgctcttcctctcggtgagttgttttgctgtcgtcgcgggccggattcgtggccttagtcacgccccgggggaggaggaaggagccgggccgcttcgatctgtgtggcctggatagggcagggcaaaggggaactgacccgcttcgctcccgggcctcctccttttggggcatgttgatccgcggctgcgctccatgttccagtttcatgcaggctcttgggaaagctggtgctgctgctgcctgattcccgccgacagaccttgggaccggggccaacactggcagctggagatggcggacacgagatccgtgcacgagactaggtttgaggcggccgtgaaggtgatccagagtttgccgaagaatggttcattccagccaacaaatgaaatgatgcttaaattttatagcttctataagcaggcaactgaaggaccctgtaaactttcaaggcctggattttgggatcctattggaagatataaatgggatgcttggagttcactgggtgatatgaccaaagaggaagccatgattgcatatgttgaagaaatgaaaaagattattgaaactatgccaatgactgagaaagttgaagaattgctgcgtgtcataggtccattttatgaaattgtcgaggacaaaaagagtggcaggagttctgatataacctcagatcttggtaatgttctcacttctactccaaacgccaaaaccgttaatggtaaagctgaaagcagtgacagtggagccgagtctgaggaagaagaggcccaagaagaagtgaaaggagcagaacaaagtgataatgataagaaaatgatgaagaagtcagcagaccataagaatttggaagtcattgtcactaatggctatgataaagatggctttgttcaggatatacagaatgacattcatgccagttcttccctgaatggcagaagcactgaagaagtaaagcccattgatgaaaacttggggcaaactggaaaatctgctgtttgcattcaccaagatataaatgatgatcatgttgaagatgttacaggaattcagcatttgacaagcgattcagacagtgaagtttactgtgattctatggaacaatttggacaagaagagtctttagacagctttacgtccaacaatggaccatttcagtattacttgggtggtcattccagtcaacccatggaaaattctggatttcgtgaagatattcaagtacctcctggaaatggcaacattgggaatatgcaggtggttgcagttgaaggaaaaggtgaagtcaagcatggaggagaagatggcaggaataacagcggagcaccacaccgggagaagcgaggcggagaaactgacgaattctctaatgttagaagaggaagaggacataggatgcaacacttgagcgaaggaaccaagggccggcaggtgggaagtggaggtgatggggagcgctggggctccgacagagggtcccgaggcagcctcaatgagcagatcgccctcgtgctgatgagactgcaggaggacatgcagaatgtccttcagagactgcagaaactggaaacgctgactgctttgcaggcaaaatcatcaacatcaacattgcagactgctcctcagcccacctcacagagaccatcttggtggcccttcgagatgtctcctggtgtgctaacgtttgccatcatatggccttttattgcacagtggttggtgtatttatactatcaaagaaggagaagaaaactgaactgaggaaaatggtgttttcctcaagaagactactggaactggatgacctcagaatgaactggattgtggtgttcacaagaaaatcttagtttgtgatgattacattgctttttgttgtccagtagtttagtttgtgtacatatatacacatatatattttgcactacacaaacgataacattttaaggactaatattgctgatacttgaataatcaatctctactaggttataagtagtatacacagatttaccctgcccttgaacttgaaggacattaaattattaatgatcatttggtaacatgtttacctgattatcttccatagagtaacataagctgcttttcaaaggtaccattgtgataatgagatcaaatttataagttattatttttaattttctaaattaaataaaagaaagaatgcaaaccaggagtgaatttcaaatgagatgtaatcgactttatatcttagtcacggagttgccatggcatgtagtagaaaaccacaggaagaatggtcatattcactttgtgggctgcccataatctttcttgggcattcacaactcttgagtttggtgttcaggcatcattattaaaaagtggagtcctatgtaccagactgagtttttacaaatgatttgcaggctagacataacccactgatggaaatggtgaagaatgagcttcatgtaggtttaaaagtgtattctgagcctgtagatgattaatcaggtttttattcaatcatataaatgtattcctttgtaatcatttttgtttaactgaggatatctagtgtctgcttcatagggtgctttgaaatataaaatgaaaacttatttatactgtttttacaacagtcaaaaaggaaacacacgaaaatcacttttctgcaactgatgaactatatagactggactcttaacctcttagtgcctcagtttttccttcggggtatactattttagatacacctacttcacaggagtactggagggatttgcaagctaacgggccaaatgcttccataggaataaggcatgcccagctaacagaaatttaagtccctcttccccacctctctcatctagaccaaaaagaagactacaatttagatccttggagacttttcctgtatgccttccaaaacttcctgctcacttagatgtaccttgtgctttgaagatttctttgatgcagtctttgtaacaaataatttttttttttaaatggagtttctctcttgttgcccaggctggagggcaatggcgtgatcttggctcactgcaacttccacctcctgggttcaagtgattctcctgcctcactcccaagtagctgggattacaggcatgcaccaccatgcctggctaattttgtatttttagtagagacggggtttctccatgttggtaaggctgatctcaaactcccaacctcaggtgatctgcctgcctcggcctcccaaagtgctgggattagaggcgtgagccactgcacctggcctgtagcaaataatttttaagcattctcaagatgtatgatgttgggtttaacatcatatgttcacagtgttttaaataagaaataatctgtctttagtatacagaatggttctttgtttgcctgaaaagtataagaatacaatttacttttcccaaactctttttccttatttttttctttcaaataactttaattatttaatcccatactgattaaaatatgtctgtctaaagggatctactactatttgcttttaaaaaagtgttccctatttatttaggaaaaagtgaagcaagcaactgaatttatatgtaaaaataacatttagacctgtggatcaaagattattttcaaaaatgagatatcaatttggtatcagtaaaaagtgtcttttctcttagtatataaataaataaaatgcaaattaagagtgtaagcagttgtgaatcattacaagcagtctgggataactaactcctagggataaccatttctatcctgttccaaagtcttattttatagtttgaaaagcactttgcacacagttcttgtatataaaagtaaagatgtaattataggatatagtgttcctgctttgtttaataagaacctcatttaaacttgacagctatggtatttttttaatgataacttcttttctgtttattgtaaaactaagttaaaaataaaaggttaatgagaaatg

SEQ ID NO: 104269 - DNA, 3685 bp, Homo sapiens
  Payload ID: 484
  Gene Symbol: ACBD5
  Gene Name: acyl-CoA binding domain containing 5
  Uniprot ID: Q5T8D3
  ENST ID: ENST00000375901
  CDS Start-End: 222-1472
accggacaggccttgtccggcaataccaagtttcatgcaggctcttgggaaagctggtgctgctgctgcctgattcccgccgacagaccttgggaccggggccaacactggcagctggagatggcggacacgagatccgtgcacgagactaggtttgaggcggccgtgaaggtgatccagagtttgccgaagaatgggatgcttggagttcactgggtgatatgaccaaagaggaagccatgattgcatatgttgaagaaatgaaaaagattattgaaactatgccaatgactgagaaagttgaagaattgctgcgtgtcataggtccattttatgaaattgtcgaggacaaaaagagtggcaggagttctgatataacctcagatcttggtaatgttctcacttctactccaaacgccaaaaccgttaatggtaaagctgaaagcagtgacagtggagccgagtctgaggaagaagaggcccaagaagaagtgaaaggagcagaacaaagtgataatgataagaaaatgatgaagaagtcagcagaccataagaatttggaagtcattgtcactaatggctatgataaagatggctttgttcaggatatacagaatgacattcatgccagttcttccctgaatggcagaagcactgaagaagtaaagcccattgatgaaaacttggggcaaactggaaaatctgctgtttgcattcaccaagatataaatgatgatcatgttgaagatgttacaggaattcagcatttgacaagcgattcagacagtgaagtttactgtgattctatggaacaatttggacaagaagagtctttagacagctttacgtccaacaatggaccatttcagtattacttgggtggtcattccagtcaacccatggaaaattctggatttcgtgaagatattcaagtacctcctggaaatggcaacattgggaatatgcaggtggttgcagttgaaggaaaaggtgaagtcaagcatggaggagaagatggcaggaataacagcggagcaccacaccgggagaagcgaggcggagaaactgacgaattctctaatgttagaagaggaagaggacataggatgcaacacttgagcgaaggaaccaagggccggcaggtgggaagtggaggtgatggggagcgctggggctccgacagagggtcccgaggcagcctcaatgagcagatcgccctcgtgctgatgagactgcaggaggacatgcagaatgtccttcagagactgcagaaactggaaacgctgactgctttgcaggcaaaatcatcaacatcaacattgcagactgctcctcagcccacctcacagagaccatcttggtggcccttcgagatgtctcctggtgtgctaacgtttgccatcatatggccttttattgcacagtggttggtgtatttatactatcaaagaaggagaagaaaactgaactgaggaaaatggtgttttcctcaagaagactactggaactggatgacctcagaatgaactggattgtggtgttcacaagaaaatcttagtttgtgatgattacattgctttttgttgtccagtagtttagtttgtgtacatatatacacatatatattttgcactacacaaacgataacattttaaggactaatattgctgatacttgaataatcaatctctactaggttataagtagtatacacagatttaccctgcccttgaacttgaaggacattaaattattaatgatcatttggtaacatgtttacctgattatcttccatagagtaacataagctgcttttcaaaggtaccattgtgataatgagatcaaatttataagttattatttttaattttctaaattaaataaaagaaagaatgcaaaccaggagtgaatttcaaatgagatgtaatcgactttatatcttagtcacggagttgccatggcatgtagtagaaaaccacaggaagaatggtcatattcactttgtgggctgcccataatctttcttgggcattcacaactcttgagtttggtgttcaggcatcattattaaaaagtggagtcctatgtaccagactgagtttttacaaatgatttgcaggctagacataacccactgatggaaatggtgaagaatgagcttcatgtaggtttaaaagtgtattctgagcctgtagatgattaatcaggtttttattcaatcatataaatgtattcctttgtaatcatttttgtttaactgaggatatctagtgtctgcttcatagggtgctttgaaatataaaatgaaaacttatttatactgtttttacaacagtcaaaaaggaaacacacgaaaatcacttttctgcaactgatgaactatatagactggactcttaacctcttagtgcctcagtttttccttcggggtatactattttagatacacctacttcacaggagtactggagggatttgcaagctaacgggccaaatgcttccataggaataaggcatgcccagctaacagaaatttaagtccctcttccccacctctctcatctagaccaaaaagaagactacaatttagatccttggagacttttcctgtatgccttccaaaacttcctgctcacttagatgtaccttgtgctttgaagatttctttgatgcagtctttgtaacaaataatttttttttttaaatggagtttctctcttgttgcccaggctggagggcaatggcgtgatcttggctcactgcaacttccacctcctgggttcaagtgattctcctgcctcactcccaagtagctgggattacaggcatgcaccaccatgcctggctaattttgtatttttagtagagacggggtttctccatgttggtaaggctgatctcaaactcccaacctcaggtgatctgcctgcctcggcctcccaaagtgctgggattagaggcgtgagccactgcacctggcctgtagcaaataatttttaagcattctcaagatgtatgatgttgggtttaacatcatatgttcacagtgttttaaataagaaataatctgtctttagtatacagaatggttctttgtttgcctgaaaagtataagaatacaatttacttttcccaaactctttttccttatttttttctttcaaataactttaattatttaatcccatactgattaaaatatgtctgtctaaagggatctactactatttgcttttaaaaaagtgttccctatttatttaggaaaaagtgaagcaagcaactgaatttatatgtaaaaataacatttagacctgtggatcaaagattattttcaaaaatgagatatcaatttggtatcagtaaaaagtgtcttttctcttagtatataaataaataaaatgcaaattaagagtgtaagcagttgtgaatcattacaagcagtctgggataactaactcctagggataaccatttctatcctgttccaaagtcttattttatagtttgaaaagcactttgcacacagttcttgtatataaaagtaaagatgtaattataggatatagtgttcctgctttgtttaataagaacctcatttaaacttgacagctatggtatttttttaatgataacttcttttctgtttattgtaaaactaagttaaaaataaaaggttaatgagaaa

SEQ ID NO: 104270 - DNA, 3848 bp, Homo sapiens
  Payload ID: 484
  Gene Symbol: ACBD5
  Gene Name: acyl-CoA binding domain containing 5
  Uniprot ID: Q5T8D3
  ENST ID: ENST00000375905
  CDS Start-End: 163-1635
taagcccgcggggcagggcgaggggcgggcgtcggggacattaccggacaggccttgtccggcaataccaagtttcatgcaggctcttgggaaagctggtgctgctgctgcctgattcccgccgacagaccttgggaccggggccaacactggcagctggagatggcggacacgagatccgtgcacgagactaggtttgaggcggccgtgaaggtgatccagagtttgccgaagaatggttcattccagccaacaaatgaaatgatgcttaaattttatagcttctataagcaggcaactgaaggaccctgtaaactttcaaggcctggattttgggatcctattggaagatataaatgggatgcttggagttcactgggtgatatgaccaaagaggaagccatgattgcatatgttgaagaaatgaaaaagattattgaaactatgccaatgactgagaaagttgaagaattgctgcgtgtcataggtccattttatgaaattgtcgaggacaaaaagagtggcaggagttctgatataacctcagatcttggtaatgttctcacttctactccaaacgccaaaaccgttaatggtaaagctgaaagcagtgacagtggagccgagtctgaggaagaagaggcccaagaagaagtgaaaggagcagaacaaagtgataatgataagaaaatgatgaagaagtcagcagaccataagaatttggaagtcattgtcactaatggctatgataaagatggctttgttcaggatatacagaatgacattcatgccagttcttccctgaatggcagaagcactgaagaagtaaagcccattgatgaaaacttggggcaaactggaaaatctgctgtttgcattcaccaagatataaatgatgatcatgttgaagatgttacaggaattcagcatttgacaagcgattcagacagtgaagtttactgtgattctatggaacaatttggacaagaagagtctttagacagctttacgtccaacaatggaccatttcagtattacttgggtggtcattccagtcaacccatggaaaattctggatttcgtgaagatattcaagtacctcctggaaatggcaacattgggaatatgcaggtggttgcagttgaaggaaaaggtgaagtcaagcatggaggagaagatggcaggaataacagcggagcaccacaccgggagaagcgaggcggagaaactgacgaattctctaatgttagaagaggaagaggacataggatgcaacacttgagcgaaggaaccaagggccggcaggtgggaagtggaggtgatggggagcgctggggctccgacagagggtcccgaggcagcctcaatgagcagatcgccctcgtgctgatgagactgcaggaggacatgcagaatgtccttcagagactgcagaaactggaaacgctgactgctttgcaggcaaaatcatcaacatcaacattgcagactgctcctcagcccacctcacagagaccatcttggtggcccttcgagatgtctcctggtgtgctaacgtttgccatcatatggccttttattgcacagtggttggtgtatttatactatcaaagaaggagaagaaaactgaactgaggaaaatggtgttttcctcaagaagactactggaactggatgacctcagaatgaactggattgtggtgttcacaagaaaatcttagtttgtgatgattacattgctttttgttgtccagtagtttagtttgtgtacatatatacacatatatattttgcactacacaaacgataacattttaaggactaatattgctgatacttgaataatcaatctctactaggttataagtagtatacacagatttaccctgcccttgaacttgaaggacattaaattattaatgatcatttggtaacatgtttacctgattatcttccatagagtaacataagctgcttttcaaaggtaccattgtgataatgagatcaaatttataagttattatttttaattttctaaattaaataaaagaaagaatgcaaaccaggagtgaatttcaaatgagatgtaatcgactttatatcttagtcacggagttgccatggcatgtagtagaaaaccacaggaagaatggtcatattcactttgtgggctgcccataatctttcttgggcattcacaactcttgagtttggtgttcaggcatcattattaaaaagtggagtcctatgtaccagactgagtttttacaaatgatttgcaggctagacataacccactgatggaaatggtgaagaatgagcttcatgtaggtttaaaagtgtattctgagcctgtagatgattaatcaggtttttattcaatcatataaatgtattcctttgtaatcatttttgtttaactgaggatatctagtgtctgcttcatagggtgctttgaaatataaaatgaaaacttatttatactgtttttacaacagtcaaaaaggaaacacacgaaaatcacttttctgcaactgatgaactatatagactggactcttaacctcttagtgcctcagtttttccttcggggtatactattttagatacacctacttcacaggagtactggagggatttgcaagctaacgggccaaatgcttccataggaataaggcatgcccagctaacagaaatttaagtccctcttccccacctctctcatctagaccaaaaagaagactacaatttagatccttggagacttttcctgtatgccttccaaaacttcctgctcacttagatgtaccttgtgctttgaagatttctttgatgcagtctttgtaacaaataatttttttttttaaatggagtttctctcttgttgcccaggctggagggcaatggcgtgatcttggctcactgcaacttccacctcctgggttcaagtgattctcctgcctcactcccaagtagctgggattacaggcatgcaccaccatgcctggctaattttgtatttttagtagagacggggtttctccatgttggtaaggctgatctcaaactcccaacctcaggtgatctgcctgcctcggcctcccaaagtgctgggattagaggcgtgagccactgcacctggcctgtagcaaataatttttaagcattctcaagatgtatgatgttgggtttaacatcatatgttcacagtgttttaaataagaaataatctgtctttagtatacagaatggttctttgtttgcctgaaaagtataagaatacaatttacttttcccaaactctttttccttatttttttctttcaaataactttaattatttaatcccatactgattaaaatatgtctgtctaaagggatctactactatttgcttttaaaaaagtgttccctatttatttaggaaaaagtgaagcaagcaactgaatttatatgtaaaaataacatttagacctgtggatcaaagattattttcaaaaatgagatatcaatttggtatcagtaaaaagtgtcttttctcttagtatataaataaataaaatgcaaattaagagtgtaagcagttgtgaatcattacaagcagtctgggataactaactcctagggataaccatttctatcctgttccaaagtcttattttatagtttgaaaagcactttgcacacagttcttgtatataaaagtaaagatgtaattataggatatagtgttcctgctttgtttaataagaacctcatttaaacttgacagctatggtatttttttaatgataacttcttttctgtttattgtaaaactaagttaaaaataaaaggttaatgagaaa

SEQ ID NO: 104271 - DNA, 3921 bp, Homo sapiens
  Payload ID: 484
  Gene Symbol: ACBD5
  Gene Name: acyl-CoA binding domain containing 5
  Uniprot ID: Q5T8D3
  ENST ID: ENST00000396271
  CDS Start-End: 128-1705
gggagggcacggactgacagacggactccggcggaatggggggtgtggctgctccgccagggtccccagggtgggagagcggctccgcggccaccgatgcccggaccccctctgtcttctgctagacatgctcttcctctcgtttcatgcaggctcttgggaaagctggtgctgctgctgcctgattcccgccgacagaccttgggaccggggccaacactggcagctggagatggcggacacgagatccgtgcacgagactaggtttgaggcggccgtgaaggtgatccagagtttgccgaagaatggttcattccagccaacaaatgaaatgatgcttaaattttatagcttctataagcaggcaactgaaggaccctgtaaactttcaaggcctggattttgggatcctattggaagatataaatgggatgcttggagttcactgggtgatatgaccaaagaggaagccatgattgcatatgttgaagaaatgaaaaagattattgaaactatgccaatgactgagaaagttgaagaattgctgcgtgtcataggtccattttatgaaattgtcgaggacaaaaagagtggcaggagttctgatataacctcagatcttggtaatgttctcacttctactccaaacgccaaaaccgttaatggtaaagctgaaagcagtgacagtggagccgagtctgaggaagaagaggcccaagaagaagtgaaaggagcagaacaaagtgataatgataagaaaatgatgaagaagtcagcagaccataagaatttggaagtcattgtcactaatggctatgataaagatggctttgttcaggatatacagaatgacattcatgccagttcttccctgaatggcagaagcactgaagaagtaaagcccattgatgaaaacttggggcaaactggaaaatctgctgtttgcattcaccaagatataaatgatgatcatgttgaagatgttacaggaattcagcatttgacaagcgattcagacagtgaagtttactgtgattctatggaacaatttggacaagaagagtctttagacagctttacgtccaacaatggaccatttcagtattacttgggtggtcattccagtcaacccatggaaaattctggatttcgtgaagatattcaagtacctcctggaaatggcaacattgggaatatgcaggtggttgcagttgaaggaaaaggtgaagtcaagcatggaggagaagatggcaggaataacagcggagcaccacaccgggagaagcgaggcggagaaactgacgaattctctaatgttagaagaggaagaggacataggatgcaacacttgagcgaaggaaccaagggccggcaggtgggaagtggaggtgatggggagcgctggggctccgacagagggtcccgaggcagcctcaatgagcagatcgccctcgtgctgatgagactgcaggaggacatgcagaatgtccttcagagactgcagaaactggaaacgctgactgctttgcaggcaaaatcatcaacatcaacattgcagactgctcctcagcccacctcacagagaccatcttggtggcccttcgagatgtctcctggtgtgctaacgtttgccatcatatggccttttattgcacagtggttggtgtatttatactatcaaagaaggagaagaaaactgaactgaggaaaatggtgttttcctcaagaagactactggaactggatgacctcagaatgaactggattgtggtgttcacaagaaaatcttagtttgtgatgattacattgctttttgttgtccagtagtttagtttgtgtacatatatacacatatatattttgcactacacaaacgataacattttaaggactaatattgctgatacttgaataatcaatctctactaggttataagtagtatacacagatttaccctgcccttgaacttgaaggacattaaattattaatgatcatttggtaacatgtttacctgattatcttccatagagtaacataagctgcttttcaaaggtaccattgtgataatgagatcaaatttataagttattatttttaattttctaaattaaataaaagaaagaatgcaaaccaggagtgaatttcaaatgagatgtaatcgactttatatcttagtcacggagttgccatggcatgtagtagaaaaccacaggaagaatggtcatattcactttgtgggctgcccataatctttcttgggcattcacaactcttgagtttggtgttcaggcatcattattaaaaagtggagtcctatgtaccagactgagtttttacaaatgatttgcaggctagacataacccactgatggaaatggtgaagaatgagcttcatgtaggtttaaaagtgtattctgagcctgtagatgattaatcaggtttttattcaatcatataaatgtattcctttgtaatcatttttgtttaactgaggatatctagtgtctgcttcatagggtgctttgaaatataaaatgaaaacttatttatactgtttttacaacagtcaaaaaggaaacacacgaaaatcacttttctgcaactgatgaactatatagactggactcttaacctcttagtgcctcagtttttccttcggggtatactattttagatacacctacttcacaggagtactggagggatttgcaagctaacgggccaaatgcttccataggaataaggcatgcccagctaacagaaatttaagtccctcttccccacctctctcatctagaccaaaaagaagactacaatttagatccttggagacttttcctgtatgccttccaaaacttcctgctcacttagatgtaccttgtgctttgaagatttctttgatgcagtctttgtaacaaataatttttttttttaaatggagtttctctcttgttgcccaggctggagggcaatggcgtgatcttggctcactgcaacttccacctcctgggttcaagtgattctcctgcctcactcccaagtagctgggattacaggcatgcaccaccatgcctggctaattttgtatttttagtagagacggggtttctccatgttggtaaggctgatctcaaactcccaacctcaggtgatctgcctgcctcggcctcccaaagtgctgggattagaggcgtgagccactgcacctggcctgtagcaaataatttttaagcattctcaagatgtatgatgttgggtttaacatcatatgttcacagtgttttaaataagaaataatctgtctttagtatacagaatggttctttgtttgcctgaaaagtataagaatacaatttacttttcccaaactctttttccttatttttttctttcaaataactttaattatttaatcccatactgattaaaatatgtctgtctaaagggatctactactatttgcttttaaaaaagtgttccctatttatttaggaaaaagtgaagcaagcaactgaatttatatgtaaaaataacatttagacctgtggatcaaagattattttcaaaaatgagatatcaatttggtatcagtaaaaagtgtcttttctcttagtatataaataaataaaatgcaaattaagagtgtaagcagttgtgaatcattacaagcagtctgggataactaactcctagggataaccatttctatcctgttccaaagtcttattttatagtttgaaaagcactttgcacacagttcttgtatataaaagtaaagatgtaattataggatatagtgttcctgctttgtttaataagaacctcatttaaacttgacagctatggtatttttttaatgataacttcttttctgtttattgtaaaactaagttaaaaataaaaggttaatgagaaatga

SEQ ID NO: 104272 - DNA, 876 bp, Homo sapiens
  Payload ID: 484
  Gene Symbol: ACBD5
  Gene Name: acyl-CoA binding domain containing 5
  ENST ID: ENST00000412279
  CDS Start-End: 123-876
ttaccggacaggccttgtccggcaataccaagtttcatgcaggctcttgggaaagctggtgctgctgctgcctgattcccgccgacagaccttgggaccggggccaacactggcagctggagatggcggacacgagatccgtgcacgagactaggtttgaggcggccgtgaaggtgatccagagtttgccgaagaatggttcattccagccaacaaatgaaatgatgcttaaattttatagcttctataagcaggcaactgaaggaccctgtaaactttcaaggcctggattttgggatcctattggaagatataaatgggatgcttggagttcactgggtgatatgaccaaagaggaagccatgattgcatatgttgaagaaatgaaaaagattattgaaactatgccaatgactgagaaagttgaagaattgctgcgtgtcataggtccattttatgaaattgtcgaggacaaaaagagtggcaggagttctgatataacctcagtccgactggagaaaatctctaaatgtttagaagatcttggtaatgttctcacttctactccaaacgccaaaaccgttaatggtaaagctgaaagcagtgacagtggagccgagtctgaggaagaagaggcccaagaagaagtgaaaggagcagaacaaagtgataatgataagaaaatgatgaagaagtcagcagaccataagaatttggaagtcattgtcactaatggctatgataaagatggctttgttcaggatatacagaatgacattcatgccagttcttccctgaatggcagaagcactgaagaagtaaagcccattgatgaaaacttggggcaaactggaaaatctgctgtttgcattcacc

SEQ ID NO: 104273 - DNA, 1014 bp, Homo sapiens
  Payload ID: 484
  Gene Symbol: ACBD5
  Gene Name: acyl-CoA binding domain containing 5
  ENST ID: ENST00000426079
  CDS Start-End: 258-1014
agtgggtcctccggtgactctggggcggggctgtggggagggcacggactgacagacggactccggcggaatggggggtgtggctgctccgccagggtccccagggtgggagagcggctccgcggccaccgatgcccggaccccctctgtcttctgctagacatgctcttcctctcggctcttgggaaagctggtgctgctgctgcctgattcccgccgacagaccttgggaccggggccaacactggcagctggagatggcggacacgagatccgtgcacgagactaggtttgaggcggccgtgaaggtgatccagagtttgccgaagaatggttcattccagccaacaaatgaaatgatgcttaaattttatagcttctataagcaggcaactgaaggaccctgtaaactttcaaggcctggattttgggatcctattggaagatataaatgggatgcttggagttcactgggtgatatgaccaaagaggaagccatgattgcatatgttgaagaaatgaaaaagattattgaaactatgccaatgactgagaaagttgaagaattgctgcgtgtcataggtccattttatgaaattgtcgaggacaaaaagagtggcaggagttctgatataacctcagtccgactggagaaaatctctaaatgtttagaagatcttggtaatgttctcacttctactccaaacgccaaaaccgttaatggtaaagctgaaagcagtgacagtggagccgagtctgaggaagaagaggcccaagaagaagtgaaaggagcagaacaaagtgataatgataagaaaatgatgaagaagtcagcagaccataagaatttggaagtcattgtcactaatggctatgataaagatggctttgttcaggatatacagaatgacattcatgccagttcttccctgaatggcagaagcactgaagaagtaaagcccattgatgaaaacttggggcaaactggaaaatctgctgtttgcattcaccaag

SEQ ID NO: 104274 - DNA, 1645 bp, Homo sapiens
  Payload ID: 484
  Gene Symbol: ACBD5
  Gene Name: acyl-CoA binding domain containing 5
  ENST ID: ENST00000476758
  CDS Start-End: 90-293
ggcctggatagggcagggcaaaggggaactgacccgcttcgctcccgggcctcctccttttggggcatgttgatccgcggctgcgctccatgttccagtttcatgcaggctcttgggaaagctggtgctgctgctgcctgattcccgccgacagaccttgggaccggggccaacactggcagctggagatggcggacacgagatccgtgcacgagactaggtttgaggcggccgtgaaggtgatccagagtttgccgaagaatgggatgcttggagttcactgggtgatatgaccaaagaggaagccatgattgcatatgttgaagaaatgaaaaagattattgaaactatgccaatgactgagaaagttgaagaattgctgcgtgtcataggtccattttatgaaattgtcgaggacaaaaagagtggcaggagttctgatataacctcagtccgactggagaaaatctctaaatgtttagaagctctcagaagatttgtatgcacattaaagttgagaagctctgatgtatttaccctcgggatatagctttggccacttggacaatttgcttttatcttggtaatgttctcacttctactccaaacgccaaaaccgttaatggtaaagctgaaagcagtgacagtggagccgagtctgaggaagaagaggcccaagaagaagtgaaaggagcagaacaaagtgataatgataagaaaatgatgaagaagtcagcagaccataagaatttggaagtcattgtcactaatggctatgataaagatggctttgttcaggatatacagaatgacattcatgccagttcttccctgaatggcagaagcactgaagaagtaaagcccattgatgaaaacttggggcaaactggaaaatctgctgtttgcattcaccaagatataaatgatgatcatgttgaagatgttacaggaattcagcatttgacaagcgattcagacagtgaagtttactgtgattctatggaacaatttggacaagaagagtctttagacagctttacgtccaacaatggaccatttcagtattacttgggtggtcattccagtcaacccatggaaaattctggatttcgtgaagatattcaagtacctcctggaaatggcaacattgggaatatgcaggtggttgcagttgaaggaaaaggtgaagtcaagcatggaggagaagatggcaggaataacagcggagcaccacaccgggagaagcgaggcggagaaactgacgaattctctaatgttagaagaggaagaggacataggatgcaacacttgagcgaaggaaccaagggccggcaggtgggaagtggaggtgatggggagcgctggggctccgacagagggtcccgaggcagcctcaatgagcagatcgccctcgtgctgatgagactgcaggaggacatgcagaatgtccttcagagactgcagaaactggaaacgctgactgctttgcaggcaaaatcatcaacatcaacattgcagactgctcctcagcccacctcacagagaccatcttggtggcccttcgagatgtctcctggtgtgctaacgtttgccatcatatggccttttattgcacagtggttggtgtatttatactatcaaagaa

SEQ ID NO: 104275 - DNA, 1670 bp, Homo sapiens
  Payload ID: 485
  Gene Symbol: ACBD6
  Gene Name: acyl-CoA binding domain containing 6
  Uniprot ID: Q9BR61
  ENST ID: ENST00000367595
  CDS Start-End: 689-1537
gggctgtttggaggcgcttggggcgcacaatctggggcaggcggaaccttagtcctcagcctcgcgtttcccgcgactccgctctcaccgctacactaccacacaaacggcctccttcccccacccccgggggcccatcccggtggcgggctccggagctcgggactgctaatttcagcgaaacgattaaaagacgcccctacagctgacggcactttctctcctccggcagggaaggacgtccagcgtagcgtcgcccgcgcttccccgccggcgcagagcaggcctcacagaatcgcacgccgctggcacgcacgccgccccgcccccacggcccagcgccagccgcgccccgcgctcgcacgcatcccggcctcactgcccctcgactcctgttccgttggaggggcctgaggcgagcctgagcgcgctgttggccggagggaagccggaggagaccgggtcgactgggcagagcggcagagggtcgaggagcctgctctgcacgcccagggagtagaagtgggcagggagcagggtcacgtgagggagcgcgccgcgactgagcttgggtccgactggagctcaggctcgcgacccagactggtgggccaggcctccaagccggccttacacccaatccaaggaggacagaccggacacagagggacggagcgagcaaggagacatggcttcatcattcctgcccgcgggggccatcaccggcgacagcggtggagagctgagctcaggggacgactccggggaggtggagttcccccatagccctgagatcgaggagaccagttgcctggccgagctgtttgagaaggctgccgcgcacctgcaaggcctgattcaggtggccagcagggagcagctcttgtacctgtatgccaggtacaaacaggtcaaagttggaaattgtaatactcctaaaccaagcttctttgattttgaaggaaagcaaaaatgggaagcttggaaagcacttggtgattcaagccccagccaagcaatgcaggaatatatcgcagtagttaaaaaactagatccaggttggaatcctcagataccagagaagaaaggaaaagaagcaaatacaggttttggtgggccagttattagttctctatatcatgaagaaaccatcagggaagaagacaaaaatatatttgattactgcagggaaaacaacattgaccatataaccaaagccatcaaatcgaaaaatgtggatgtgaatgtgaaagatgaagagggtagggctctacttcactgggcctgtgatcgaggacataaggaactagtcacagtgttgctgcaacatagagctgacattaactgtcaggacaatgaaggccaaacagctctacattatgcctctgcctgtgagtttctggatattgtagagctgctgctccagtctggtgctgaccccactctccgagaccaggatggctgcctgccagaggaggtgacaggctgcaaaacagtttctttggtgctgcagcggcacacaactggcaaggcttaatcaaaagactggaaaactgcagtctgtaatagcataaggcttccattatgaaagaaaactacaaaaataatacttcttttccacccgtctttggtatgtattggctaataaaatcagttctgtggaactggga

SEQ ID NO: 104276 - DNA, 1322 bp, Homo sapiens
  Payload ID: 486
  Gene Symbol: ACBD7
  Gene Name: acyl-CoA binding domain containing 7
  Uniprot ID: Q8N6N7
  ENST ID: ENST00000356189
  CDS Start-End: 49-315
agagcaccggacgacaacagcagcagcaacaacgcggcagccgccaccatggccctgcaggctgattttgacagggctgcagaagatgtgaggaagctgaaagcaagaccagatgatggagaactgaaagaactctatgggctttacaaacaagcaatagttggagacattaatattgcgtgtccaggaatgctagatttaaaaggcaaagccaaatgggaagcatggaacctcaaaaaagggttgtcgacggaagatgcgacgagtgcctatatttctaaagcaaaggagctgatagaaaaatacggaatttagaatacagcatatgaggaatttttccttttgaagacttccaaatgctatcatgacctaacatttagagggagaggcatactgttaacttgatgtatcatgtatatttttgctattagcatgagctgtagtacttagaagtatactgaaactacatagttaactcaattgtacttgcttaaaccaggtgtctttaaaagttctttttaagaaaatgtggcacatatacaccatggaatactatggagccataaaaagggatgagttcatgtcctttgcagggacatggatgaagctggaaaccatcattctcagcaaactatcacaagatcagaaaaccaagcatgttctcactcataagtgggagttgaacaatgagaacacatggacacagggaagggaacatcacacactggggcctgtcggggactagggggttaggggagggataacattaggagacatacctgatgtaggtgaccggttgatgggtacagcaaaccaccatggcacatgtatacctatgtaacaaaactgcacgttctgcatatgtatcccagaacttaaagtataaaaaaaaaaattcttttagaaaagtattttttatttttatagagttagggagtacagttgcagtttttgtttgtttgtttgttttttcttgaggagtctcactctgtcacccaggctggagtgcagtcgtgtgatctcggttcactgcaacctccgcctcctgggttcaagtgattctcttgcctcagcctcccgagtagctgggattacaggtgcttgccaccatggctggctaatttttgtatttttagtagagacggggttttgccatgttggccaggctggtctcgaactcctgacctcaggtgatctgcccaccttggcgctggggttgcaggtgtgagccaccacacctggtcacaggtgcagttttgttacatggatatattgtgtagtggggaaatctgggcttttagtgtaaccatcaccaaaatact

SEQ ID NO: 104277 - DNA, 3959 bp, Homo sapiens
  Payload ID: 487
  Gene Symbol: ACAD10
  Gene Name: acyl-CoA dehydrogenase family, member 10
  Uniprot ID: Q6JQN1
  ENST ID: ENST00000313698
  CDS Start-End: 156-3335
gtcgtggagattgcttgcgctggggtgccacacttaggctgagctgcaggttttcgcacagtcgcgagttaacctctgcttgctccagaggcctcgtcctaatccacctcggctgacggcgcgggatccctggctccgcgagcctcagcctcaccatgtgtgtcaggagctgtttccagtccccccgtctccagtgggtgtggagaacagccttcctgaaacacacccagcgcaggcaccaggggtcccaccgatggacacaccttggaggcagcacctacagagcggtgattttcgacatgggcggagttctcattccttctccagggagagtcgctgcagaatgggaggtacagaatcgtatcccttctggaactatattaaaggccttgatggaaggtggtgaaaatgggccctggatgagatttatgagagcagaaataacagcagagggttttttacgagaatttgggagactttgctctgaaatgttaaagacctccgtgcctgtggactcatttttctctctgttgaccagtgagcgagtggcaaagcagttcccagtgatgactgaggccataactcaaattcgggcaaaaggtcttcagactgcagtcttgagcaataatttttatcttcccaaccagaaaagctttttgcccctggaccggaaacagtttgatgtgattgtggagtcctgcatggaagggatctgtaagccagaccctaggatctacaagctgtgcttggagcagctcggcctgcagccctctgagtccatctttcttgatgaccttggaacaaatctaaaagaagctgccagacttggtattcacaccattaaggttaatgacccagagactgcagtaaaggaattagaagctctcttgggttttacattgagagtaggtgttccaaacactcggcctgtgaaaaagacgatggaaattccgaaagattccttgcagaagtacctcaaagacttactgggtatccagaccacaggcccattggaactacttcagtttgatcacgggcagtcaaatccaacttactacatcaggctggctaatcgtgatctagttctgaggaagaagcccccagggacactccttccatctgcccatgccatagagagggagttcaggattatgaaagcccttgcaaatgctggagtacctgtccctaacgttcttgatctctgtgaagattcaagtgtcattggcacccccttctatgtgatggagtactgcccaggtctcatctacaaagacccttccctgccaggcttggagcccagccacagacgagccatatacactgccatgaacacagtcctgtgcaaaattcacagtgtggatctgcaggctgtgggacttgaagactatgggaagcaaggggactatattccacgccaggtacgaacctgggttaagcagtatcgagcttccgaaactagcaccatcccagccatggagaggctgatcgaatggctgcccctccatcttccccgtcagcagaggaccacagtggtgcacggggacttcaggctcgacaacctggtgtttcatccagaagagccagaggtgcttgctgtccttgactgggaactttctaccttgggcgacccccttgctgatgtggcctacagctgcctggctcattacctgccatccagttttcccgtgctgagaggtattaatgactgtgacttgacacagctgggaatccctgctgcagaggagtatttcaggatgtactgtctccaaatggggctccctcccactgagaactggaacttctatatggctttttcctttttccgtgtggctgcaatcctacagggagtctacaagcgatcactcacagggcaagcaagctccacatatgcggaacaaactggaaagctgaccgaatttgtgtctaacctggcgtgggatttcgcagtcaaagaagggttccgggttttcaaagagatgcccttcacaaatccgttaacaaggtcctaccacacgtgggccaggccccagtcccagtggtgccccacaggcagcaggagttatagctccgttccagaagcttccccagctcatacctcaaggggaggtctggttatctctccagagagcctctctccacctgtcagagagctgtatcaccggctgaagcacttcatggagcaacgtgtgtaccctgcagagccagagctgcagagtcaccaggcctcagcagccaggtggagcccctccccactgatcgaagacctcaaggagaaagccaaagctgaaggactttggaaccttttcctacccttagaggctgatcccgagaaaaaatacggagcaggactgaccaatgtggaatatgcacatctgtgtgagctcatgggcacgtccctgtatgcccccgaggtatgtaactgctctgcgcctgacacgggcaacatggagctgctggtgaggtatggcaccgaagcgcagaaggctcgctggctgattcctctgctggaggggaaagcccgctcctgttttgctatgaccgagccccaggttgcctcttcagatgccaccaacattgaggcttccatcagagaggaggacagcttctatgtcataaacggtcacaaatggtggatcacaggcatcctggatcctcgttgccaactctgtgtgtttatgggaaaaacagacccacatgcaccaagacaccggcagcagtctgtgctcttggttcccatggataccccagggataaaaatcatccggcctctgacggtgtatggactggaagatgcaccaggtggccatggtgaagtccgatttgagcacgtgcgtgtgcccaaagagaacatggtcctgggccctggccgaggctttgagatcgcccagggcagactgggccccggcaggatccatcactgcatgaggctgatcgggttctcagagagggccctggcactcatgaaggcccgcgtgaagtcccgcttggcttttgggaagcccctggtggagcagggcacagtgctggcggacatcgcgcagtcgcgcgtggagattgagcaggcacggctgctggtgctgagagctgcccacctcatggacctggcaggaaacaaggctgcagccttggatatagccatgattaaaatggtcgccccgtccatggcctcccgagtgattgatcgtgcgattcaggcctttggagcagcaggcctgagcagcgactacccactggctcagttcttcacctgggcccgagccctgcgctttgccgacggccctgacgaggtgcaccgggccacggtggccaagctagagctgaagcaccgcatttagagccttggggctgcagtggctcaatgtcctggctggtccagctgtgcccagatctgtcactgatgtgcctcgaaagatccggtgtttgtggctcctgcaccctgctcagcagctctgtcccgggacagtcagggtggactcaatctttctggttctccacagaagacgtctctgcaagaagcctggagtctgtttcaggccaggaggaggggatttgctgagggccaagggggttctgggacagagtctggaaagctggtcttcaggctctcagtcccaggctgggcaggcacggtcacttcacttcagcctttcagtccctctctctctgcctgtgggaatctggacacattttgggaggcctcccaaggctgtgggacgtgcttgctctggcagctgcagggttcctgtctggcctccctggtgagcagaggggcggccacggcgggcggtggcctagagacccaggacctgggcgcctgggaaaatggaatgcaacccacattgtaaagccactggcatctgattatctccatttgaacacacagcacagaacaatcatttaaatgttattttggaaaggggttttggggacacagaagaataagtaaacacatctcggag

SEQ ID NO: 104278 - DNA, 4071 bp, Homo sapiens
  Payload ID: 487
  Gene Symbol: ACAD10
  Gene Name: acyl-CoA dehydrogenase family, member 10
  Uniprot ID: Q6JQN1
  ENST ID: ENST00000455480
  CDS Start-End: 178-3450
gaggaggtcggagcggaaggacgtcgtggagattgcttgcgctggggtgccacacttaggctgagctgcaggttttcgcacagtcgcgagttaacctctgcttgctccagaggcctcgtcctaatccacctcggctgacggcgcgggatccctggctccgcgagcctcagcctcaccatgtgtgtcaggagctgtttccagtccccccgtctccagtgggtgtggagaacagccttcctgaaacacacccagcgcaggcaccaggggtcccaccgatggacacaccttggaggcagcacctacagagcggtgattttcgacatgggcggagttctcattccttctccagggagagtcgctgcagaatgggaggtacagaatcgtatcccttctggaactatattaaaggccttgatggaaggtggtgaaaatgggccctggatgagatttatgagagcagaaataacagcagagggttttttacgagaatttgggagactttgctctgaaatgttaaagacctccgtgcctgtggactcatttttctctctgttgaccagtgagcgagtggcaaagcagttcccagtgatgactgaggccataactcaaattcgggcaaaaggtcttcagactgcagtcttgagcaataatttttatcttcccaaccagaaaagctttttgcccctggaccggaaacagtttgatgtgattgtggagtcctgcatggaagggatctgtaagccagaccctaggatctacaagctgtgcttggagcagctcggcctgcagccctctgagtccatctttcttgatgaccttggaacaaatctaaaagaagctgccagacttggtattcacaccattaagagacagggttttgccgtgttgcccaagctggtgtcgaactcctgggctcaagcgatctacccaccttaccctcccaaagtggtgagattacaggttaatgacccagagactgcagtaaaggaattagaagctctcttgggttttacattgagagtaggtgttccaaacactcggcctgtgaaaaagacgatggaaattccgaaagattccttgcagaagtacctcaaagacttactgggtatccagaccacaggcccattggaactacttcagtttgatcacgggcagtcaaatccaacttactacatcaggctggctaatcgtgatctagttctgaggaagaagcccccagggacactccttccatctgcccatgccatagagagggagttcaggattatgaaagcccttgcaaatgctggagtacctgtccctaacgttcttgatctctgtgaagattcaagtgtcattggcacccccttctatgtgatggagtactgcccaggtctcatctacaaagacccttccctgccaggcttggagcccagccacagacgagccatatacactgccatgaacacagtcctgtgcaaaattcacagtgtggatctgcaggctgtgggacttgaagactatgggaagcaaggggactatattccacgccaggtacgaacctgggttaagcagtatcgagcttccgaaactagcaccatcccagccatggagaggctgatcgaatggctgcccctccatcttccccgtcagcagaggaccacagtggtgcacggggacttcaggctcgacaacctggtgtttcatccagaagagccagaggtgcttgctgtccttgactgggaactttctaccttgggcgacccccttgctgatgtggcctacagctgcctggctcattacctgccatccagttttcccgtgctgagaggtattaatgactgtgacttgacacagctgggaatccctgctgcagaggagtatttcaggatgtactgtctccaaatggggctccctcccactgagaactggaacttctatatggctttttcctttttccgtgtggctgcaatcctacagggagtctacaagcgatcactcacagggcaagcaagctccacatatgcggaacaaactggaaagctgaccgaatttgtgtctaacctggcgtgggatttcgcagtcaaagaagggttccgggttttcaaagagatgcccttcacaaatccgttaacaaggtcctaccacacgtgggccaggccccagtcccagtggtgccccacaggcagcaggagttatagctccgttccagaagcttccccagctcatacctcaaggggaggtctggttatctctccagagagcctctctccacctgtcagagagctgtatcaccggctgaagcacttcatggagcaacgtgtgtaccctgcagagccagagctgcagagtcaccaggcctcagcagccaggtggagcccctccccactgatcgaagacctcaaggagaaagccaaagctgaaggactttggaaccttttcctacccttagaggctgatcccgagaaaaaatacggagcaggactgaccaatgtggaatatgcacatctgtgtgagctcatgggcacgtccctgtatgcccccgaggtatgtaactgctctgcgcctgacacgggcaacatggagctgctggtgaggtatggcaccgaagcgcagaaggctcgctggctgattcctctgctggaggggaaagcccgctcctgttttgctatgaccgagccccaggttgcctcttcagatgccaccaacattgaggcttccatcagagaggaggacagcttctatgtcataaacggtcacaaatggtggatcacaggcatcctggatcctcgttgccaactctgtgtgtttatgggaaaaacagacccacatgcaccaagacaccggcagcagtctgtgctcttggttcccatggataccccagggataaaaatcatccggcctctgacggtgtatggactggaagatgcaccaggtggccatggtgaagtccgatttgagcacgtgcgtgtgcccaaagagaacatggtcctgggccctggccgaggctttgagatcgcccagggcagactgggccccggcaggatccatcactgcatgaggctgatcgggttctcagagagggccctggcactcatgaaggcccgcgtgaagtcccgcttggcttttgggaagcccctggtggagcagggcacagtgctggcggacatcgcgcagtcgcgcgtggagattgagcaggcacggctgctggtgctgagagctgcccacctcatggacctggcaggaaacaaggctgcagccttggatatagccatgattaaaatggtcgccccgtccatggcctcccgagtgattgatcgtgcgattcaggcctttggagcagcaggcctgagcagcgactacccactggctcagttcttcacctgggcccgagccctgcgctttgccgacggccctgacgaggtgcaccgggccacggtggccaagctagagctgaagcaccgcatttagagccttggggctgcagtggctcaatgtcctggctggtccagctgtgcccagatctgtcactgatgtgcctcgaaagatccggtgtttgtggctcctgcaccctgctcagcagctctgtcccgggacagtcagggtggactcaatctttctggttctccacagaagacgtctctgcaagaagcctggagtctgtttcaggccaggaggaggggatttgctgagggccaagggggttctgggacagagtctggaaagctggtcttcaggctctcagtcccaggctgggcaggcacggtcacttcacttcagcctttcagtccctctctctctgcctgtgggaatctggacacattttgggaggcctcccaaggctgtgggacgtgcttgctctggcagctgcagggttcctgtctggcctccctggtgagcagaggggcggccacggcgggcggtggcctagagacccaggacctgggcgcctgggaaaatggaatgcaacccacattgtaaagccactggcatctgattatctccatttgaacacacagcacagaacaatcatttaaatgttattttggaaaggggttttggggacacagaagaataagtaaacacatctcg

SEQ ID NO: 104279 - DNA, 501 bp, Homo sapiens
  Payload ID: 487
  Gene Symbol: ACAD10
  Gene Name: acyl-CoA dehydrogenase family, member 10
  ENST ID: ENST00000514615
  CDS Start-End: 214-501
ggacgcaattttgaggaggtcggagcggaaggacgtcgtggagattgcttgcgctggggtgccacacttaggctgagctgcaggttttcgcacagtcgcgagttaacctctgcttgctccagaggcctcgtcctaatccacctcggctgacggcgcgggatccctggctccgcgagataggtacaacgaggctcagagagcctcagcctcaccatgtgtgtcaggagctgtttccagtccccccgtctccagtgggtgtggagaacagccttcctgaaacacacccagcgcaggcaccaggggtcccaccgatggacacaccttggaggcagcacctacagagcggtgattttcgacatgggcggagttctcattccttctccagggagagtcgctgcagaatgggaggtacagaatcgtatcccttctggaactatattaaaggccttgatggaaggtggtgaaaatgggccctggatgagatttatgagagcagaaata

SEQ ID NO: 104280 - DNA, 833 bp, Homo sapiens
  Payload ID: 487
  Gene Symbol: ACAD10
  Gene Name: acyl-CoA dehydrogenase family, member 10
  ENST ID: ENST00000507683
  CDS Start-End: 1-833
ggaattagaagctctcttgggttttacattgagagtaggtgttccaaacactcggcctgtgaaaaagacgatggaaattccgaaagattccttgcagaagtacctcaaagacttactgggtatccagaccacaggcccattggaactacttcagtttgatcacgggcagtcaaatccaacttactacatcaggctggctaatcgtgatctagttctgaggaagaagcccccagggacactccttccatctgcccatgccatagagagggagttcaggattatgaaagcccttgcaaatgctggagtacctgtccctaacgttcttgatctctgtgaagattcaagtgtcattggcacccccttctatgtgatggagtactgcccaggtctcatctacaaagacccttccctgccaggcttggagcccagccacagacgagccatatacactgccatgaacacagtcctgtgcaaaattcacagtgtggatctgcaggctgtgggacttgaagactatgggaagcaagggcaagcaagctccacatatgcggaacaaactggaaagctgaccgaatttgtgtctaacctggcgtgggatttcgcagtcaaagaagggttccgggttttcaaagagatgcccttcacaaatccgttaacaaggtcctaccacacgtgggccaggccccagtcccagtggtgccccacaggcagcaggagttatagctccgttccagaagcttccccagctcatacctcaaggggaggtctggttatctctccagagagcctctctccacctgtcagagagctgtatcaccggctgaagcacttca

SEQ ID NO: 104281 - DNA, 2888 bp, Homo sapiens
  Payload ID: 487
  Gene Symbol: ACAD10
  Gene Name: acyl-CoA dehydrogenase family, member 10
  ENST ID: ENST00000549590
  CDS Start-End: 183-2315
attttgaggaggtcggagcggaaggacgtcgtggagattgcttgcgctggggtgccacacttaggctgagctgcaggttttcgcacagtcgcgagttaacctctgcttgctccagaggcctcgtcctaatccacctcggctgacggcgcgggatccctggctccgcgagcctcagcctcaccatgtgtgtcaggagctgtttccagtccccccgtctccagtgggtgtggagaacagccttcctgaaacacacccagcgcaggcaccaggggtcccaccgatggacacaccttggaggcagcacctacagagcggtgattttcgacatgggcggagttctcattccttctccagggagagtcgctgcagaatgggaggtacagaatcgtatcccttctggaactatattaaaggccttgatggaaggtggtgaaaatgggccctggatgagatttatgagagcagaaataacagcagagggttttttacgagaatttgggagactttgctctgaaatgttaaagacctccgtgcctgtggactcatttttctctctgttgaccagtgagcgagtggcaaagcagttcccagtgatgactgaggccataactcaaattcgggcaaaaggtcttcagactgcagtcttgagcaataatttttatcttcccaaccagaaaagctttttgcccctggaccggaaacagtttgatgtgattgtggagtcctgcatggaagggatctgtaagccagaccctaggatctacaagctgtgcttggagcagctcggcctgcagccctctgagtccatctttcttgatgaccttggaacaaatctaaaagaagctgccagacttggtattcacaccattaaggttaatgacccagagactgcagtaaaggaattagaagctctcttgggttttacattgagagtaggtgttccaaacactcggcctgtgaaaaagacgatggaaattccgaaagattccttgcagaagtacctcaaagacttactgggtatccagaccacaggcccattggaactacttcagtttgatcacgggcagtcaaatccaacttactacatcaggctggctaatcgtgatctagttctgaggaagaagcccccagggacactccttccatctgcccatgccatagagagggagttcaggattatgaaagcccttgcaaatgctggagtacctgtccctaacgttcttgatctctgtgaagattcaagtgtcattggcacccccttctatgtgatggagtactgcccaggtctcatctacaaagacccttccctgccaggcttggagcccagccacagacgagccatatacactgccatgaacacagtcctgtgcaaaattcacagtgtggatctgcaggctgtgggacttgaagactatgggaagcaaggggactatattccacgccaggtacgaacctgggttaagcagtatcgagcttccgaaactagcaccatcccagccatggagaggctgatcgaatggctgcccctccatcttccccgtcagcagaggaccacagtggtgcacggggacttcaggctcgacaacctggtgtttcatccagaagagccagaggtgcttgctgtccttgactgggaactttctaccttgggcgacccccttgctgatgtggcctacagctgcctggctcattacctgccatccagttttcccgtgctgagaggtattaatgactgtgacttgacacagctgggaatccctgctgcagaggagtatttcaggatgtactgtctccaaatggggctccctcccactgagaactggaacttctatatggctttttcctttttccgtgtggctgcaatcctacagggagtctacaagcgatcactcacagggcaagcaagctccacatatgcggaacaaactggaaagctgaccgaatttgtgtctaacctggcgtgggatttcgcagtcaaagaagggttccgggttttcaaagagatgcccttcacaaatccgttaacaaggtcctaccacacgtgggccaggccccagtcccagtggtgccccacaggcagcaggagttatagctccgttccagaagcttccccagctcatacctcaaggggaggtctggttatctctccagagagcctctctccacctgtcagagagctgtatcaccggctgaagcacttcatggagcaacgtgtgtaccctgcagagccagagctgcagagtcaccaggcctcagcagccaggtggagcccctccccactgatcgaagacctcaaggtaaagcagccatggtgaggtggtaagaccccaataccatggcataccctccccgaccccaccgggctcacctgaaccatcccaggcagtgaagatacaggagctccgagttgaatgatctttgcttccatcgtctcagaaagagccagctcttcatgactcagtttccatctcttgctcttgctgtgcctgtgtcacaggcagatggctcaggtgtgactgcacagcccaggcagtggaatgcttggccttagaaagccagggcaggttaggcctatctgatgggtatttgaattatgtaaatttgaaacagtgctgtatcagctaataaatctctctctagagaacccgtaatatcacagctagagggccagatccactgtgagctgagtttctgtgttgtctcccagtgctgtcacttcagctgataaacagaaacacccgctgttccttatcacgtgaaccttggattgtgttagttttgaaattacttgagatcttcaggagcataatgcaatcatcatctacttttctttttttctctttttttttgagacggagtcttgctctgtgcaacttccgcctcccagg

SEQ ID NO: 104282 - DNA, 589 bp, Homo sapiens
  Payload ID: 487
  Gene Symbol: ACAD10
  Gene Name: acyl-CoA dehydrogenase family, member 10
  ENST ID: ENST00000552965
  CDS Start-End: 550-589
aggaggtcggagcggaaggacgtcgtggagattgcttgcgctggggtgccacacttaggctgagctgcaggttttcgcacagtcgcgagttaacctctgcttgctccagaggcctcgtcctaatccacctcggctgacggcgcgggatccctggctccgcgagggtttcaccatgttggtcagacttgtctcgaactcctgaccttgtgatccgcccacttcggcctcccaaagtgctgggatgacaggcgtgagccaccgcgcccggcccccccaaaggcatttttcgtctctactaagccctcacacaaaatatacaagtgtgtatcggatatttggattagggatgctcaacctctacagttttttagtcctagctgggcgccgtgactcacacctgtaattccagcactttgggaggctgagcttatagaaaagtcaaaagaagttacagtgatctcccgttatacctttcatctagactcactattaatgtctggccatgtttggttttctctatacacgagtgtatatagcctcagcctcaccatgtgtgtcaggagctgtttccagtccccccgtctccagt

SEQ ID NO: 104283 - DNA, 678 bp, Homo sapiens
  Payload ID: 487
  Gene Symbol: ACAD10
  Gene Name: acyl-CoA dehydrogenase family, member 10
  ENST ID: ENST00000552706
  CDS Start-End: 1-678
gttaatgacccagagactgcagtaaaggaattagaagctctcttgggttttacattgagagtaggtgttccaaacactcggcctgtgaaaaagacgatggaaattccgaaagattccttgcagaagtacctcaaagacttactgggtatccagaccacaggcccattggaactacttcagtttgatcacgggcagtcaaatccaacttactacatcaggctggctaatcgtgatctagttctgaggaagaagcccccagggacactccttccatctgcccatgccatagagagggagttcaggattatgaaagcccttgcaaatgctggagtacctgtccctaacgttcttgatctctgtgaagattcaagtgtcattggcacccccttctatgtgatggagtactgcccaggtctcatctacaaagacccttccctgccaggcttggagcccagccacagacgagccatatacactgccatgaacacagtcctgtgcaaaattcacagtgtggatctgcaggctgtgggacttgaagactatgggaagcaaggctcgacaacctggtgtttcatccagaagagccagaggtgcttgctgtccttgactgggaactttctaccttgggcgacccccttgctgatgtggcctacagctgcctggctcattacctgccat

SEQ ID NO: 104284 - DNA, 703 bp, Homo sapiens
  Payload ID: 487
  Gene Symbol: ACAD10
  Gene Name: acyl-CoA dehydrogenase family, member 10
  ENST ID: ENST00000515283
  CDS Start-End: 266-703
gtcggagcggaaggacgtcgtggagattgcttgcgctggggtgccacacttaggctgagctgcaggttttcgcacagtcgcgagttaacctctgcttgctccagaggcctcgtcctaatccacctcggctgacggcgcgggatccctggctccgcgagggcaagcaagctccacatatgcggaacaaactggaaagctgaccgaatttgtgtctaacctggcgtgggatttcgcagtcaaagaagggttccgggttttcaaagagatgcccttcacaaatccgttaacaaggtcctaccacacgtgggccaggccccagtcccagtggtgccccacaggcagcaggagttatagctccgttccagaagcttccccagctcatacctcaaggggaggtctggttatctctccagagagcctctctccacctgtcagagagctgtatcaccggctgaagcacttcatggagcaacgtgtgtaccctgcagagccagagctgcagagtcaccaggcctcagcagccaggtggagcccctccccactgatcgaagacctcaaggagaaagccaaagctgaaggactttggaaccttttcctacccttagaggctgatcccgagaaaaaatacggagcaggactgaccaatgtggaatatgcacatctgtgtgagctcatgggcacgtccctgtatgcccccgaggta

SEQ ID NO: 104285 - DNA, 4142 bp, Homo sapiens
  Payload ID: 488
  Gene Symbol: ACAD11
  Gene Name: acyl-CoA dehydrogenase family, member 11
  Uniprot ID: Q709F0
  ENST ID: ENST00000264990
  CDS Start-End: 973-3315
gcctccgaccggcgacgcaggttacctgtagggattcgaatccaccacctctgagctcatcttctcgatgcggacccggccgccccctccgtcgccgctcctcgggacctgcagactcctctcctgggcaagttcccgctccagctcctggacccgctgctgcaggcgctccacagactccgccatggctgggactccggccgccaacgctcccagcccgggccttcgccgccgccttcgccccacgttgctcggctgggcccgcgaggggtacgtggggaggcacctcgccgctgccttcctagcccagagccctggggacgtgcacccagcgcctcacagacagacacgtctccgagactcccacaggccttcctcggagccgcttccggtgcgtcgcagacatcgctccccctcatcaaaaacctggctctttcggcttccttcctcgctgggccggctaaacccggccgcagcagcaccggggtgataagtgtccagggcaggaggccagcgatgttgccttgctaaccgggtatctaagagaaacagggtctttttattcttaggctcgacagtctgacggccctttttctgaacgggaccctgcaggtcttccgcctgctgttgcattaaatttgggggtggaagaggcttctgcgttgttccttacccgcaacgatgaccatggctttgccttctttaaaattgaggcctccaactctgacgctgactggagaattgaaacccgaacacacattgggctcttttggcacttgactagagctaaaacctcgggattcagcgggcaagcgttgctcagcaacggcgcgtaggctgtgtgcggttggctggagccagaccccaccccggcctcggcccatgctctagaggggacgttgccccaatcctgaaggacttcggcactcgagacctgtggatgccgcgttgctgtggcctgcgggggtgatcatgaagccaggtgctactggcgagtccgatttggccgaagtgctgccccagcacaagttcgacagcaagtccctggaggcctacctaaaccagcacttgtctggctttggggccgaacgtgaggctacgctgaccattgcccagtacagagcaggaaagtccaatccaaccttttatctccagaagggctttcaaacatatgtgctcaggaaaaaaccaccaggttcacttcttcctaaagcacatcagattgatagagaatttaaagtccagaaagccttgttttcaattggattccccgttcccaagcctatactgtactgcagtgatacttctgtcattggaacagaattttacgtaatggaacatgtgcagggtcgaatcttccgtgatttaacaattcctggacttagcccagcagaacgttcagccatatatgtggccacggtagaaacattggctcagttacattccttgaatatacagtcactgcagctggaaggatatggtataggtgctgggtactgcaaaagacaggtatcaacctggacaaagcaatatcaagctgcagctcatcaggacatccctgccatgcaacagctatcggagtggctaatgaagaacttgcccgataatgacaatgaagagaatttgattcatggagatttcagactagataacatagttttccaccctaaagagtgtcgagttatagcagtgctggattgggagctgtcaaccattggtcatcctttgtcagacttagctcatttttccctgttctacttttggccaaggacagttccaatgataaatcaaggttcttatagtgaaaactcagggataccatcaatggaagaactgatttcaatatattgccgctgcaggggaattaattctattcttcctaactggaatttctttcttgccctttcatattttaagatggctggaatagcacagggagtatatagcagatatcttctgggaaataattcatctgaggatagctttttatttgccaatattgtgcaacctctggcagaaactggactacaactctccaaacgaactttcagtactgtactaccacagattgatactactggacagttgtttgtacagactcggaaaggtcaggaagttcttattaaggtgaagcatttcatgaaacaacacattcttccagctgaaaaggaggtaactgagttctatgttcaaaatgaaaattcagtggacaagtggggaaaacctttagtgattgataaactcaaggaaatggccaaagtcgagggtctctggaacttgtttttgccagctgtcagcggactcagccacgtggactatgccttgattgctgaagaaacaggaaaatgcttttttgctccagatgtctttaactgccaagcaccagacacagggaatatggaggttctgcacctgtatggaagtgaggaacagaagaaacagtggcttgagcctcttcttcaagggaacattacctcttgcttctgtatgacagaacctgatgtagcttcaagtgatgccacgaatattgaatgcagcatccaacgagatgaagatagctatgtaattaacggcaaaaaatggtggagcagtggagctgggaatcccaagtgcaaaattgcaattgttttgggaagaactcaaaatacttctctctccagacacaaacagcacagcatgattcttgttcccatgaacacacctggagtaaaaataataaggcctttgtcagtttttggctacacagataattttcatggaggacattttgagatccattttaatcaagtgcgagttcctgccacaaatctaatactaggtgaaggtaggggatttgaaatttcccaaggccgccttggacctggcagaatccaccactgtatgagaacagtaggtttggcggaacgcgctttgcagatcatgtgtgagcgggcaacacaaaggatagctttcaagaagaagttgtatgcacatgaggttgtggctcactggattgctgaaagccgcattgccattgagaagatccgcttgttgactctgaaagctgctcacagcatggacactctgggcagtgctggcgctaagaaagagattgcaatgatcaaagtggctgccccacgggctgtcagcaaaatcgttgactgggccatccaggtgtgcggaggtgctggtgtttcccaggattaccctctggctaacatgtatgctataacccgagttttgcgtttagcagatggacctgacgaagttcatctttcagcaatcgcaacaatggagctgcgggaccaagccaaaagactgacagccaagatataaggagggtggcactgccacatcccactggcagaaactctcctttatacaaacttcattggctccaacatttgaatctcatatttttgtagcagtttgagcacagggttaattattcatttgtggtaaagattatagcatctattttgatcagtgggttttattatttcaagggtcacacagggttaagttcagtaagaaatgctgtagctgttgtcattcaatctagtgcctccttgaggccaggagttcaggaccagcctgggcaacatagcgagacccccattgctacaaaaaatttaaaaatgaaacaagtgtggtggcacatgcttgtagtcctagctacttgggaggctgaggcaggaggattgcttgagtctaggagtttgaggttacagtaagctgtgatcgtgacatggcctccagcctgggtgaccgagtgagactgtttctaaaaataaaaacaaaaaataaatttcttcttgaggtggggtggaggtggggagcaagaatttgacctggctctgatccctggtgtgttgtgtgggcctctttaacgtttgccactgagccttaacctcactgtacttcactgtacttcacacgcattggtgttaacattttaatcttagaagaccctgacccactgagggtttgttgtgagaattgctgaagccacgtagaagcaccttgaaatctgtaaaaccacaagaaagtactttataaaaggtatccttatttgaagtggataaatcttgtaactcgaaaagttgtgatttagaagacaggattgtttttgaacattaggaattaaaggctatatctggtcc

SEQ ID NO: 104286 - DNA, 2940 bp, Homo sapiens
  Payload ID: 488
  Gene Symbol: ACAD11
  Gene Name: acyl-CoA dehydrogenase family, member 11
  ENST ID: ENST00000485198
  CDS Start-End: 316-1617
ctgcgttgttccttacccgcaacgatgaccatggctttgccttctttaaaattgaggcctccaactctgacgctgactggagaattgaaacccgaacacacattgggctcttttggcacttgactagagctaaaacctcgggattcagcgggcaagcgttgctcagcaacggcgcgtaggctgtgtgcggttggctggagccagaccccaccccggcctcggcccatgctctagaggggacgttgccccaatcctgaaggacttcggcactcgagacctgtggatgccgcgttgctgtggcctgcgggggtgatcatgaagccaggtgctactggcgagtccgatttggccgaagtgctgccccagcacaagttcgacagcaagtccctggaggcctacctaaaccagcacttgtctggctttggggccgaacgtgaggctacgctgaccattgcccagtacagagcaggaaagtccaatccaaccttttatctccagaagggctttcaaacatatgtgctcaggaaaaaaccaccaggttcacttcttcctaaagcacatcagattgatagagaatttaaagtccagaaagccttgttttcaattggattccccgttcccaagcctatactgtactgcagtgatacttctgtcattggaacagaattttacgtaatggaacatgtgcagggtcgaatcttccgtgatttaacaattcctggacttagcccagcagaacgttcagccatatatgtggccacggtagaaacattggctcagttacattccttgaatatacagtcactgcagctggaaggatatggtataggtgctgggtactgcaaaagacaggtatcaacctggacaaagcaatatcaagctgcagctcatcaggacatccctgccatgcaacagctatcggagtggctaatgaagaacttgcccgataatgacaatgaagagaatttgattcatggagatttcagactagataacatagttttccaccctaaagagtgtcgagttatagcagtgctggattgggagctgtcaaccattggtcatcctttgtcagacttagctcatttttccctgttctacttttggccaaggacagttccaatgataaatcaaggttcttatagtgaaaactcagggataccatcaatggaagaactgatttcaatatattgccgctgcaggggaattaattctattcttcctaactggaatttctttcttgccctttcatattttaagatggctggaatagcacagggagtatatagcagatatcttctgggaaataattcatctgaggatagctttttatttgccaatattgtgcaacctctggcagaaactggactacaactctccaaacgaactttcagtactgtactaccacagattgatactactggacagttgtttgtacagactcggaaaggtcaggaagttcttattaaggtgaagcatttcatgaaacaacacattcttccagctgaaaagacacagggaatatggaggttctgcacctgtatggaagtgaggaacagaagaaacagtggcttgagcctcttcttcaagggaacattacctcttgcttctgtatgacagaacctgatgtagcttcaagtgatgccacgaatattgaatgcagcatccaacgagatgaagatagctatgtaattaacggcaaaaaatggtggagcagtggagctgggaatcccaagtgcaaaattgcaattgttttgggaagaactcaaaatacttctctctccagacacaaacagcacagcatgattcttgttcccatgaacacacctggagtaaaaataataaggcctttgtcagtttttggctacacagataattttcatggaggacattttgagatccattttaatcaagtgcgagttcctgccacaaatctaatactaggtgaaggtaggggatttgaaatttcccaaggccgccttggacctggcagaatccaccactgtatgagaacagtaggtttggcggaacgcgctttgcagatcatgtgtgagcgggcaacacaaaggatagctttcaagaagaagttgtatgcacatgaggttgtggctcactggattgctgaaagccgcattgccattgagaagatccgcttgttgactctgaaagctgctcacagcatggacactctgggcagtgctggcgctaagaaagagattgcaatgatcaaagtggctgccccacgggctgtcagcaaaatcgttgactgggccatccaggtgtgcggaggtgctggtgtttcccaggattaccctctggctaacatgtatgctataacccgagttttgcgtttagcagatggacctgacgaagttcatctttcagcaatcgcaacaatggagctgcgggaccaagccaaaagactgacagccaagatataaggagggtggcactgccacatcccactggcagaaactctcctttatacaaacttcattggctccaacatttgaatctcatatttttgtagcagtttgagcacagggttaattattcatttgtggtaaagattatagcatctattttgatcagtgggttttattatttcaagggtcacacagggttaagttcagtaagaaatgctgtagctgttgtcattcaatctagtgcctccttgaggccaggagttcaggaccagcctgggcaacatagcgagacccccattgctacaaaaaatttaaaaatgaaacaagtgtggtggcacatgcttgtagtcctagctacttgggaggctgaggcaggaggattgcttgagtctaggagtttgaggttacagtaagctgtgatcgtgacatggcctccagcctgggtgaccgagtgagactgtttctaaaaataaaaacaaaaaataaatttcttcttgaggtggggtggaggtgg

SEQ ID NO: 104287 - DNA, 1891 bp, Homo sapiens
  Payload ID: 488
  Gene Symbol: ACAD11
  Gene Name: acyl-CoA dehydrogenase family, member 11
  ENST ID: ENST00000481970
  CDS Start-End: 94-1524
cccatgctctagaggggacgttgccccaatcctgaaggacttcggcactcgagacctgtggatgccgcgttgctgtggcctgcgggggtgatcatgaagccaggtgctactggcgagtccgatttggccgaagtgctgccccagcacaagttcgacagcaagtccctggaggcctacctaaaccagcacttgtctggctttggggccgaacgtgaggctacgctgaccattgcccagtacagagcaggaaagtccaatccaaccttttatctccagaagggctttcaaacatatgtgctcaggaaaaaaccaccaggttcacttcttcctaaagcacatcagattgatagagaatttaaagtccagaaagccttgttttcaattggattccccgttcccaagcctatactgtactgcagtgatacttctgtcattggaacagaattttacgtaatggaacatgtgcagggtcgaatcttccgtgatttaacaattcctggacttagcccagcagaacgttcagccatatatgtggccacggtagaaacattggctcagttacattccttgaatatacagtcactgcagctggaaggatatggtataggtgctgggtactgcaaaagacaggtatcaacctggacaaagcaatatcaagctgcagctcatcaggacatccctgccatgcaacagctatcggagtggctaatgaagaacttgcccgataatgacaatgaagagaatttgattcatggagatttcagactagataacatagttttccaccctaaagagtgtcgagttatagcagtgctggattgggagctgtcaaccattggtcatcctttgtcagacttagctcatttttccctgttctacttttggccaaggacagttccaatgataaatcaaggttcttatagtgaaaactcagggataccatcaatggaagaactgatttcaatatattgccgctgcaggggaattaattctattcttcctaactggaatttctttcttgccctttcatattttaagatggctggaatagcacagggagtatatagcagatatcttctgggaaataattcatctgaggatagctttttatttgccaatattgtgcaacctctggcagaaactggactacaactctccaaacgaactttcagtactgtactaccacagattgatactactggacagttgtttgtacagactcggaaaggtcaggaagttcttattaaggtgaagcatttcatgaaacaacacattcttccagctgaaaaggaggtaactgagttctatgttcaaaatgaaaattcagtggacaagtggggaaaacctttagtgattgataaactcaaggaaatggccaaagtcgagggtctctggaacttgtttttgccagctgtcagcggactcagccacgtggactatgccttgattgctgaagaaacaggaaaatgcttttttgctccagatgtctttaactgccaagcaccaggttactacattaattgaaaacataattttttctaatattttgatcagtgtttaaaatttctatatatgataagaatgtgtttttatacaaagttattgacttatgaatttagctataattttacttttcagttactttgatttaaatataagaaatggatttgaaattttcattggactattcttttgttaaatatcattacaattaagagtattggtgaaaaaaattagccaccaaagggattggtcgtgtaaggatcatggatcatggatccatgggaattggatatttctattactagttggaatggatagagagtttcaaatcttttggttagcctcactattcattcaccaaatgaataaaccattcatttaccaatta

SEQ ID NO: 104288 - DNA, 695 bp, Homo sapiens
  Payload ID: 488
  Gene Symbol: ACAD11
  Gene Name: acyl-CoA dehydrogenase family, member 11
  ENST ID: ENST00000510100
  CDS Start-End: 1-468
ggactcagccacgtggactatgccttgattgctgaagaaacaggaaaatgcttttttgctccagatgtctttaactgccaagcaccagacacagggaatatggaggttctgcacctgtatggaagtgaggaacagaagaaacagtggcttgagcctcttcttcaagggaacattacctcttgcttctgtatgacagaacctgatgtagcttcaagtgatgccacgaatattgaatgcagcatccaacgagatgaagatagctatgtaattaacggcaaaaaatggtggagcagtggagctgggaatcccaagtgcaaaattgcaattgttttgggaagaactcaaaatacttctctctccagatcacagcctgcatcagactatgttggtgtacgtcttttacacagttcccattccagtcatcactgcttacatgactacatgaaaacatcaaaaagacaattgtgattctgcttattatctgttttatttttcttcttagcaaactttttctaatacaatttttcttttgactagacacaaacagcacagcatgattcttgttcccatgaacacacctggagtaaaaataataaggcctttgtcagtttttggctacacagataattttcatggaggacattttgagatccattttaatcaagtgcgagttcctgccacaaatctaatactag

SEQ ID NO: 104289 - DNA, 2249 bp, Homo sapiens
  Payload ID: 489
  Gene Symbol: ACAD8
  Gene Name: acyl-CoA dehydrogenase family, member 8
  Uniprot ID: Q9UKU7
  ENST ID: ENST00000281182
  CDS Start-End: 107-1354
agggtgcagtgggacaggcgttgccgggtcgcaggtcccgccagtgcgagcgcaacggaggtcgaaggcgttcagactcttagctgaacgcggagctgcggcggctatgctgtggagcggctgccggcgtttcggggcgcgcctcggctgcctgcccggcggtctccgggtcctcgtccagaccggccaccggagcttgacctcctgcatcgacccttccatgggacttaatgaagagcagaaagaatttcaaaaagtggcctttgactttgctgcccgagagatggctccaaatatggcagagtgggaccagaaggagctgttcccagtggatgtgatgcggaaggcagcccagctaggcttcggaggggtctacatacaaacagatgtgggcgggtctgggctgtcacgtcttgatacctctgtcatttttgaagccttggctacaggctgcaccagcaccacagcctatataagcatccacaacatgtgtgcctggatgattgatagcttcggaaatgaggaacagaggcacaaattttgcccaccgctctgtaccatggagaagtttgcttcctactgcctcactgaaccaggaagtgggagtgatgctgcctctcttctgacctccgctaagaaacagggagatcattacatcctcaatggctccaaggccttcatcagtggtgctggtgagtcagacatctatgtggtcatgtgccgaacaggaggaccaggccccaagggcatctcatgcatagttgttgagaaggggacccctggcctcagctttggcaagaaggagaaaaaggtggggtggaactcccagccaacacgagctgtgatcttcgaagactgtgctgtccctgtggccaacagaattgggagcgaggggcagggcttcctcattgccgtgagaggactgaacggagggaggatcaatattgcttcctgctccctgggggctgcccacgcctctgtcatcctcacccgagaccacctcaatgtccggaagcagtttggagagcctctggccagtaaccagtacttgcaattcacactggctgatatggcaacaaggctggtggccgcgcggctgatggtccgcaatgcagcagtggctctgcaggaggagaggaaggatgcagtggccttgtgctccatggccaagctctttgctacagatgaatgctttgccatctgcaaccaggccttgcagatgcacgggggctacggctacctgaaggattacgctgttcagcagtacgtgcgggactccagggtccaccagattctagaaggtagcaatgaagtgatgaggatactgatctctagaagcctgcttcaggagtagaacccacacttgttctggcctggtgttcagtgcgactgcagtcagtgttgagtggtgccatgtgggccgctctattccaaaggaatcatggattagacccaagggctgagctcctctagggcaggacctgcaccctgtgtgttggcaccagcatcgggtcttggactggggcagaatccccagtggaaccggaagagctggactgatgagaaacatcagaagaacacatactaccttgttttcctaatgccagaagggtgaccagtgaagattcaccgtcaaaccatgaaagtcctttcttggatccactttatcttgattagtctgcattttactagttcactggatccctcctctaggggcctggggactttcactgatgctcttcctgattctagagcaaaggtgtgggaaggggaaatggaggaatgccctcctgtctgtgtcgttctctgtgccacagctacagatgcagaaggtttctctggatagcacacctctgaatgtaaatcatgataaaatggatatttggaaacttactcctaagctgtgatttagggtgtatttctacttctggactgcctcaatatcaagggctgagacttttgaattttgaatattcgttgggtttcatgttaagaagcctgtggtctaggagtgctattcagtgtttcttttcctgataaacactttgaatattttttttgtgtttttgtttccttttctgaagctgttcctccttttaaatatttttaatcacattgataaaatctatccttcaccacctctggttctactatagttgatttttattttaaatgtttaattgtatttgattaaacacttaactggattttggaataataaaactctcgtccaatttggcttttaaaaa

SEQ ID NO: 104290 - DNA, 1797 bp, Homo sapiens
  Payload ID: 489
  Gene Symbol: ACAD8
  Gene Name: acyl-CoA dehydrogenase family, member 8
  Uniprot ID: Q9UKU7
  ENST ID: ENST00000374752
  CDS Start-End: 41-907
ggcgttcagactcttagctgaacgcggagctgcggcggctatgctgtggagcggctgccggcgtttcggggcgcgcctcggctgcctgcccggcggtctccgggtcctcgtccagaccggccaccggagcttgacctcctgcatcgaccgaagtgggagtgatgctgcctctcttctgacctccgctaagaaacagggagatcattacatcctcaatggctccaaggccttcatcagtggtgctggtgagtcagacatctatgtggtcatgtgccgaacaggaggaccaggccccaagggcatctcatgcatagttgttgagaaggggacccctggcctcagctttggcaagaaggagaaaaaggtggggtggaactcccagccaacacgagctgtgatcttcgaagactgtgctgtccctgtggccaacagaattgggagcgaggggcagggcttcctcattgccgtgagaggactgaacggagggaggatcaatattgcttcctgctccctgggggctgcccacgcctctgtcatcctcacccgagaccacctcaatgtccggaagcagtttggagagcctctggccagtaaccagtacttgcaattcacactggctgatatggcaacaaggctggtggccgcgcggctgatggtccgcaatgcagcagtggctctgcaggaggagaggaaggatgcagtggccttgtgctccatggccaagctctttgctacagatgaatgctttgccatctgcaaccaggccttgcagatgcacgggggctacggctacctgaaggattacgctgttcagcagtacgtgcgggactccagggtccaccagattctagaaggtagcaatgaagtgatgaggatactgatctctagaagcctgcttcaggagtagaacccacacttgttctggcctggtgttcagtgcgactgcagtcagtgttgagtggtgccatgtgggccgctctattccaaaggaatcatggattagacccaagggctgagctcctctagggcaggacctgcaccctgtgtgttggcaccagcatcgggtcttggactggggcagaatccccagtggaaccggaagagctggactgatgagaaacatcagaagaacacatactaccttgttttcctaatgccagaagggtgaccagtgaagattcaccgtcaaaccatgaaagtcctttcttggatccactttatcttgattagtctgcattttactagttcactggatccctcctctaggggcctggggactttcactgatgctcttcctgattctagagcaaaggtgtgggaaggggaaatggaggaatgccctcctgtctgtgtcgttctctgtgccacagctacagatgcagaaggtttctctggatagcacacctctgaatgtaaatcatgataaaatggatatttggaaacttactcctaagctgtgatttagggtgtatttctacttctggactgcctcaatatcaagggctgagacttttgaattttgaatattcgttgggtttcatgttaagaagcctgtggtctaggagtgctattcagtgtttcttttcctgataaacactttgaatattttttttgtgtttttgtttccttttctgaagctgttcctccttttaaatatttttaatcacattgataaaatctatccttcaccacctctggttctactatagttgatttttattttaaatgtttaattgtatttgattaaacacttaactggattttggaataataaaactctcgtccaatttggctttt

SEQ ID NO: 104291 - DNA, 1189 bp, Homo sapiens
  Payload ID: 489
  Gene Symbol: ACAD8
  Gene Name: acyl-CoA dehydrogenase family, member 8
  ENST ID: ENST00000524426
  CDS Start-End: 44-274
gaaggcgttcagactcttagctgaacgcggagctgcggcggctatgctgtggagcggctgccggcgtttcggggcgcgcctcggctgcctgcccggcggtctccgggtcctcgtccagaccggccaccggagcttgacctcctgcatcgacccttccatgggacttaatgaagagcagaaagaatttcaaaaagtggcctttgactttgctgcccgagagatggctccaaatatggcagagtgggaccagaagcatgtgtgcctggatgattgatagcttcggaaatgaggaacagaggcacaaattttgcccaccgctctgtaccatggagaagtttgcttcctactgcctcactgaaccaggaagtgggagtgatgctgcctctcttctgacctccgctaagaaacagggagatcattacatcctcaatggctccaaggccttcatcagtggtgctggtgagtcagacatctatgtggtcatgtgccgaacaggaggaccaggccccaagggcatctcatgcatagttgttgagaaggggacccctggcctcagctttggcaagaaggagaaaaaggtggggtggaactcccagccaacacgagctgtgatcttcgaagactgtgctgtccctgtggccaacagaattgggagcgaggggcagggcttcctcattgccgtgagaggactgaacggagggaggatcaatattgcttcctgctccctgggggctgcccacgcctctgtcatcctcacccgagaccacctcaatgtccggaagcagtttggagagcctctggccagtaaccagaaaaagcaagagactttgaagctttggatcacttagaaaaggcgcctccgagatgtcttaccgaggctcctgcaccaggtgctggtctaagcccctcagtcttgtctggttctctgctccctgtgctgcagtacttgcaattcacactggctgatatggcaacaaggctggtggccgcgcggctgatggtccgcaatgcagcagtggctctgcaggaggagaggaaggatgcagtggccttgtgctccatggccaagctctttgctacagatgaatgctttgccatctgcaaccaggccttgcagatgcacgggggctacggctacctgaaggattacgctgttcagcagtacgtgcgggactccagggtccaccag

SEQ ID NO: 104292 - DNA, 1336 bp, Homo sapiens
  Payload ID: 489
  Gene Symbol: ACAD8
  Gene Name: acyl-CoA dehydrogenase family, member 8
  ENST ID: ENST00000526026
  CDS Start-End: 54-263
aacggaggtcgaaggcgttcagactcttagctgaacgcggagctgcggcggctatgctgtggagcggctgccggcgtttcggggcgcgcctcggctgcctgcccggcggtctccgggtcctcgtccagaccggccaccggagcttgacctcctgcatcgaccgagctgttcccagtggatgtgatgcggaaggcagcccagctaggcttcggaggggtctacatacaaacagatgtgggcgggtctgggctgtcacgtcttgatacctctgtcatttttgaagccttggctacaggctgcaccagcaccacagcctatataagcatccacaacatgtgtgcctggatgattgatagcttcggaaatgaggaacagaggcacaaattttgcccaccgctctgtaccatggagaagtttgcttcctactgcctcactgaaccaggaagtgggagtgatgctgcctctcttctgacctccgctaagaaacagggagatcattacatcctcaatggctccaaggccttcatcagtggtgctggtgagtcagacatctatgtggtcatgtgccgaacaggaggaccaggccccaagggcatctcatgcatagttgttgagaaggggacccctggcctcagctttggcaagaaggagaaaaaggtggggtggaactcccagccaacacgagctgtgatcttcgaagactgtgctgtccctgtggccaacagaattgggagcgaggggcagggcttcctcattgccgtgagaggactgaacggagggaggatcaatattgcttcctgctccctgggggctgcccacgcctctgtcatcctcacccgagaccacctcaatgtccggaagcagtttggagagcctctggccagtaaccagtacttgcaattcacactggctgatatggcaacaaggctggtggccgcgcggctgatggtccgcaatgcagcagtggctctgcaggaggagaggaaggatgcagtggccttgtgctccatggccaagctctttgctacagatgaatgctttgccatctgcaaccaggccttgcagatgcacgggggctacggctacctgaaggattacgctgttcagcagtacgtgcgggactccagggtccaccagattctagaagagctgttctggcaggggcctggagtccagagccgcagcttcgtccctttcggggggcctcagatcgctctgctgctgcccttttcctctggagatctgcgagaagggtgaactgagataatggatgagaaagcatgttgaaaaccacagccggggcttttctctaaggttatcgagtacgtggttctca

SEQ ID NO: 104293 - DNA, 2454 bp, Homo sapiens
  Payload ID: 490
  Gene Symbol: ACAD9
  Gene Name: acyl-CoA dehydrogenase family, member 9
  Uniprot ID: Q9H845
  ENST ID: ENST00000308982
  CDS Start-End: 82-1947
agtaacgtcatcagacgtgtgtgtgtccctgcggcgctaagaaggggagactgaggctgaggctggggaacatcgggcagcatgagcggctgcgggctcttcctgcgcaccacggctgcggctcgtgcctgccggggtctggtggtctctaccgcgaaccggcggctactgcgcaccagcccgcctgtacgagctttcgccaaagagcttttcctaggcaaaatcaagaagaaagaagttttcccatttccagaagttagccaagatgaacttaatgaaatcaatcagttcttgggacccgtggaaaaattcttcactgaagaggtggactcccgaaaaattgaccaggaagggaaaatcccagatgaaactttggagaaattgaagagcctagggctttttgggctgcaagtcccagaagaatatggtggcctgggcttctccaacaccatgtactcaagactaggggagatcatcagcatggatgggtccatcactgtgaccctggcagcgcaccaggctattggcctcaaggggatcatcttggctggcactgaggagcagaaagccaaatacttgcctaaactggcgtccggggagcacattgcagccttctgcctcacggagccagccagtgggagcgatgcagcctcaatccggagcagagccacactaagtgaagacaagaagcactacatcctcaatggctccaaggtctggattactaatggaggactggccaatatttttactgtgtttgcaaagactgaggtcgttgattctgatggatcagtgaaagacaaaatcacagcattcatagtagaaagagactttggtggagtcactaatgggaaacccgaagataaattaggcattcggggctccaacacttgtgaagtccattttgaaaacaccaagatacctgtggaaaacatccttggagaggtcggagatgggtttaaggtggccatgaacatcctcaacagcggccggttcagcatgggcagcgtcgtggctgggctgctcaagagattgattgaaatgactgctgagtacgcctgcacaaggaaacagtttaacaagaggctcagtgaatttggattgattcaggagaaatttgcactgatggctcagaaggcttacgtcatggagagtatgacctacctcacagcagggatgctggaccaacctggctttcccgactgctccatcgaggcagccatggtgaaggtgttcagctccgaggccgcctggcagtgtgtgagtgaggcgctgcagatcctcgggggcttgggctacacaagggactatccgtacgagcgcatactgcgtgacacccgcatcctcctcatcttcgagggaaccaatgagattctccggatgtacatcgccctgacgggtctgcagcatgccggccgcatcctgactaccaggatccatgagcttaaacaggccaaagtgagcacagtcatggataccgttggccggaggcttcgggactccctgggccgaactgtggacctggggctgacaggcaaccatggagttgtgcaccccagtcttgcggacagtgccaacaagtttgaggagaacacctactgcttcggccggaccgtggagacactgctgctccgctttggcaagaccatcatggaggagcagctggtactgaagcgggtggccaacatcctcatcaacctgtatggcatgacggccgtgctgtcgcgggccagccgctccatccgcattgggctccgcaaccacgaccacgaggttctcttggccaacaccttctgcgtggaagcttacttgcagaatctcttcagcctctctcagctggacaagtatgctccagaaaacctagatgagcagattaagaaagtgtcccagcagatccttgagaagcgagcctatatctgtgcccaccctctggacaggacatgctgaggcaggggacagtgtcccctgctaccgcccgcccctacccatggcccgttgctggatgactgttactcttttttcagaaggtgttgggattatcacaggttaagccttttgttccccgtctgcacctgaagggttgtcgcctggcctgggagagcctcttccaggttttgacctgcaggcagtgctctctaacaggaccatcacagcttctgaactgagccggagagagagaatggaattgctgacccctggaactggcgggtattctggtcattgaggagacaccatagtggaaactggggcttatgctgctgcctccagggtgtgaggtgggtggggacctgtgtcaggtgtggatagccatttctgctcaaccacacattctctaagaaacagcttgaaagctctgtctgggtcattcatttaaactagaagcagaggcacttaaaacatgtaccaggaaccatttaacaaagaatataaaatgtcacaatctgtgtactgtta

SEQ ID NO: 104294 - DNA, 831 bp, Homo sapiens
  Payload ID: 490
  Gene Symbol: ACAD9
  Gene Name: acyl-CoA dehydrogenase family, member 9
  ENST ID: ENST00000514643
  CDS Start-End: 89-388
gcgggccagtaacgtcatcagacgtgtgtgtgtccctgcggcgctaagaaggggagactgaggctgaggctggggaacatcgggcagcatgagcggctgcgggctcttcctgcgcaccacggctgcggctcgtgcctgccggggtctggtggtctctaccgcgaaccggcggctactgcgcaccagcccgcctgtacgagctttcgccaaagagcttttcctaggcaaaatcaagaagaagttttcccatttccagaagttagccaagatgaacttaatgaaatcaatcagttcttgggacccgtggaaaaattcttcactgaagaggtggactcccgaaaaattgaccaggaagggaaaatcccagatgaaactttggagaaattgaagagcctagggctttttgggctgcaagtcccagaagaatatggtggcctgggcttctccaacaccatgtactcaagactaggggagatcatcagcatggatgggtccatcactgtgaccctggcagcgcaccaggctattggcctcaaggggatcatcttggctggcactgaggagcagaaagccaaatacttgcctaaactggcgtccggggagcacattgcagccttctgcctcacggagccagccagtgggagcgatgcagcctcaatccggagcagagccacactaagtgaagacaagaagcactacatcctcaatggctccaaggtctggattactaatggaggactggccaatatttttactgtgtttgcaaagactgaggtcgttgattctgatggatcagtgaaagacaaaatcacagcattcatagtagaaaga

SEQ ID NO: 104295 - DNA, 1872 bp, Homo sapiens
  Payload ID: 490
  Gene Symbol: ACAD9
  Gene Name: acyl-CoA dehydrogenase family, member 9
  ENST ID: ENST00000508971
  CDS Start-End: 1-1155
gtgaaagacaaaatcacagcattcatagtagaaagagactttggtggagtcactaatgggaaacccgaagataaattaggcattcggggctccaacacttgtgaagtccattttgaaaacaccaagatacctgtggaaaacatccttggagaggtcggagatgggtttaaggtggccatgaacatcctcaacagcggccggttcagcatgggcagcgtcgtggctgggctgctcaagagattgattgaaatgactgctgagtacgcctgcacaaggaaacagtttaacaagaggctcagtgaatttggattgattcaggagaaatttgcactgatggctcagaaggcttacgtcatggagagtatgacctacctcacagcagggatgctggaccaacctggctttcccgactgctccatcgaggcagccatggtgaaggtgttcagctccgaggccgcctggcagtgtgtgagtgaggcgctgcagatcctcgggggcttgggctacacaagggactatccgtacgagcgcatactgcgtgacacccgcatcctcctcatcttcgagggaaccaatgagattctccggatgtacatcgccctgacgggtctgcagcatgccggccgcatcctgactaccaggatccatgagcttaaacaggccaaagtgagcacagtcatggataccgttggccggaggcttcgggactccctgggccgaactgtggacctggggctgacaggcaaccatggagttgtgcaccccagtcttgcggacagtgccaacaagtttgaggagaacacctactgcttcggccggaccgtggagacactgctgctccgctttggcaagaccatcatggaggagcagctggtactgaagcgggtggccaacatcctcatcaacctgtatggcatgacggccgtgctgtcgcgggccagccgctccatccgcattgggctccgcaaccacgaccacgaggttctcttggccaacaccttctgcgtggaagcttacttgcagaatctcttcagcctctctcagctggacaagtatgctccagaaaacctagatgagcagattaagaaagtgtcccagcagatccttgagaagcgagcctatatctgtgcccaccctctggacaggacatgctgaggcaggggacagtgtcccctgctaccgcccgcccctacccatggcccgttgctggatgactgttactcttttttcagaaggtgttgggattatcacaggaccatcacagcttctgaactgagccggagagagagaatggaattgctgacccctggaactggcgggtattctggtcattgaggagacaccatagtggaaactggggcttatgctgctgcctccagggtgtgagggataaagaggaagaggacttggagggactggtacagcaagacctacgtttcctgtctctgccttaccccaaagaaagaactgtcagtatctttgccgctggaaggtcccagtgaagcccagagcctctgcccccagctcttggctggacacctagagatcagtcatggctctttgatgggtggcagcttgagatcctgaaagctgctttcggtgtcgctctgaagacctgtcacttggaatcccctggctgtgagccaggcctggcgggatttcttctgggctttcttctcctcttccttcaagtccaggggctccaccatggctgagaggtaatcctgtgtggaggattcacatttagtgtggaacagaacacctctcaacatctgagccttgtctacttcccctagctgattggctttcatctgtatagttgagatcccccactgacctccaggcaggcatggtcagaataaagaactcatg

SEQ ID NO: 104296 - DNA, 583 bp, Homo sapiens
  Payload ID: 490
  Gene Symbol: ACAD9
  Gene Name: acyl-CoA dehydrogenase family, member 9
  ENST ID: ENST00000514336
  CDS Start-End: 64-583
gtgtgtgtccctgcggcgctaagaaggggagactgaggctgaggctggggaacatcgggcagcatgagcggctgcgggctcttcctgcgcaccacggctgcggctcgtgcctgccggggtctggtggtctctaccgcgaaccggcggctactgcgcaccagcccgcctgtacgagctttcgccaaagagcttttcctaggcaaaatcaagaagaaagaagttttcccatttccagaagttagccaagatgaacttaatgaaatcaatcagttcttgggacccgtggaaaaattcttcactgaagaggcttatatttgtttaatcaagattttcctcttggcagtggactcccgaaaaattgaccaggaagggaaaatcccagatgaaactttggagaaattgaagagcctagggctttttgggctgcaagtcccagaagaatatggtggcctgggcttctccaacaccatgtactcaagactaggggagatcatcagcatggatgggtccatcactgtgaccctggcagcgcaccaggctattggcctcaaggggatcatcttggctggcactgaggagcaga

SEQ ID NO: 104297 - DNA, 2431 bp, Homo sapiens
  Payload ID: 490
  Gene Symbol: ACAD9
  Gene Name: acyl-CoA dehydrogenase family, member 9
  ENST ID: ENST00000511227
  CDS Start-End: 70-351
agacgtgtgtgtgtccctgcggcgctaagaaggggagactgaggctgaggctggggaacatcgggcagcatgagcggctgcgggctcttcctgcgcaccacggctgcggctcgtgcctgccggggtctggtggtctctaccgcgaaccggcggctactgcgcaccagcccgcctgtacgagctttcgccaaagagcttttcctaggcaaaatcaagaaggtaacgcgagccctgggcgaacccttgctgtctggctcccgcttttcaccctcagctgcaagactggtgttgaactttgtgagattccccaaacctgccagagagatacaccctgcggccgaggcgtgttaacactccggattcctgagttccaggaaaaccttcccagagaaaggaaagaagttttcccatttccagaagttagccaagatgaacttaatgaaatcaatcagttcttgggacccgtggaaaaattcttcactgaagaggtggactcccgaaaaattgaccaggaagggaaaatcccagatgaaactttggagaaattgaagagcctagggctttttgggctgcaagtcccagaagaatatggtggcctgggcttctccaacaccatgtactcaagactaggggagatcatcagcatggatgggtccatcactgtgaccctggcagcgcaccaggctattggcctcaaggggatcatcttggctggcactgaggagcagaaagccaaatacttgcctaaactggcgtccggggagcacattgcagccttctgcctcacggagccagccagtgggagcgatgcagcctcaatccggagcagagccacactaagtgaagacaagaagcactacatcctcaatggctccaaggtctggattactaatggaggactggccaatatttttactgtgtttgcaaagactgaggtcgttgattctgatggatcagtgaaagacaaaatcacagcattcatagtagaaagagactttggtggagtcactaatgggaaacccgaagataaattaggcattcggggctccaacacttgtgaagtccattttgaaaacaccaagatacctgtggaaaacatccttggagaggtcggagatgggtttaaggtggccatgaacatcctcaacagcggccggttcagcatgggcagcgtcgtggctgggctgctcaagagattgattgaaatgactgctgagtacgcctgcacaaggaaacagtttaacaagaggctcagtgaatttggattgattcaggagaaatttgcactgatggctcagaaggcttacgtcatggagagtatgacctacctcacagcagggatgctggaccaacctggctttcccgactgctccatcgaggcagccatggtgaaggtgttcagctccgaggccgcctggcagtgtgtgagtgaggcgctgcagatcctcgggggcttgggctacacaagggactatccgtacgagcgcatactgcgtgacacccgcatcctcctcatcttcgagggaaccaatgagattctccggatgtacatcgccctgacgggtctgcagcatgccggccgcatcctgactaccaggatccatgagcttaaacaggccaaagtgagcacagtcatggataccgttggccggaggcttcgggactccctgggccgaactgtggacctggggctgacaggcaaccatggagttgtgcaccccagtcttgcggacagtgccaacaagtttgaggagaacacctactgcttcggccggaccgtggagacactgctgctccgctttggcaagaccatcatggaggagcagctggtactgaagcgggtggccaacatcctcatcaacctgtatggcatgacggccgtgctgtcgcgggccagccgctccatccgcattgggctccgcaaccacgaccacgaggttctcttggccaacaccttctgcgtggaagcttacttgcagaatctcttcagcctctctcagctggacaagtatgctccagaaaacctagatgagcagattaagaaagtgtcccagcagatccttgagaagcgagcctatatctgtgcccaccctctggacaggacatgctgaggcaggggacagtgtcccctgctaccgcccgcccctacccatggcccgttgctggatgactgttactcttttttcagaaggtgttgggattatcacaggttaagccttttgttccccgtctgcacctgaagggttgtcgcctggcctgggagagcctcttccaggttttgacctgcaggcagtgctctctaacaggaccatcacagcttctgaactgagccggagagagagaatggaattgctgacccctggaactggcgggtattctggtcattgaggagacaccatagtggaaactggggcttatgctgctgcctcca

SEQ ID NO: 104298 - DNA, 2401 bp, Homo sapiens
  Payload ID: 490
  Gene Symbol: ACAD9
  Gene Name: acyl-CoA dehydrogenase family, member 9
  ENST ID: ENST00000505867
  CDS Start-End: 47-328
gctaagaaggggagactgaggctgaggctggggaacatcgggcagcatgagcggctgcgggctcttcctgcgcaccacggctgcggctcgtgcctgccggggtctggtggtctctaccgcgaaccggcggctactgcgcaccagcccgcctgtacgagctttcgccaaagagcttttcctaggcaaaatcaagaaggtaacgcgagccctgggcgaacccttgctgtctggctcccgcttttcaccctcagctgcaagactggtgttgaactttgtgagattccccaaacctgccagagagatacaccctgcggccgaggcgtgttaacactccggattcctgagttccaggaaaaccttcccagagaaaggtggactcccgaaaaattgaccaggaagggaaaatcccagatgaaactttggagaaattgaagagcctagggctttttgggctgcaagtcccagaagaatatggtggcctgggcttctccaacaccatgtactcaagactaggggagatcatcagcatggatgggtccatcactgtgaccctggcagcgcaccaggctattggcctcaaggggatcatcttggctggcactgaggagcagaaagccaaatacttgcctaaactggcgtccggggagcacattgcagccttctgcctcacggagccagccagtgggagcgatgcagcctcaatccggagcagagccacactaagtgaagacaagaagcactacatcctcaatggctccaaggtctggattactaatggaggactggccaatatttttactgtgtttgcaaagactgaggtcgttgattctgatggatcagtgaaagacaaaatcacagcattcatagtagaaagagactttggtggagtcactaatgggaaacccgaagataaattaggcattcggggctccaacacttgtgaagtccattttgaaaacaccaagatacctgtggaaaacatccttggagaggtcggagatgggtttaaggtggccatgaacatcctcaacagcggccggttcagcatgggcagcgtcgtggctgggctgctcaagagattgattgaaatgactgctgagtacgcctgcacaaggaaacagtttaacaagaggctcagtgaatttggattgattcaggagaaatttgcactgatggctcagaaggcttacgtcatggagagtatgacctacctcacagcagggatgctggaccaacctggctttcccgactgctccatcgaggcagccatggtgaaggtgttcagctccgaggccgcctggcagtgtgtgagtgaggcgctgcagatcctcgggggcttgggctacacaagggactatccgtacgagcgcatactgcgtgacacccgcatcctcctcatcttcgagggaaccaatgagattctccggatgtacatcgccctgacgggtctgcagcatgccggccgcatcctgactaccaggatccatgagcttaaacaggccaaagtgagcacagtcatggataccgttggccggaggcttcgggactccctgggccgaactgtggacctggggctgacaggcaaccatggagttgtgcaccccagtcttgcggacagtgccaacaagtttgaggagaacacctactgcttcggccggaccgtggagacactgctgctccgctttggcaagaccatcatggaggagcagctggtactgaagcgggtggccaacatcctcatcaacctgtatggcatgacggccgtgctgtcgcgggccagccgctccatccgcattgggctccgcaaccacgaccacgaggttctcttggccaacaccttctgcgtggaagcttacttgcagaatctcttcagcctctctcagctggacaagtatgctccagaaaacctagatgagcagattaagaaagtgtcccagcagatccttgagaagcgagcctatatctgtgcccaccctctggacaggacatgctgaggcaggggacagtgtcccctgctaccgcccgcccctacccatggcccgttgctggatgactgttactcttttttcagaaggtgttgggattatcacaggttaagccttttgttccccgtctgcacctgaagggttgtcgcctggcctgggagagcctcttccaggttttgacctgcaggcagtgctctctaacaggaccatcacagcttctgaactgagccggagagagagaatggaattgctgacccctggaactggcgggtattctggtcattgaggagacaccatagtggaaactggggcttatgctgctgcctccagggtgtgaggtgggtggggacctgtgtcaggtgtggatagccatttctgctcaaccacacattctctaagaaacagcttgaaagctc

SEQ ID NO: 104299 - DNA, 546 bp, Homo sapiens
  Payload ID: 490
  Gene Symbol: ACAD9
  Gene Name: acyl-CoA dehydrogenase family, member 9
  ENST ID: ENST00000515429
  CDS Start-End: 64-345
gtgtgtgtccctgcggcgctaagaaggggagactgaggctgaggctggggaacatcgggcagcatgagcggctgcgggctcttcctgcgcaccacggctgcggctcgtgcctgccggggtctggtggtctctaccgcgaaccggcggctactgcgcaccagcccgcctgtacgagctttcgccaaagagcttttcctaggcaaaatcaagaaggtaacgcgagccctgggcgaacccttgctgtctggctcccgcttttcaccctcagctgcaagactggtgttgaactttgtgagattccccaaacctgccagagagatacaccctgcggccgaggcgtgttaacactccggattcctgagttccaggaaaaccttcccagagaaaggaaagaagttttcccatttccagaagttagccaagatgaacttaatgaaatcaatcagttcttgggacccgtggaaaaattcttcactgaagaggattttcctcttggcagtggactcccgaaaaattgaccaggaagggaaaatcccagatgaaact

SEQ ID NO: 104300 - DNA, 1693 bp, Homo sapiens
  Payload ID: 490
  Gene Symbol: ACAD9
  Gene Name: acyl-CoA dehydrogenase family, member 9
  ENST ID: ENST00000505192
  CDS Start-End: 70-279
agacgtgtgtgtgtccctgcggcgctaagaaggggagactgaggctgaggctggggaacatcgggcagcatgagcggctgcgggctcttcctgcgcaccacggctgcggctcgtgcctgccggggtctggtggtctctaccgcgaaccggcggctactgcgcaccagcccgcctgtacgagctttcgccaaagagcttttcctaggcaaaatcaagaagtggactcccgaaaaattgaccaggaagggaaaatcccagatgaaactttggagaaattgaagagcctagggctttttgggctgcaagtcccagaagaatatggtggcctgggcttctccaacaccatgtactcaagactaggggagatcatcagcatggatgggtccatcactgtgaccctggcagcgcaccaggctattggcctcaaggggatcatcttggctggcactgaggagcagaaagccaaatacttgcctaaactggcgtccggggagcacattgcagccttctgcctcacggagccagccagtgggagcgatgcagcctcaatccggagcagagccacactaagtgaagacaagaagcactacatcctcaatggctccaaggtctggattactaatggaggactggccaatatttttactgtgtttgcaaagactgaggtcgttgattctgatggatcagtgaaagacaaaatcacagcattcatagtagaaagagactttggtggagtcactaatgggaaacccgaagataaattaggcattcggggctccaacacttgtgaagtccattttgaaaacaccaagatacctgtggaaaacatccttggagaggtcggagatgggtttaaggtggccatgaacatcctcaacagcggccggttcagcatgggcagcgtcgtggctgggctgctcaagagattgattgaaatgactgctgagtacgcctgcacaaggaaacagtttaacaagaggctcagtgaatttggattgattcaggagaaatttgcactgatggctcagaaggcttacgtcatggagagtatgacctacctcacagcagggatgctggaccaacctggctttcccgactgctccatcgaggcagccatggtgaaggtgttcagctccgaggccgcctggcagtgtgtgagtgaggcgctgcagatcctcgggggcttgggctacacaagggactatccgtacgagcgcatactgcgtgacacccgcatcctcctcatcttcgagggaaccaatgagattctccggatgtacatcgccctgacgggtctgcagcatgccggccgcatcctgactaccaggatccagtaggtgccattgtcaccgtgtgcttctcaggtcccatacctgcccagcaggggccagtccagggcagtgggaggaaagagctgccttgacctggagtgggggcatgggggtgtggcgcagccttgtggaggggaccttcccctgtggtagtggggggcttgctgcccagggaagccctcgctgccctgcccttatggccacagcaccctacagcttcagcataaataccgtatcccccatctggtccctcacactagaggcagctggtttttcagaacctgaagaatgagaggtgtccctttaaaggtgccaggcctcacagccaacataagccagtgtttctcttctctgcccttctt

SEQ ID NO: 104301 - DNA, 736 bp, Homo sapiens
  Payload ID: 490
  Gene Symbol: ACAD9
  Gene Name: acyl-CoA dehydrogenase family, member 9
  ENST ID: ENST00000512801
  CDS Start-End: 73-354
atcagacgtgtgtgtgtccctgcggcgctaagaaggggagactgaggctgaggctggggaacatcgggcagcatgagcggctgcgggctcttcctgcgcaccacggctgcggctcgtgcctgccggggtctggtggtctctaccgcgaaccggcggctactgcgcaccagcccgcctgtacgagctttcgccaaagagcttttcctaggcaaaatcaagaagaagttagccaagatgaacttaatgaaatcaatcagttcttgggacccgtggaaaaattcttcactgaagaggtggactcccgaaaaattgaccaggaagggaaaatcccagatgaaactttggagaaattgaagagcctagggctttttgggctgcaagtcccagaagaatatggtggcctgggcttctccaacaccatgtactcaagactaggggagatcatcagcatggatgggtccatcactgtgaccctggcagcgcaccaggctattggcctcaaggggatcatcttggctggcactgaggagcagaaagccaaatacttgcctaaactggcgtccggggagcacattgcagccttctgcctcacggagccagccagtgggagcgatgcagcctcaatccggagcagagccacactaagtgaagacaagaagcactacatcctcaatggctccaaggtctggattactaatggaggactggccaatatttttactgtgtttgcaaagac

SEQ ID NO: 104302 - DNA, 507 bp, Homo sapiens
  Payload ID: 490
  Gene Symbol: ACAD9
  Gene Name: acyl-CoA dehydrogenase family, member 9
  ENST ID: ENST00000620948
  CDS Start-End: 1-507
atggaggagcagctggtactgaagggtggccaacatcctcatcaacctgtatggcatgacggccgtgctgtcgcgggccagccgctccatccgcattgggctccgcaaccacgaccacgaggttctcttggccaacaccttctgcgtggaagcttacttgcagaatctcttcagcctctctcagctggacaagtatgctccagaaaacctagaagcagattaagaaagtgtcccagcagatccttgagaagcgagcctatatctgtgcccaccctctggacaggacatgctgagaggggacagtgtcccctgctaccgcccgcccctacccatggcccgttgctggatgactgttactcttttttcagaaggttgggattatcacaggttaagccttttgttccccgtctgcacctgaagggttgtcgcctggcctgggagagcctcttccaggttttgacctgcaggcagtgctctctaacaggaccatcacagcttctgaactga

SEQ ID NO: 104303 - DNA, 1950 bp, Homo sapiens
  Payload ID: 491
  Gene Symbol: ACADS
  Gene Name: acyl-CoA dehydrogenase, C-2 to C-3 short chain
  Uniprot ID: P16219
  ENST ID: ENST00000242592
  CDS Start-End: 152-1390
tggaggccccgccccctggccgcgagcgcacctcggccccgctcccgaggccctacgggcgtggcctctgtcccgggtcccgccccccagcactccggaacagcgcgctcgcagcgggaggtcgcgaagcctgggactgtgtctgtcgcccatggccgccgcgctgctcgcccgggcctcgggccctgcccgcagagctctctgtcctagggcctggcggcagttacacaccatctaccagtctgtggaactgcccgagacacaccagatgttgctccagacatgccgggactttgccgagaaggagttgtttcccattgcagcccaggtggataaggaacatctcttcccagcggctcaggtgaagaagatgggcgggcttgggcttctggccatggacgtgcccgaggagcttggcggtgctggcctcgattacctggcctacgccatcgccatggaggagatcagccgtggctgcgcctccaccggagtcatcatgagtgtcaacaactctctctacctggggcccatcttgaagtttggctccaaggagcagaagcaggcgtgggtcacgcctttcaccagtggtgacaaaattggctgctttgccctcagcgaaccagggaacggcagtgatgcaggagctgcgtccaccaccgcccgggccgagggcgactcatgggttctgaatggaaccaaagcctggatcaccaatgcctgggaggcttcggctgccgtggtctttgccagcacggacagagccctgcaaaacaagggcatcagtgccttcctggtccccatgccaacgcctgggctcacgttggggaagaaagaagacaagctgggcatccggggctcatccacggccaacctcatctttgaggactgtcgcatccccaaggacagcatcctgggggagccagggatgggcttcaagatagccatgcaaaccctggacatgggccgcatcggcatcgcctcccaggccctgggcattgcccagaccgccctcgattgtgctgtgaactacgctgagaatcgcatggccttcggggcgcccctcaccaagctccaggtcatccagttcaagttggcagacatggccctggccctggagagtgcccggctgctgacctggcgcgctgccatgctgaaggataacaagaagcctttcatcaaggaggcagccatggccaagctggccgcctcggaggccgcgaccgccatcagccaccaggccatccagatcctgggcggcatgggctacgtgacagagatgccggcagagcggcactaccgcgacgcccgcatcactgagatctacgagggcaccagcgaaatccagcggctggtgatcgccgggcatctgctcaggagctaccggagctgagcccgcggcggactgccccaggactgcgggaaggcgcgggagccaggggcctccaccccaaccccggctcagagactgggcggcccggcgggggctccctggggaccccagatgggctcagtgctgccacccagatcagatcacatgggaatgaggccctccgaccattggcagctccgcctctgggcctttccgcctcctcaccactgtgcctcaagttcctcatctaagtggccctggcctcctgggggcggggttgtgggggggctgagcgacactcagggacacctcagttgtcctcccgcgggccctggtgccctggcatgaaggcccagtgcgacaggcccttggtggggtctgtcttttccttgaggtcagaggtcaggagcagggctggggtcaggatgacgaggcctggggtcctggtgttgggcaggtggtggggctgggccatggagctggcccagaggcccctcagccctttgtaaagtctgatgaaggcaggggtggtgattcatgctgtgtgactgactgtgggtaataaacacacctgtccccca

SEQ ID NO: 104304 - DNA, 1398 bp, Homo sapiens
  Payload ID: 491
  Gene Symbol: ACADS
  Gene Name: acyl-CoA dehydrogenase, C-2 to C-3 short chain
  ENST ID: ENST00000411593
  CDS Start-End: 26-1252
aagcctgggactgtgtctgtcgcccatggccgccgcgctgctcgcccgggcctcgggccctgcccgcagagctctctgtcctagggcctggcggcagttacacaccatctaccagtctgtggaactgcccgagacacaccagatgttgctccagacatgccgggactttgccgagaaggagttgtttcccattgcagcccaggtggataaggaacatctcttcccagcggctcaggtgaagaagatgggcgggcttgggcttctggccatggacgtgcccgaggagcttggcggtgctggcctcgattacctggcctacgccatcgccatggaggagatcagccgtggctgcgcctccaccggagtcatcatgagtgtcaacaactctctctacctggggcccatcttgaagtttggctccaaggagcagaagcaggcgtgggtcacgcctttcaccagtggtgacaaaattggctgctttgccctcagcgaaccagggccttctctccttggcccgactggacctatttttgctctggggcaagtgggctgtccctgtccctcctcagctgccactgaagcctgcaccttccccagaagccggcagagggtgtcaaggcctgagcttctgagggagggcatcagtgccttcctggtccccatgccaacgcctgggctcacgttggggaagaaagaagacaagctgggcatccggggctcatccacggccaacctcatctttgaggactgtcgcatccccaaggacagcatcctgggggagccagggatgggcttcaagatagccatgcaaaccctggacatgggccgcatcggcatcgcctcccaggccctgggcattgcccagaccgccctcgattgtgctgtgaactacgctgagaatcgcatggccttcggggcgcccctcaccaagctccaggtcatccagttcaagttggcagacatggccctggccctggagagtgcccggctgctgacctggcgcgctgccatgctgaaggataacaagaagcctttcatcaaggaggcagccatggccaagctggccgcctcggaggccgcgaccgccatcagccaccaggccatccagatcctgggcggcatgggctacgtgacagagatgccggcagagcggcactaccgcgacgcccgcatcactgagatctacgagggcaccagcgaaatccagcggctggtgatcgccgggcatctgctcaggagctaccggagctgagcccgcggcggactgccccaggactgcgggaaggcgcgggagccaggggcctccaccccaaccccggctcagagactgggcggcccggcgggggctccctggggaccccagatgggctcagtgctgccacccagatcagatcacat

SEQ ID NO: 104305 - DNA, 2172 bp, Homo sapiens
  Payload ID: 492
  Gene Symbol: ACADM
  Gene Name: acyl-CoA dehydrogenase, C-4 to C-12 straight chain
  ENST ID: ENST00000370834
  CDS Start-End: 80-1444
agaggagtcccgcgttcggggagtatgtcaaggccgtgacccgtgtattattgtccgagtggccggaacgggagccaacatggcagcggggttcgggcgatgctgcagggtcctgagaagtatttctcgttttcattggagatcacagcatacaaaagccaatcgacaacgtgaaccaggattaggatttagttttgagttcaccgaacagcagaaagaatttcaagctactgctcgtaaatttgccagagaggaaatcatcccagtggctgcagaatatgataaaactggtgaatatccagtccccctaattagaagagcctgggaacttggtttaatgaacacacacattccagagaactgtgactacagtgtttgcccacttttggaagcttgcactctatacctagatgcgtttttccttcttctaactggttccaaccttaacttgcacctaaaccttggaggtcttggacttggaacttttgatgcttgtttaattagtgaagaattggcttatggatgtacaggggttcagactgctattgaaggaaattctttggggcaaatgcctattattattgctggaaatgatcaacaaaagaagaagtatttggggagaatgactgaggagccattgatgtgtgcttattgtgtaacagaacctggagcaggctctgatgtagctggtataaagaccaaagcagaaaagaaaggagatgagtatattattaatggtcagaagatgtggataaccaacggaggaaaagctaattggtattttttattggcacgttctgatccagatcctaaagctcctgctaataaagcctttactggattcattgtggaagcagataccccaggaattcagattgggagaaaggaattaaacatgggccagcgatgttcagatactagaggaattgtcttcgaagatgtgaaagtgcctaaagaaaatgttttaattggtgacggagctggtttcaaagttgcaatgggagcttttgataaaaccagacctgtagtagctgctggtgctgttggattagcacaaagagctttggatgaagctaccaagtatgccctggaaaggaaaactttcggaaagctacttgtagagcaccaagcaatatcatttatgctggctgaaatggcaatgaaagttgaactagctagaatgagttaccagagagcagcttgggaggttgattctggtcgtcgaaatacctattatgcttctattgcaaaggcatttgctggagatattgcaaatcagttagctactgatgctgtgcagatacttggaggcaatggatttaatacagaatatcctgtagaaaaactaatgagggatgccaaaatctatcagatttatgaaggtacttcacaaattcaaagacttattgtagcccgtgaacacattgacaagtacaaaaattaaaaaaattactgtagaaatattgaataactagaacacaagccactgtttcagctccagaaaaaagaaagggctttaacgttttttccagtgaaaacaaatcctcttatattaaatctaagcaactgcttattatagtagtttatacttttgcttaactctgttatgtctcttaagcaggtttggtttttattaaaatgatgtgttttctttagtaccactttacttgaattacattaacctagaaaactacataggttattttgatctcttaagattaatgtagcagaaatttcttggaattttatttttgtaatgacagaaaagtgggcttagaaagtattcaagatgttacaaaatttacatttagaaaatattgtagtatttgaatactgtcaacttgacagtaactttgtagacttaatggtattattaaagttctttttattgcagtttggaaagcatttgtgaaactttctgtttggcacagaaacagtcaaaattttgacattcatattctcctattttacagctacaagaactttcttgaaaatcttatttaattctgagcccatatttcacttaccttatttaaaataaatcaataaagcttgccttaaattatttttatatgactgttggtctctaggtagcctttggtctattgtacacaatctcatttcatatgtttgcattttggcaaagaacttaataaaattgttcagtgctta

SEQ ID NO: 104306 - DNA, 2619 bp, Homo sapiens
  Payload ID: 492
  Gene Symbol: ACADM
  Gene Name: acyl-CoA dehydrogenase, C-4 to C-12 straight chain
  Uniprot ID: P11310
  ENST ID: ENST00000370841
  CDS Start-End: 438-1703
accgcgccgcaagtccccccaccgttcagcgcaaccgggccctcccagccccgccgccgtccccctcccccgccctggctctctttccgcgctgcggtcagcctcggcgtcccacagagagggccagaggtggaaacgcagaaaaccaaaccaggactatcagagattgcccggagaggggatgcgacccctccccaggtcgcagcgacggcgcacgcaagggtcacggagcatgcgttggctacccggcgccggggaccgctgccaccccgcctagcgcagcgccccgtccttccgcagcccaaccgcctcttcccgccccgccccatcccgcccacgggctccagtgggcgggaccagaggagtcccgcgttcggggagtatgtcaaggccgtgacccgtgtattattgtccgagtggccggaacgggagccaacatggcagcggggttcgggcgatgctgcagggtcctgagaagtatttctcgttttcattggagatcacagcatacaaaagccaatcgacaacgtgaaccaggattaggatttagttttgagttcaccgaacagcagaaagaatttcaagctactgctcgtaaatttgccagagaggaaatcatcccagtggctgcagaatatgataaaactggtgaatatccagtccccctaattagaagagcctgggaacttggtttaatgaacacacacattccagagaactgtggaggtcttggacttggaacttttgatgcttgtttaattagtgaagaattggcttatggatgtacaggggttcagactgctattgaaggaaattctttggggcaaatgcctattattattgctggaaatgatcaacaaaagaagaagtatttggggagaatgactgaggagccattgatgtgtgcttattgtgtaacagaacctggagcaggctctgatgtagctggtataaagaccaaagcagaaaagaaaggagatgagtatattattaatggtcagaagatgtggataaccaacggaggaaaagctaattggtattttttattggcacgttctgatccagatcctaaagctcctgctaataaagcctttactggattcattgtggaagcagataccccaggaattcagattgggagaaaggaattaaacatgggccagcgatgttcagatactagaggaattgtcttcgaagatgtgaaagtgcctaaagaaaatgttttaattggtgacggagctggtttcaaagttgcaatgggagcttttgataaaaccagacctgtagtagctgctggtgctgttggattagcacaaagagctttggatgaagctaccaagtatgccctggaaaggaaaactttcggaaagctacttgtagagcaccaagcaatatcatttatgctggctgaaatggcaatgaaagttgaactagctagaatgagttaccagagagcagcttgggaggttgattctggtcgtcgaaatacctattatgcttctattgcaaaggcatttgctggagatattgcaaatcagttagctactgatgctgtgcagatacttggaggcaatggatttaatacagaatatcctgtagaaaaactaatgagggatgccaaaatctatcagatttatgaaggtacttcacaaattcaaagacttattgtagcccgtgaacacattgacaagtacaaaaattaaaaaaattactgtagaaatattgaataactagaacacaagccactgtttcagctccagaaaaaagaaagggctttaacgttttttccagtgaaaacaaatcctcttatattaaatctaagcaactgcttattatagtagtttatacttttgcttaactctgttatgtctcttaagcaggtttggtttttattaaaatgatgtgttttctttagtaccactttacttgaattacattaacctagaaaactacataggttattttgatctcttaagattaatgtagcagaaatttcttggaattttatttttgtaatgacagaaaagtgggcttagaaagtattcaagatgttacaaaatttacatttagaaaatattgtagtatttgaatactgtcaacttgacagtaactttgtagacttaatggtattattaaagttctttttattgcagtttggaaagcatttgtgaaactttctgtttggcacagaaacagtcaaaattttgacattcatattctcctattttacagctacaagaactttcttgaaaatcttatttaattctgagcccatatttcacttaccttatttaaaataaatcaataaagcttgccttaaattatttttatatgactgttggtctctaggtagcctttggtctattgtacacaatctcatttcatatgtttgcattttggcaaagaacttaataaaattgttcagtgcttattatcatatctttctgtattttttccaggaaatttcattacttcgtgtaatagtgtatatttcttgtatttactatgatgaaaaaaggtcgttttaattttgaattgaataaagttacctgttcattttttattagatattttaaagacttcagaaaatataaatatgaaataatttaagaacccaaa

SEQ ID NO: 104307 - DNA, 1332 bp, Homo sapiens
  Payload ID: 492
  Gene Symbol: ACADM
  Gene Name: acyl-CoA dehydrogenase, C-4 to C-12 straight chain
  Uniprot ID: P11310
  ENST ID: ENST00000420607
  CDS Start-End: 9-1286
gagccaacatggcagcggggttcgggcgatgctgcaggtgttctttacaggtcctgagaagtatttctcgttttcattggagatcacagcatacaaaagccaatcgacaacgtgaaccaggattaggatttagttttgagttcaccgaacagcagaaagaatttcaagctactgctcgtaaatttgccagagaggaaatcatcccagtggctgcagaatatgataaaactggtgaatatccagtccccctaattagaagagcctgggaacttggtttaatgaacacacacattccagagaactgtggaggtcttggacttggaacttttgatgcttgtttaattagtgaagaattggcttatggatgtacaggggttcagactgctattgaaggaaattctttggggcaaatgcctattattattgctggaaatgatcaacaaaagaagaagtatttggggagaatgactgaggagccattgatgtgtgcttattgtgtaacagaacctggagcaggctctgatgtagctggtataaagaccaaagcagaaaagaaaggagatgagtatattattaatggtcagaagatgtggataaccaacggaggaaaagctaattggtattttttattggcacgttctgatccagatcctaaagctcctgctaataaagcctttactggattcattgtggaagcagataccccaggaattcagattgggagaaaggaattaaacatgggccagcgatgttcagatactagaggaattgtcttcgaagatgtgaaagtgcctaaagaaaatgttttaattggtgacggagctggtttcaaagttgcaatgggagcttttgataaaaccagacctgtagtagctgctggtgctgttggattagcacaaagagctttggatgaagctaccaagtatgccctggaaaggaaaactttcggaaagctacttgtagagcaccaagcaatatcatttatgctggctgaaatggcaatgaaagttgaactagctagaatgagttaccagagagcagcttgggaggttgattctggtcgtcgaaatacctattatgcttctattgcaaaggcatttgctggagatattgcaaatcagttagctactgatgctgtgcagatacttggaggcaatggatttaatacagaatatcctgtagaaaaactaatgagggatgccaaaatctatcagatttatgaaggtacttcacaaattcaaagacttattgtagcccgtgaacacattgacaagtacaaaaattaaaaaaattactgtagaaatattgaataactagaacacaagccactgt

SEQ ID NO: 104308 - DNA, 508 bp, Homo sapiens
  Payload ID: 492
  Gene Symbol: ACADM
  Gene Name: acyl-CoA dehydrogenase, C-4 to C-12 straight chain
  ENST ID: ENST00000530953
  CDS Start-End: 28-180
gtccgagtggccggaacgggagccaacatggcagcggggttcgggcgatgctgcagggtcctgagaagtatttctcgttttcattggagatcacagcatacaaaagccaatcgacaacgtgaaccaggattaggatttagttttggcttattgtgtaacagaacctggagcaggctctgatgtagctggtataaagaccaaagcagaaaagaaaggagatgagtatattattaatggtcagaagatgtggataaccaacggaggaaaagctaattggtattttttattggcacgttctgatccagatcctaaagctcctgctaataaagcctttactggattcattgtggaagcagataccccaggaattcagattgggagaaaggaattaaacatgggccagcgatgttcagatactagaggaattgtcttcgaagatgtgaaagtgcctaaagaaaatgttttaattggtgacggagctggtttcaaagttgcaatgggagctttt

SEQ ID NO: 104309 - DNA, 1451 bp, Homo sapiens
  Payload ID: 492
  Gene Symbol: ACADM
  Gene Name: acyl-CoA dehydrogenase, C-4 to C-12 straight chain
  ENST ID: ENST00000526196
  CDS Start-End: 83-226
accagaggagtcccgcgttcggggagtatgtcaaggccgtgacccgtgtattattgtccgagtggccggaacgggagccaacatggcagcggggttcgggcgatgctgcaggagttcaccgaacagcagaaagaatttcaagctactgctcgtaaatttgccagagaggaaatcatcccagtggctgcagaatatgataaaactggtgaatatccagtccccctaattagaagagcctgggaacttggtttaatgaacacacacattccagagaactgtggaggtcttggacttggaacttttgatgcttgtttaattagtgaagaattggcttatggatgtacaggggttcagactgctattgaaggaaattctttggggcaaatgcctattattattgctggaaatgatcaacaaaagaagaagtatttggggagaatgactgaggagccattgatgtgtgcttattgtgtaacagaacctggagcaggctctgatgtagctggtataaagaccaaagcagaaaagaaaggagatgagtatattattaatggtcagaagatgtggataaccaacggaggaaaagctaattggtattttttattggcacgttctgatccagatcctaaagctcctgctaataaagcctttactggattcattgtggaagcagataccccaggaattcagattgggagaaaggaattaaacatgggccagcgatgttcagatactagaggaattgtcttcgaagatgtgaaagtgcctaaagaaaatgttttaattggtgacggagctggtttcaaagttgcaatgggagcttttgataaaaccagacctgtagtagctgctggtgctgttggattagcacaaagagctttggatgaagctaccaagtatgccctggaaaggaaaactttcggaaagctacttgtagagcaccaagcaatatcatttatgctggctgaaatggcaatgaaagttgaactagctagaatgagttaccagagagcagcttgggaggttgattctggtcgtcgaaatacctattatgcttctattgcaaaggcatttgctggagatattgcaaatcagttagctactgatgctgtgcagatacttggaggcaatggatttaatacagaatatcctgtagaaaaactaatgagggatgccaaaatctatcagatttatgaaggtacttcacaaattcaaagacttattgtagcccgtgaacacattgacaagtacaaaaattaaaaaaattactgtagaaatattgaataactagaacacaagccactgtttcagctccagaaaaaagaaagggctttaacgttttttccagtgaaaacaaatcctcttatattaaatctaagcaactgcttattatagtagtttatacttttgcttaactctgttatgtctcttaagcaggtttggtttttatt

SEQ ID NO: 104310 - DNA, 825 bp, Homo sapiens
  Payload ID: 492
  Gene Symbol: ACADM
  Gene Name: acyl-CoA dehydrogenase, C-4 to C-12 straight chain
  ENST ID: ENST00000532509
  CDS Start-End: 80-217
agaggagtcccgcgttcggggagtatgtcaaggccgtgacccgtgtattattgtccgagtggccggaacgggagccaacatggcagcggggttcgggcgatgctgcagggtcctgagaagtatttctcgttttcattggagatcacagcatacaaaagccaatcgacaacgtgaaccaggattaggatttagttttgtatccagtccccctaattagaagagcctgggaacttggtttaatgaacacacacattccagagaactgtggaggtcttggacttggaacttttgatgcttgtttaattagtgaagaattggcttatggatgtacaggggttcagactgctattgaaggaaattctttggggcaaatgcctattattattgctggaaatgatcaacaaaagaagaagtatttggggagaatgactgaggagccattgatgtgtgcttattgtgtaacagaacctggagcaggctctgatgtagctggtataaagaccaaagcagaaaagaaaggagatgagtatattattaatggtcagaagatgtggataaccaacggaggaaaagctaattggtattttttattggcacgttctgatccagatcctaaagctcctgctaataaagcctttactggattcattgtggaagcagataccccaggaattcagattgggagaaaggaattaaacatgggccagcgatgttcagatactagaggaattgtcttcgaagatgtgaaagtgcctaaagaaaatgttttaattggtgacggagctggtttcaaagttgcaatgggagcttttgataaaaccagac

SEQ ID NO: 104311 - DNA, 1536 bp, Homo sapiens
  Payload ID: 492
  Gene Symbol: ACADM
  Gene Name: acyl-CoA dehydrogenase, C-4 to C-12 straight chain
  ENST ID: ENST00000526129
  CDS Start-End: 83-313
accagaggagtcccgcgttcggggagtatgtcaaggccgtgacccgtgtattattgtccgagtggccggaacgggagccaacatggcagcggggttcgggcgatgctgcagggtcctgagaagtatttctcgttttcattggagatcacagcatacaaaagccaatcgacaacgtgaaccaggattaggatttagttttgagttcaccgaacagcagaaagaatttcaagctactgctcgtaaatttgccagagaggaaatcatcccagtggctgcagaatatgataaaactggtgaattctttttcttctagtatccagtccccctaattagaagagcctgggaacttggtttaatgaacacacacattccagagaactgtggaggtcttggacttggaacttttgatgcttgtttaattagtgaagaattggcttatggatgtacaggggttcagactgctattgaaggaaattctttggggcaaatgcctattattattgctggaaatgatcaacaaaagaagaagtatttggggagaatgactgaggagccattgatgtgtgcttattgtgtaacagaacctggagcaggctctgatgtagctggtataaagaccaaagcagaaaagaaaggagatgagtatattattaatggtcagaagatgtggataaccaacggaggaaaagctaattggtattttttattggcacgttctgatccagatcctaaagctcctgctaataaagcctttactggattcattgtggaagcagataccccaggaattcagattgggagaaaggaattaaacatgggccagcgatgttcagatactagaggaattgtcttcgaagatgtgaaagtgcctaaagaaaatgttttaattggtgacggagctggtttcaaagttgcaatgggagcttttgataaaaccagacctgtagtagctgctggtgctgttggattagcacaaagagctttggatgaagctaccaagtatgccctggaaaggaaaactttcggaaagctacttgtagagcaccaagcaatatcatttatgctggctgaaatggcaatgaaagttgaactagctagaatgagttaccagagagcagcttgggaggttgattctggtcgtcgaaatacctattatgcttctattgcaaaggcatttgctggagatattgcaaatcagttagctactgatgctgtgcagatacttggaggcaatggatttaatacagaatatcctgtagaaaaactaatgagggatgccaaaatctatcaggtaaggttaaagatgatttttttggtttgcaaggagagagaatattcataaatgacaacgtggatttctgattatttagaaattttatgtccctagtagcaataaatgactgtcatatatggctgtgagccagtttttggaattaattaatagaaagaagaatgttatttgtgattaagtataagtctgaagagagaataggctaaaaaaaatggtacagacatgtgtattacgtttggattaga

SEQ ID NO: 104312 - DNA, 546 bp, Homo sapiens
  Payload ID: 492
  Gene Symbol: ACADM
  Gene Name: acyl-CoA dehydrogenase, C-4 to C-12 straight chain
  ENST ID: ENST00000528016
  CDS Start-End: 1-204
ttaattggtgacggagctggtttcaaagttgcaatgggagcttttgataaaaccagacctgtagtagctgctggtgctgttggattagcacaaagagctttggatgaagctaccaagtatgccctggaaaggaaaactttcggaaagctacttgtagaggtcttgtttccccttcaccttccaacatcattgaaagtctcctgaggcctccccagccgtggaactacaaatcggagtgactatgggacaagcatatggtcgcaggactttggacgcaggcagtgaggacacctatgagcgatcagtggggtcctacggcagccgtggaactgctctgccttgcaggcgaaagtgtggtcagctatatcggagcgcgatgggggcctgagaggcgcatctgcgcaggcgcccggctcctaagtctacccaggaactgaccctgctctctcctttccctgttagacatgggcactccacagaaggatgttattatcaagtcagatgcaccggacactttgttattggagaaacatgcagattatatcg

SEQ ID NO: 104313 - DNA, 1422 bp, Homo sapiens
  Payload ID: 492
  Gene Symbol: ACADM
  Gene Name: acyl-CoA dehydrogenase, C-4 to C-12 straight chain
  ENST ID: ENST00000525808
  CDS Start-End: 22-165
gtggccggaacgggagccaacatggcagcggggttcgggcgatgctgcaggagttcaccgaacagcagaaagaatttcaagctactgctcgtaaatttgccagagaggaaatcatcccagtggctgcagaatatgataaaactggtgaatatccagtccccctaattagaagagcctgggaacttggtttaatgaacacacacattccagagaactgtggcttattgtgtaacagaacctggagcaggctctgatgtagctggtataaagaccaaagcagaaaagaaaggagatgagtatattattaatggtcagaagatgtggataaccaacggaggaaaagctaattggtattttttattggcacgttctgatccagatcctaaagctcctgctaataaagcctttactggattcattgtggaagcagataccccaggaattcagattgggagaaaggaattaaacatgggccagcgatgttcagatactagaggaattgtcttcgaagatgtgaaagtgcctaaagaaaatgttttaattggtgacggagctggtttcaaagttgcaatgggagcttttgataaaaccagacctgtagtagctgctggtgctgttggattagcacaaagagctttggatgaagctaccaagtatgccctggaaaggaaaactttcggaaagctacttgtagagcaccaagcaatatcatttatgctggctgaaatggcaatgaaagttgaactagctagaatgagttaccagagagcagcttgggaggttgattctggtcgtcgaaatacctattatgcttctattgcaaaggcatttgctggagatattgcaaatcagttagctactgatgctgtgcagatacttggaggcaatggatttaatacagaatatcctgtagaaaaactaatgagggatgccaaaatctatcagatttatgaaggtacttcacaaattcaaagacttattgtagcccgtgaacacattgacaagtacaaaaattaaaaaaattactgtagaaatattgaataactagaacacaagccactgtttcagctccagaaaaaagaaagggctttaacgttttttccagtgaaaacaaatcctcttatattaaatctaagcaactgcttattatagtagtttatacttttgcttaactctgttatgtctcttaagcaggtttggtttttattaaaatgatgtgttttctttagtaccactttacttgaattacattaacctagaaaactacataggttattttgatctcttaagattaatgtagcagaaatttcttggaattttatttttgtaatgacagaaaagtgggcttagaaagtattcaagatgttacaaaatttacatttagaaaatattgtagtatttgaatactgtcaacttgacagt

SEQ ID NO: 104314 - DNA, 1149 bp, Homo sapiens
  Payload ID: 492
  Gene Symbol: ACADM
  Gene Name: acyl-CoA dehydrogenase, C-4 to C-12 straight chain
  ENST ID: ENST00000534334
  CDS Start-End: 22-336
gtggccggaacgggagccaacatggcagcggggttcgggcgatgctgcagggtcctgagaagtatttctcgttttcattggagatcacagcatacaaaagccaatcgacaacgtgaaccaggattaggatttagttttgagttcaccgaacagcagaaagaatttcaagctactgctcgtaaatttgccagagaggaaatcatcccagtggctgcagaatatgataaaactggtgaatatccagtccccctaattagaagagcctgggaacttggtttaatgaacacacacattccagagaactgtgcaaatgcctattattattgctggaaatgatcaacaaaagaagaagtatttggggagaatgactgaggagccattgatgtgtgcttattgtgtaacagaacctggagcaggctctgatgtagctggtataaagaccaaagcagaaaagaaaggagatgagtatattattaatggtcagaagatgtggataaccaacggaggaaaagctaattggtattttttattggcacgttctgatccagatcctaaagctcctgctaataaagcctttactggattcattgtggaagcagataccccaggaattcagattgggagaaaggaattaaacatgggccagcgatgttcagatactagaggaattgtcttcgaagatgtgaaagtgcctaaagaaaatgttttaattggtgacggagctggtttcaaagttgcaatgggagcttttgataaaaccagacctgtagtagctgctggtgctgttggattagcacaaagagctttggatgaagctaccaagtatgccctggaaaggaaaactttcggaaagctacttgtagagtcttagcaaacaacacaccaggagattatatcctgcgcctggcttggagggtcccacacccatggaacctcacccactgctagcacagcagtctgagatgaaactacaaggcggcagcaaggctcagggaggggcatccgccattgctgaggcttgacaccaagcaatatcatttatgctggctgaaatggcaatgaaagttgaactagctagaatgagttaccagagagcagcttgggaggttgattctggtcgtcgaaatacctattatgcttctattgcaa

SEQ ID NO: 104315 - DNA, 2535 bp, Homo sapiens
  Payload ID: 492
  Gene Symbol: ACADM
  Gene Name: acyl-CoA dehydrogenase, C-4 to C-12 straight chain
  ENST ID: ENST00000541113
  CDS Start-End: 462-1619
ctgcaccgcgccgcaagtccccccaccgttcagcgcaaccgggccctcccagccccgccgccgtccccctcccccgccctggctctctttccgcgctgcggtcagcctcggcgtcccacagagagggccagaggtggaaacgcagaaaaccaaaccaggactatcagagattgcccggagaggggatgcgacccctccccaggtcgcagcgacggcgcacgcaagggtcacggagcatgcgttggctacccggcgccggggaccgctgccaccccgcctagcgcagcgccccgtccttccgcagcccaaccgcctcttcccgccccgccccatcccgcccacgggctccagtgggcgggaccagaggagtcccgcgttcggggagtatgtcaaggccgtgacccgtgtattattgtccgagtggccggaacgggagccaacatggcagcggggttcgggcgatgctgcaggagttcaccgaacagcagaaagaatttcaagctactgctcgtaaatttgccagagaggaaatcatcccagtggctgcagaatatgataaaactggtgaatatccagtccccctaattagaagagcctgggaacttggtttaatgaacacacacattccagagaactgtggaggtcttggacttggaacttttgatgcttgtttaattagtgaagaattggcttatggatgtacaggggttcagactgctattgaaggaaattctttggggcaaatgcctattattattgctggaaatgatcaacaaaagaagaagtatttggggagaatgactgaggagccattgatgtgtgcttattgtgtaacagaacctggagcaggctctgatgtagctggtataaagaccaaagcagaaaagaaaggagatgagtatattattaatggtcagaagatgtggataaccaacggaggaaaagctaattggtattttttattggcacgttctgatccagatcctaaagctcctgctaataaagcctttactggattcattgtggaagcagataccccaggaattcagattgggagaaaggaattaaacatgggccagcgatgttcagatactagaggaattgtcttcgaagatgtgaaagtgcctaaagaaaatgttttaattggtgacggagctggtttcaaagttgcaatgggagcttttgataaaaccagacctgtagtagctgctggtgctgttggattagcacaaagagctttggatgaagctaccaagtatgccctggaaaggaaaactttcggaaagctacttgtagagcaccaagcaatatcatttatgctggctgaaatggcaatgaaagttgaactagctagaatgagttaccagagagcagcttgggaggttgattctggtcgtcgaaatacctattatgcttctattgcaaaggcatttgctggagatattgcaaatcagttagctactgatgctgtgcagatacttggaggcaatggatttaatacagaatatcctgtagaaaaactaatgagggatgccaaaatctatcagatttatgaaggtacttcacaaattcaaagacttattgtagcccgtgaacacattgacaagtacaaaaattaaaaaaattactgtagaaatattgaataactagaacacaagccactgtttcagctccagaaaaaagaaagggctttaacgttttttccagtgaaaacaaatcctcttatattaaatctaagcaactgcttattatagtagtttatacttttgcttaactctgttatgtctcttaagcaggtttggtttttattaaaatgatgtgttttctttagtaccactttacttgaattacattaacctagaaaactacataggttattttgatctcttaagattaatgtagcagaaatttcttggaattttatttttgtaatgacagaaaagtgggcttagaaagtattcaagatgttacaaaatttacatttagaaaatattgtagtatttgaatactgtcaacttgacagtaactttgtagacttaatggtattattaaagttctttttattgcagtttggaaagcatttgtgaaactttctgtttggcacagaaacagtcaaaattttgacattcatattctcctattttacagctacaagaactttcttgaaaatcttatttaattctgagcccatatttcacttaccttatttaaaataaatcaataaagcttgccttaaattatttttatatgactgttggtctctaggtagcctttggtctattgtacacaatctcatttcatatgtttgcattttggcaaagaacttaataaaattgttcagtgcttattatcatatctttctgtattttttccaggaaatttcattacttcgtgtaatagtgtatatttcttgtatttactatgatgaaaaaaggtcgttttaattttgaattgaataaagttacctgttcattttttattagatattttaaagacttcagaaaatataaatatgaaataatttaagaacccaaa

SEQ ID NO: 104316 - DNA, 2543 bp, Homo sapiens
  Payload ID: 493
  Gene Symbol: ACADL
  Gene Name: acyl-CoA dehydrogenase, long chain
  Uniprot ID: P28330
  ENST ID: ENST00000233710
  CDS Start-End: 229-1521
agcagtttcgctgtaaaatcctattgctgacagccaagacgggcgtattccctcgcgaccagcctgtggcgtggttggggctccggaagggcgcgcgcgagcgcttttttgggaggacaccacaggtggacgcctcagctgatcgtcctccctcccggggaccctgccccgagtcgccgagtagccgcagagtcgcctccgtcgccccgccgcccctgtgtttcggacatggccgcacgccttctccgagggtccctacgcgtcctgggcggccaccgtgcgccgcgccagctgcccgccgcgcgatgttctcattccggaggggaagaacgtctagaaactccttctgctaaaaaattaacagatataggaattcgaagaatcttttctccagagcatgacattttccggaaaagtgtaaggaagtttttccaagaagaagtgattcctcatcactcagaatgggagaaagctggagaagtaagtagggaggtttgggaaaaagctggaaaacaaggactgcttggtgtcaatattgcagagcatcttggtggaattggaggggatctgtactccgcagctattgtctgggaggagcaagcttattcaaattgttcaggcccaggttttagtattcattcaggtattgtcatgtcctatattacaaaccatggctcagaagaacagattaagcactttattccccagatgactgcaggcaaatgtattggtgcaatagcaatgacagagcctggagctggaagtgacttacagggaataaaaacaaatgctaaaaaggatggaagtgactggattctcaatggaagcaaggtgttcatcagtaatgggtcattaagtgatgttgtgattgtagttgcggtcacaaatcatgaagctccctcccctgcccatggtattagcctttttctggtggaaaatggaatgaaaggatttatcaagggacgaaagctacataaaatgggattaaaagcccaggataccgcagaactattctttgaagatatacggttgccagctagtgccctacttggagaagagaataaaggcttctattacatcatgaaagagcttccacaggaaaggctgttaattgctgatgtggcaatttcagctagtgaattcatgtttgaagaaaccaggaactatgttaaacaaagaaaagcttttggcaaaacagttgctcacctacagacagtgcaacataaattagcagaattaaaaacacatatatgtgtaacccgagcatttgtggacaactgtctccagctgcatgaagcgaaacgtttggactccgccactgcttgcatggcgaaatattgggcatctgagttacaaaatagtgtagcttacgactgtgtacagctccatggaggttggggatacatgtgggagtacccaattgcaaaagcttatgtggatgccagagttcagccaatctatggtggtacaaatgaaataatgaaggagctgattgcaagagagattgtctttgacaagtagacatctgcccacatcctggagtcctattacagctaatctcgttttaaatctgctcaagataaaatgtaacttggaaagcgaggaaacactaaacatgtttttacctgctctctctatagagaaggaaataaaatataaatataagattaacacagtggaaggacaaatctttgaagccaaaattctagttttccaatataaggtttaacttacagttttttatgtagccaaaggtaaacggttttctgaatcttgcctaggtgtttcatttatctctaaaattctaaaaagcataaatcattcaaatcttcaaaccaaggcagaaataattttatgtcgctatagtataaaaacattaataagatagcacattgacttttaaagggaaaagtaaatataacttagcatgtaaactcatttcggctaccatttgctccaaattccctagaacagtggtttttaccactgtactccaaccccgtttttaagcaatggaactctttcttcaaacaaaagcttatgcagaacatctctgtgaaacgctgctgagtgagaactgctttcattgaagctggaagccatcataccttactgccttgaaacccctaggactcagctaagtatttgcctaaccctgaccagggaatgccttggttctgtcaattgctgacatctgagaacacagaataatccatcatttttaatttcaagatattggtacattttataggtatcaaagcaatggcttttcttttgcaacagttaatgtatttattaacttaataattactttatgtcttctataaaccaggctgttaatacaatgatgacaaacaaaactggcaagatcactaaaaaataagtgaataaacaaataagtagtaaaataaggtaagaagtaaatatgtaaaagagataatttcaagcataagtgcaatgtaaataataaagtaagcatttaaaattcaaaagtgaggaaatgacatttgatttaagacttaaaagtaattacaaaaaataaa

SEQ ID NO: 104317 - DNA, 1599 bp, Homo sapiens
  Payload ID: 494
  Gene Symbol: ACADSB
  Gene Name: acyl-CoA dehydrogenase, short/branched chain
  Uniprot ID: P45954
  ENST ID: ENST00000368869
  CDS Start-End: 253-1245
aggggctggctagagacccagaggcgcagagcggagaggcctgcggcgaggatggagggcctggcagtgcggttgctgcgcggcagcagctaagaagaaatttcctgacttgtttgtcttcttggaagattcctcctcatgtctcaaaatcttcccagtcagaagctctactcaatataacaaataatggaatacactttgctcccctgcaaacatttacagatgaggaaatgatgataaagagttcagttgatgggtattgaagttgacccagaatatggaggcacaggagcttcatttttatccactgtgctcgtgatagaggaattagccaaagttgatgcatctgtggctgtcttttgtgagatccagaacacattaattaacacactgattagaaaacatggaacagaagaacaaaaggccacctatttgcctcagctcactacagaaaaagtaggaagtttctgcctttcagaggctggagcaggtagtgactcatttgctttgaagaccagagctgataaagagggagattattatgtcctcaatggatcaaagatgtggatcagcagtgctgagcacgcagggctctttctggtgatggcaaatgtagaccctaccattggatataagggaattacctccttcttagtagatcgtgatactccgggccttcatatagggaaacctgaaaacaaattggggctcagagcttcttccacctgcccgttaacattcgaaaatgtcaaggttccagaagccaatatcttgggacaaattggacatggctataagtatgccatagggagtctcaatgaaggtagaataggaattgctgcacagatgctgggactggcgcaaggatgttttgactacactattccatatattaaagaaaggatacaatttggcaaaagactatttgattttcagggcctccaacaccaagtggctcacgtggccacccagctggaagctgcaagattactaacatacaatgctgctaggcttttagaagctggaaagccattcataaaagaagcgtcaatggccaaatactatgcatcagagattgcaggacaaacaacgagtaaatgtatcgagtggatggggggagtaggctacaccaaagattaccctgtggagaaatacttccgagatgcaaagattggtacgatatatgaaggagcttccaacatccagttgaacaccattgcaaagcatatcgatgcagaatactgacgtctataggagtgggacccctccctggtgtcactgctgtaaaattttaaacggttgtgtcttgttgggagtaagtgccttgcgtgggaataaacttccacagcattcgaatattttaatgaagcccttagtcagggtcctggtgttggcctttttggttttctcttttcaggctgtttaacttaggcacaggagatccacttttaaacttgggaaataagcacctgtatttttttccaaaactgtttttaaagctgtatacgcatacatatatatatttttactctgtcttactctgtcacccaggctagagtgcagtggcgcgatctcagctcactgcagccttgacctcct

SEQ ID NO: 104318 - DNA, 5859 bp, Homo sapiens
  Payload ID: 494
  Gene Symbol: ACADSB
  Gene Name: acyl-CoA dehydrogenase, short/branched chain
  Uniprot ID: P45954
  ENST ID: ENST00000358776
  CDS Start-End: 15-1313
ggcctgcggcgaggatggagggcctggcagtgcggttgctgcgcggcagcaggctgctaagaagaaatttcctgacttgtttgtcttcttggaagattcctcctcatgtctcaaaatcttcccagtcagaagctctactcaatataacaaataatggaatacactttgctcccctgcaaacatttacagatgaggaaatgatgataaagagttcagttaaaaaatttgctcaggaacaaattgcacctttggtttcaaccatggatgaaaattcgaaaatggagaaatcagtaatacaaggattatttcaacaagggttgatgggtattgaagttgacccagaatatggaggcacaggagcttcatttttatccactgtgctcgtgatagaggaattagccaaagttgatgcatctgtggctgtcttttgtgagatccagaacacattaattaacacactgattagaaaacatggaacagaagaacaaaaggccacctatttgcctcagctcactacagaaaaagtaggaagtttctgcctttcagaggctggagcaggtagtgactcatttgctttgaagaccagagctgataaagagggagattattatgtcctcaatggatcaaagatgtggatcagcagtgctgagcacgcagggctctttctggtgatggcaaatgtagaccctaccattggatataagggaattacctccttcttagtagatcgtgatactccgggccttcatatagggaaacctgaaaacaaattggggctcagagcttcttccacctgcccgttaacattcgaaaatgtcaaggttccagaagccaatatcttgggacaaattggacatggctataagtatgccatagggagtctcaatgaaggtagaataggaattgctgcacagatgctgggactggcgcaaggatgttttgactacactattccatatattaaagaaaggatacaatttggcaaaagactatttgattttcagggcctccaacaccaagtggctcacgtggccacccagctggaagctgcaagattactaacatacaatgctgctaggcttttagaagctggaaagccattcataaaagaagcgtcaatggccaaatactatgcatcagagattgcaggacaaacaacgagtaaatgtatcgagtggatggggggagtaggctacaccaaagattaccctgtggagaaatacttccgagatgcaaagattggtacgatatatgaaggagcttccaacatccagttgaacaccattgcaaagcatatcgatgcagaatactgacgtctataggagtgggacccctccctggtgtcactgctgtaaaattttaaacggttgtgtcttgttgggagtaagtgccttgcgtgggaataaacttccacagcattcgaatattttaatgaagcccttagtcagggtcctggtgttggcctttttggttttctcttttcaggctgtttaacttaggcacaggagatccacttttaaacttgggaaataagcacctgtatttttttccaaaactgtttttaaagctgtatacgcatacatatatatatttttactctgtcttactctgtcacccaggctagagtgcagtggcgcgatctcagctcactgcagccttgacctcctgggttccagtgattctcatgcctcatcctcccaagtagctggaactacaggtgtgcaccaccatgcctggttcatttttgtgtttttagtagagatggggttttaccatattgcccaggctggtcttctggcttctggatatcgcccaccttggcctcccaaagtgctgggattacagggatgagccaccgtgcctggctgggtatttatattatcattctagtttcagagtatacagaagtttcatcccatcatttggaaaaataaaggcatctgaagtacaatattacttatagaaatagtttatattcctattaaatcttaatcttgtggcatcagggaaatatttgttacatagtaggcaatttttatccagtactttatagattcaactctaagttgcaagcgaagtcaaaactgatgaaaatttatttagaaaaatctaaaaattctggttttaaatatgagaatcagtggaaaataagggtataattttgtaggtcatatgattgaagaaaatattattttaacaatgtaaagcaatatgatttgttactataattaacctgtataaaagatacattttatggtggtttcagtaggtcattttaaaaaccaatgtgcattagttttcaagtataaggtttaagtaatttggtttaataatcagaaaatattcaatacagtgttggatattctgtcatgcactatttttcagttgacaatttctgtattttaattgaatactgtttcttcagtcatggttattgcactttatcctgaataataattcagaaattgggttttggttcagtgattctcaagaaaaagatctcttgcccattaagaagtgtatcaaaatctcataaggaatgagggagagaagggggctgtagagtttgaaaaagcatattcaatattaaaatagttttatatttgggaaggcaaaaatgaatctattgttttgcaatataggttataaacaggcaaaatgcaataaaatatatatctggttgtattagtctgttttcacgctgctgataaagacatacctgagaccaggaagaaaaagaggtttaattggacttacagttccacatgactggggaggcctcagaatcatggtgggaggcaaaaagcacttcttacatggcggcagcaagagaaaatgagaaagaagcaaaagtggaaacccctaataaacctatcagatcttgtgagacttactatcacgagaatagcacaggaaagactggcccccatgattcaattacctcccccgggtccctcccacaacacatgggaattctgagagataccatttaagttgagatttcagtggggacacagccaaaccatatcattctacccctggcacctccaaatctcatgtcctcacatttcaaaaccaatcatgccttcccaacagtcccccaaagtcttaactcatttcagcattaacccaaaagtccgcagtccaaagtttcatctgagacaaggcaagtcccttccacttatgaacctgtaaaatcaaaagtaaactagttacttcctagatacaatgggggtacaggtattgggtaaatacagccattccaaatgggagaaattggccaacacaaaagggtaacagggcccatgcaagtccaaaattcagcagggcagtcaaattttaaacctccaaaatgatcacctttgactccacgtctcacaatcatctctctcaagttcgaagttccacaaatctctaaggcaagggaaagatgctgccagtctctttgctaaaacacagcaagagtcacctttactccagttcccaaaaagtttttcatctccatctgagaccacctcagcctgaattttattgtcaatattgctatcagcattttgggcaaagccattcagcaagtatctaggaagttccaaactttcccacattttcctgtcttcttctgagcccttcaaactgttccaacctctgcctgttacccagttccaaacttgctttcatatttttggctatcttttcagcaatgccccactctactgttagcagtttactgtattagtctgttttcacactgctgataaagacattcctcaagattgtgaagaaaaagaggtttaattggacttacagttccacatggccggggaggcctcagaatcatggcgggaggtgaaaagcacttcgtacatggtggtggcaagagaaaatgaagaagaagcaaaagtggaaacccctgataaacccatcagatctcatgagacttactatcatgagaatagcacaggaaagactggcccccctgattcgatgacctccccctgggtccctcccacaacatgtgggaattccagaagataaattcaagttgcaatttcagtggggacatagccaaaccatatcactggtgatgccacttcttcagtattagggattctcagtcagaagagaccccctgtgtggcctgagtcccctcaggaggaaggtggacaacagagaaatgagagttttgatattttctgaaagaggaacatgtgttagagatgaagaatcttccaaggctcatgcagttgcttagaataatcattactgttatatgagaaacattttagtaatttaataaaaggataatgtttatttaaaaaacctgacttttccagagtaattttgttttgcacattcatgtttattgaagtggactaatttctataatgcaaatcagagttaaatattaaaaattgtgtaaatacaattgacataggaattacattaaaatattaggaagaaacaaggacaaatttagaccttgaatccgaagagataaagcttacttgactttcaaatggagagatgatgaaaacccactcattcactctttcagaacaaaaagacagtcatctgataagagtatgacatggatgaaatgccctacaggggccttggacatctttaatttctgcgattatgtgaaagaggtggactttacagataatggagcagaagccaacattagtaaaaggaatcccaacttcttcccatagaattagaaacatgtgaaagtacaataaacttcttgttcaaattaccagcatcagagagcttcccatttgcatctagaccttgaatttatatttattgatcaagttctaatttgtatgtatattttgtgcatattcaccaataacagttaaaattaattatgtgttatagttaatatatgcacctaccttcttccgttagtgcatcagtaaatgtgttattttgtcatttttccaaagagagtgttgtaggttttccctgtagttcttcctttatagcttttcttctgataaccatgacttcaggagctttaaaactatctatcttgcatttgtgtctggcggagaactagccatcagcctcctgaagcctgccatcattgttaatttgaggactgggctgtcttggggctcagaagataaagaactatttgagcagatgtgtgtgggtggcactggattccacccaactgccaagttagtattgttagagatttcattttacaacacaaaaataagcctgtgtcaaagattttaaaatcatggaaagttaaaatctagaaagaccttagagaaccagccaaccaactctctcattttaaaagtgaaggattcatagcacagattacttgcctaagatcatccaggaacgaagacaagaatccaaatgtacttggggacaagaattagtccccaaattcagtgttcttcctagtattaaacattgcccctttcgacaaattttggatttcattcttgttatatttcagtactcttgctgatttattttaggtttaactggtaaagaatgaacatttcagaagtgttaggattagtcagtgtcatcgcttatgtatatgaatcacttgccaaagacactggctctcctcagctgtaaccagcatgtcaaatgtgaagattattgtgtgggatcctttggtttcattgttatgatgtattttataaatgtactagttatatccttgtttatgtatttttgctgatctttcataaagcagaatggtatgtatcggattgttttaatgttatatattggattgtattcgatgttacaaaaccaatattctatggagaatgaaaaaaataaaggactaaattaactggagatttttggtactcttataaa

SEQ ID NO: 104319 - DNA, 2352 bp, Homo sapiens
  Payload ID: 495
  Gene Symbol: ACADVL
  Gene Name: acyl-CoA dehydrogenase, very long chain
  ENST ID: ENST00000322910
  CDS Start-End: 142-261
agcatgccccggggcccgcaaccgtccgccgcccggtgcactgtggacgatgagtcagggttaggggcgccaggacgtgggcgtgcaggacgccagagctgggtcagagctcgagccagcggcgcccggagagattcggagatgcaggcggctcggatggccgcgagcttggggcggcagctgctgaggctcgggggcggaaggtctgtgtgtgacaagagggacggtgggcagcggccctgggcaccgggccggcactgaacccccactccccacagctcgcggctcacggcgctcctggggcagccccggcccggccctgcccggcggccctatgccgggggtgccgctcagctggctctggacaagtcagattcccacccctctgacgctctgaccaggaaaaaaccggccaaggcggaatctaagtcctttgctgtgggaatgttcaaaggccagctcaccacagatcaggtgttcccatacccgtccgtgctcaacgaagagcagacacagtttcttaaagagctggtggagcctgtgtcccgtttcttcgaggaagtgaacgatcccgccaagaatgacgctctggagatggtggaggagaccacttggcagggcctcaaggagctgggggcctttggtctgcaagtgcccagtgagctgggtggtgtgggcctttgcaacacccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctggggagactgtggccgctttctgtctaaccgagccctcaagcgggtcagatgcagcctccatccgaacctctgctgtgcccagcccctgtggaaaatactataccctcaatggaagcaagctttggatcagtaatgggggcctagcagacatcttcacggtctttgccaagacaccagttacagatccagccacaggagccgtgaaggagaagatcacagcttttgtggtggagaggggcttcgggggcattacccatgggccccctgagaagaagatgggcatcaaggcttcaaacacagcagaggtgttctttgatggagtacgggtgccatcggagaacgtgctgggtgaggttgggagtggcttcaaggttgccatgcacatcctcaacaatggaaggtttggcatggctgcggccctggcaggtaccatgagaggcatcattgctaaggcggtagatcatgccactaatcgtacccagtttggggagaaaattcacaactttgggctgatccaggagaagctggcacggatggttatgctgcagtatgtaactgagtccatggcttacatggtgagtgctaacatggaccagggagccacggacttccagatagaggccgccatcagcaaaatctttggctcggaggcagcctggaaggtgacagatgaatgcatccaaatcatggggggtatgggcttcatgaaggaacctggagtagagcgtgtgctccgagatcttcgcatcttccggatctttgaggggacaaatgacattcttcggctgtttgtggctctgcagggctgtatggacaaaggaaaggagctctctgggcttggcagtgctctaaagaatccctttgggaatgctggcctcctgctaggagaggcaggcaaacagctgaggcggcgggcagggctgggcagcggcctgagtctcagcggacttgtccacccggagttgagtcggagtggcgagctggcagtacgggctctggagcagtttgccactgtggtggaggccaagctgataaaacacaagaaggggattgtcaatgaacagtttctgctgcagcggctggcagacggggccatcgacctctatgccatggtggtggttctctcgagggcctcaagatccctgagtgagggccaccccacggcccagcatgagaaaatgctctgtgacacctggtgtatcgaggctgcagctcggatccgagagggcatggccgccctgcagtctgacccctggcagcaagagctctaccgcaacttcaaaagcatctccaaggccttggtggagcggggtggtgtggtcaccagcaacccacttggcttctgaatactcccggccagggcctgtcccagttatgtgccttccctcaagccaaagccgaagcccctttccttaaggccctggtttgtcccgaaggggcctagtgttcccagcactgtgcctgctctcaagagcacttactgcctcgcaaataataaaaatttctagccagtc

SEQ ID NO: 104320 - DNA, 2191 bp, Homo sapiens
  Payload ID: 495
  Gene Symbol: ACADVL
  Gene Name: acyl-CoA dehydrogenase, very long chain
  Uniprot ID: P49748
  ENST ID: ENST00000350303
  CDS Start-End: 123-2024
aaccgtccgccgcccggtgcactgtggacgatgagtcagggttaggggcgccaggacgtgggcgtgcaggacgccagagctgggtcagagctcgagccagcggcgcccggagagattcggagatgcaggcggctcggatggccgcgagcttggggcggcagctgctgaggctcgggggcggaagctcgcggctcacggcgctcctggggcagccccggcccggccctgcccggcggccctatgccgggggtgccgctcaggaatctaagtcctttgctgtgggaatgttcaaaggccagctcaccacagatcaggtgttcccatacccgtccgtgctcaacgaagagcagacacagtttcttaaagagctggtggagcctgtgtcccgtttcttcgaggaagtgaacgatcccgccaagaatgacgctctggagatggtggaggagaccacttggcagggcctcaaggagctgggggcctttggtctgcaagtgcccagtgagctgggtggtgtgggcctttgcaacacccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctggggagactgtggccgctttctgtctaaccgagccctcaagcgggtcagatgcagcctccatccgaacctctgctgtgcccagcccctgtggaaaatactataccctcaatggaagcaagctttggatcagtaatgggggcctagcagacatcttcacggtctttgccaagacaccagttacagatccagccacaggagccgtgaaggagaagatcacagcttttgtggtggagaggggcttcgggggcattacccatgggccccctgagaagaagatgggcatcaaggcttcaaacacagcagaggtgttctttgatggagtacgggtgccatcggagaacgtgctgggtgaggttgggagtggcttcaaggttgccatgcacatcctcaacaatggaaggtttggcatggctgcggccctggcaggtaccatgagaggcatcattgctaaggcggtagatcatgccactaatcgtacccagtttggggagaaaattcacaactttgggctgatccaggagaagctggcacggatggttatgctgcagtatgtaactgagtccatggcttacatggtgagtgctaacatggaccagggagccacggacttccagatagaggccgccatcagcaaaatctttggctcggaggcagcctggaaggtgacagatgaatgcatccaaatcatggggggtatgggcttcatgaaggaacctggagtagagcgtgtgctccgagatcttcgcatcttccggatctttgaggggacaaatgacattcttcggctgtttgtggctctgcagggctgtatggacaaaggaaaggagctctctgggcttggcagtgctctaaagaatccctttgggaatgctggcctcctgctaggagaggcaggcaaacagctgaggcggcgggcagggctgggcagcggcctgagtctcagcggacttgtccacccggagttgagtcggagtggcgagctggcagtacgggctctggagcagtttgccactgtggtggaggccaagctgataaaacacaagaaggggattgtcaatgaacagtttctgctgcagcggctggcagacggggccatcgacctctatgccatggtggtggttctctcgagggcctcaagatccctgagtgagggccaccccacggcccagcatgagaaaatgctctgtgacacctggtgtatcgaggctgcagctcggatccgagagggcatggccgccctgcagtctgacccctggcagcaagagctctaccgcaacttcaaaagcatctccaaggccttggtggagcggggtggtgtggtcaccagcaacccacttggcttctgaatactcccggccagggcctgtcccagttatgtgccttccctcaagccaaagccgaagcccctttccttaaggccctggtttgtcccgaaggggcctagtgttcccagcactgtgcctgctctcaagagcacttactgcctcgcaaataataaaaatttctagccagt

SEQ ID NO: 104321 - DNA, 2323 bp, Homo sapiens
  Payload ID: 495
  Gene Symbol: ACADVL
  Gene Name: acyl-CoA dehydrogenase, very long chain
  Uniprot ID: P49748
  ENST ID: ENST00000356839
  CDS Start-End: 180-2147
cggaacgcagggccgggctccagggaactacagctcccagcatgccccggggcccgcaaccgtccgccgcccggtgcactgtggacgatgagtcagggttaggggcgccaggacgtgggcgtgcaggacgccagagctgggtcagagctcgagccagcggcgcccggagagattcggagatgcaggcggctcggatggccgcgagcttggggcggcagctgctgaggctcgggggcggaagctcgcggctcacggcgctcctggggcagccccggcccggccctgcccggcggccctatgccgggggtgccgctcagctggctctggacaagtcagattcccacccctctgacgctctgaccaggaaaaaaccggccaaggcggaatctaagtcctttgctgtgggaatgttcaaaggccagctcaccacagatcaggtgttcccatacccgtccgtgctcaacgaagagcagacacagtttcttaaagagctggtggagcctgtgtcccgtttcttcgaggaagtgaacgatcccgccaagaatgacgctctggagatggtggaggagaccacttggcagggcctcaaggagctgggggcctttggtctgcaagtgcccagtgagctgggtggtgtgggcctttgcaacacccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctggggagactgtggccgctttctgtctaaccgagccctcaagcgggtcagatgcagcctccatccgaacctctgctgtgcccagcccctgtggaaaatactataccctcaatggaagcaagctttggatcagtaatgggggcctagcagacatcttcacggtctttgccaagacaccagttacagatccagccacaggagccgtgaaggagaagatcacagcttttgtggtggagaggggcttcgggggcattacccatgggccccctgagaagaagatgggcatcaaggcttcaaacacagcagaggtgttctttgatggagtacgggtgccatcggagaacgtgctgggtgaggttgggagtggcttcaaggttgccatgcacatcctcaacaatggaaggtttggcatggctgcggccctggcaggtaccatgagaggcatcattgctaaggcggtagatcatgccactaatcgtacccagtttggggagaaaattcacaactttgggctgatccaggagaagctggcacggatggttatgctgcagtatgtaactgagtccatggcttacatggtgagtgctaacatggaccagggagccacggacttccagatagaggccgccatcagcaaaatctttggctcggaggcagcctggaaggtgacagatgaatgcatccaaatcatggggggtatgggcttcatgaaggaacctggagtagagcgtgtgctccgagatcttcgcatcttccggatctttgaggggacaaatgacattcttcggctgtttgtggctctgcagggctgtatggacaaaggaaaggagctctctgggcttggcagtgctctaaagaatccctttgggaatgctggcctcctgctaggagaggcaggcaaacagctgaggcggcgggcagggctgggcagcggcctgagtctcagcggacttgtccacccggagttgagtcggagtggcgagctggcagtacgggctctggagcagtttgccactgtggtggaggccaagctgataaaacacaagaaggggattgtcaatgaacagtttctgctgcagcggctggcagacggggccatcgacctctatgccatggtggtggttctctcgagggcctcaagatccctgagtgagggccaccccacggcccagcatgagaaaatgctctgtgacacctggtgtatcgaggctgcagctcggatccgagagggcatggccgccctgcagtctgacccctggcagcaagagctctaccgcaacttcaaaagcatctccaaggccttggtggagcggggtggtgtggtcaccagcaacccacttggcttctgaatactcccggccagggcctgtcccagttatgtgccttccctcaagccaaagccgaagcccctttccttaaggccctggtttgtcccgaaggggcctagtgttcccagcactgtgcctgctctcaagagcacttactgcctcgcaaataataaaaatttctagccagtcatgctttg

SEQ ID NO: 104322 - DNA, 2227 bp, Homo sapiens
  Payload ID: 495
  Gene Symbol: ACADVL
  Gene Name: acyl-CoA dehydrogenase, very long chain
  Uniprot ID: P49748
  ENST ID: ENST00000543245
  CDS Start-End: 22-2058
gtcactatacagagacagtccatgttggggggcctggccgcggcggcgggaacccggataatgggaaaggagatagaagcagaagcacagaggcccctgaggcaaacatggagacctggccagccaccagcgatgacagcaaagacgatgagctcgcggctcacggcgctcctggggcagccccggcccggccctgcccggcggccctatgccgggggtgccgctcagctggctctggacaagtcagattcccacccctctgacgctctgaccaggaaaaaaccggccaaggcggaatctaagtcctttgctgtgggaatgttcaaaggccagctcaccacagatcaggtgttcccatacccgtccgtgctcaacgaagagcagacacagtttcttaaagagctggtggagcctgtgtcccgtttcttcgaggaagtgaacgatcccgccaagaatgacgctctggagatggtggaggagaccacttggcagggcctcaaggagctgggggcctttggtctgcaagtgcccagtgagctgggtggtgtgggcctttgcaacacccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctggggagactgtggccgctttctgtctaaccgagccctcaagcgggtcagatgcagcctccatccgaacctctgctgtgcccagcccctgtggaaaatactataccctcaatggaagcaagctttggatcagtaatgggggcctagcagacatcttcacggtctttgccaagacaccagttacagatccagccacaggagccgtgaaggagaagatcacagcttttgtggtggagaggggcttcgggggcattacccatgggccccctgagaagaagatgggcatcaaggcttcaaacacagcagaggtgttctttgatggagtacgggtgccatcggagaacgtgctgggtgaggttgggagtggcttcaaggttgccatgcacatcctcaacaatggaaggtttggcatggctgcggccctggcaggtaccatgagaggcatcattgctaaggcggtagatcatgccactaatcgtacccagtttggggagaaaattcacaactttgggctgatccaggagaagctggcacggatggttatgctgcagtatgtaactgagtccatggcttacatggtgagtgctaacatggaccagggagccacggacttccagatagaggccgccatcagcaaaatctttggctcggaggcagcctggaaggtgacagatgaatgcatccaaatcatggggggtatgggcttcatgaaggaacctggagtagagcgtgtgctccgagatcttcgcatcttccggatctttgaggggacaaatgacattcttcggctgtttgtggctctgcagggctgtatggacaaaggaaaggagctctctgggcttggcagtgctctaaagaatccctttgggaatgctggcctcctgctaggagaggcaggcaaacagctgaggcggcgggcagggctgggcagcggcctgagtctcagcggacttgtccacccggagttgagtcggagtggcgagctggcagtacgggctctggagcagtttgccactgtggtggaggccaagctgataaaacacaagaaggggattgtcaatgaacagtttctgctgcagcggctggcagacggggccatcgacctctatgccatggtggtggttctctcgagggcctcaagatccctgagtgagggccaccccacggcccagcatgagaaaatgctctgtgacacctggtgtatcgaggctgcagctcggatccgagagggcatggccgccctgcagtctgacccctggcagcaagagctctaccgcaacttcaaaagcatctccaaggccttggtggagcggggtggtgtggtcaccagcaacccacttggcttctgaatactcccggccagggcctgtcccagttatgtgccttccctcaagccaaagccgaagcccctttccttaaggccctggtttgtcccgaaggggcctagtgttcccagcactgtgcctgctctcaagagcacttactgcctcgcaaataataaaaatttctagccagtca

SEQ ID NO: 104323 - DNA, 1016 bp, Homo sapiens
  Payload ID: 495
  Gene Symbol: ACADVL
  Gene Name: acyl-CoA dehydrogenase, very long chain
  ENST ID: ENST00000542255
  CDS Start-End: 1-847
gaagctggcacggatggttatgctgcagtatgtaactgagtccatggcttacatggtgagtgctaacatggaccagggagccacggacttccagatagaggccgccatcagcaaaatctttggctcggaggcagcctggaaggtgacagatgaatgcatccaaatcatggggggtatgggcttcatgaaggaacctggagtagagcgtgtgctccgagatcttcgcatcttccggatctttgaggggacaaatgacattcttcggctgtttgtggctctgcagggctgtatggacaaaggaaaggagctctctgggcttggcagtgctctaaagaatccctttgggaatgctggcctcctgctaggagaggcaggcaaacagctgaggcggcgggcagggctgggcagcggcctgagtctcagcggacttgtccacccggagttgagtcggagtggcgagctggcagtacgggctctggagcagtttgccactgtggtggaggccaagctgataaaacacaagaaggggattgtcagtgaggaggcaggcagggaatgcctgagccgcagggggcctgggcctggatcccagccggcccagatttattttcatctcctgcttcctgccagggcctcaagatccctgagtgagggccaccccacggcccagcatgagaaaatgctctgtgacacctggtgtatcgaggctgcagctcggatccgagagggcatggccgccctgcagtctgacccctggcagcaagagctctaccgcaacttcaaaagcatctccaaggccttggtggagcggggtggtgtggtcaccagcaacccacttggcttctgaatactcccggccagggcctgtcccagttatgtgccttccctcaagccaaagccgaagcccctttccttaaggccctggtttgtcccgaaggggcctagtgttcccagcactgtgcctgctctcaagagcacttactgcctcgcaaataataaaaatttctagccagtca

SEQ ID NO: 104324 - DNA, 752 bp, Homo sapiens
  Payload ID: 495
  Gene Symbol: ACADVL
  Gene Name: acyl-CoA dehydrogenase, very long chain
  ENST ID: ENST00000581378
  CDS Start-End: 1-230
ttcttaaagagctggtggagcctgtgtcccgtttcttcgaggaagtgaacgatcccgccaagaatgacgctctggagatggtggaggagaccacttggcagggcctcaaggagctgggggcctttggtctgcaagtgcccagtgagctgggtggtgtgggcctttgcaacacccagattcctgcttcccctccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctggggagactgtggccgctttctgtctaaccgagccctcaagcgggtcagatgcagcctccatccgaacctctgctgtgcccagcccctgtggaaaatactataccctcaatggaagcaagctttggatcagtaatgggggcctagcagacatcttcacggtctttgccaagacaccagttacagatccagccacaggagccgtgaaggagaagatcacagcttttgtggtggagaggggcttcgggggcattacccatgggccccctgagaagaagatgggcatcaaggcttcaaacacagcagaggtgttctttgatggagtacgggtgccatcggagaacgtgctgggtgaggttgggagtggcttcaaggttgccatgcacatcctcaacaatggaaggtttggcatggc

SEQ ID NO: 104325 - DNA, 1015 bp, Homo sapiens
  Payload ID: 495
  Gene Symbol: ACADVL
  Gene Name: acyl-CoA dehydrogenase, very long chain
  ENST ID: ENST00000583858
  CDS Start-End: 1-613
tgaggttgggagtggcttcaaggttgccatgcacatcctcaacaatggaaggtttggcatggctgcggccctggcaggtaccatgagaggcatcattgctaaggcggtagatcatgccactaatcgtacccagtttggggagaaaattcacaactttgggctgatccaggagaagctggcacggatggttatgctgcagtatgtaactgagtccatggcttacatggtgagtgctaacatggaccagggagccacggacttccagatagaggccgccatcagcaaaatctttggctcggaggcagcctggaaggtgacagatgaatgcatccaaatcatggggggtatgggcttcatgaaggaacctggagtagagcgtgtgctccgagatcttcgcatcttccggatctttgaggggacaaatgacattcttcggctgtttgtggctctgcagggctgtatggcgggcagggctgggcagcggcctgagtctcagcggacttgtccacccggagttgagtcggagtggcgagctggcagtacgggctctggagcagtttgccactgtggtggaggccaagctgataaaacacaagaaggggattgtcaatgaacagtttctgctgcagcggctggcagacggggccatcgacctctatgccatggtggtggttctctcgagggcctcaagatccctgagtgagggccaccccacggcccagcatgagaaaatgctctgtgacacctggtgtatcgaggctgcagctcggatccgagagggcatggccgccctgcagtctgacccctggcagcaagagctctaccgcaacttcaaaagcatctccaaggccttggtggagcggggtggtgtggtcaccagcaacccacttggcttctgaatactcccggccagggcctgtcccagttatgtgccttccctcaagccaaagccgaagcccctttccttaaggccctggtttgtcccgaaggggcctagtgttcccagcactgtgcc

SEQ ID NO: 104326 - DNA, 502 bp, Homo sapiens
  Payload ID: 495
  Gene Symbol: ACADVL
  Gene Name: acyl-CoA dehydrogenase, very long chain
  ENST ID: ENST00000579886
  CDS Start-End: 38-502
cagagctcgagccagcggcgcccggagagattcggagatgcaggcggctcggatggccgcgagcttggggcggcagctgctgaggctcgggggcggaagctcgcggctcacggcgctcctggggcagccccggcccggccctgcccggcggccctatgccgggggtgccgctcagctggctctggacaagtcagattcccacccctctgacgctctgaccaggaaaaaaccggccaagaatgacgctctggagatggtggaggagaccacttggcagggcctcaaggagctgggggcctttggtctgcaagtgcccagtgagctgggtggtgtgggcctttgcaacacccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctggggag

SEQ ID NO: 104327 - DNA, 582 bp, Homo sapiens
  Payload ID: 495
  Gene Symbol: ACADVL
  Gene Name: acyl-CoA dehydrogenase, very long chain
  ENST ID: ENST00000579546
  CDS Start-End: 1-582
gctgcagtatgtaactgagtccatggcttacatggtgagtgctaacatggaccagggagccacggacttccagatagaggccgccatcagcaaaatctttggctcggaggcagcctggaaggtgacagatgaatgcatccaaatcatggggggtatgggcttcatgaaggaacctggagtagagcgtgtgctccgagatcttcgcatcttccggatctttgaggggacaaatgacattcttcggctgtttgtggctctgcagggctgtatggcgggcagggctgggcagcggcctgagtctcagcggacttgtccacccggagttgagtcggagtggcgagctgtacgggctctggagcagtttgccactgtggtggaggccaagctgataaaacacaagaaggggattgtcaatgaacagtttctgctgcagcggctggcagacggggccatcgacctctatgccatggtggtggttctctcgagggcctcaagatccctgagtgagggccaccccacggcccagcatgagaaaatgctctgtgacacctggtgtatcgaggctgcagctcggatccgaga

SEQ ID NO: 104328 - DNA, 555 bp, Homo sapiens
  Payload ID: 495
  Gene Symbol: ACADVL
  Gene Name: acyl-CoA dehydrogenase, very long chain
  ENST ID: ENST00000584103
  CDS Start-End: 83-555
gttaggggcgccaggacgtgggcgtgcaggacgccagagctgggtcagagctcgagccagcggcgcccggagagattcggagatgcaggcggctcggatggccgcgagcttggggcggcagctgctgaggctcgggggcggaagctcgcggctcacggcgctcctggggcagccccggcccggccctgcccggcggccctatgccgggggtgccgctcagctggctctggacaagtcagattcccacccctctgacgctctgaccaggaaaaaaccggccaaggcggaatctaagtcctttgctgtgggaatgttcaaaggccagctcaccacagatcaggtgttcccatacccgtccgtgctcaacgaagagcagacacagtttcttaaagagctggtggagcctgtgtcccgtttcttcgaggagcctggatgtgggatcctgtgccttccccaggaagtgaacgatcccgccaagaatgacgctctggagatggtggaggagaccacttggcagggcctcaaggagctgggggcctttggtctgcaagtgcc

SEQ ID NO: 104329 - DNA, 503 bp, Homo sapiens
  Payload ID: 495
  Gene Symbol: ACADVL
  Gene Name: acyl-CoA dehydrogenase, very long chain
  ENST ID: ENST00000583848
  CDS Start-End: 1-138
gctctggagcagtttgccactgtggtggaggccaagctgataaaacacaagaaggggattgtcacggctggcagacggggccatcgacctctatgccatggtggtggttctctcgagggcctcaagatccctgagtgagggccaccccacggcccagcatgagaaaatgctctgtgacacctggtgtatcgaggctgcagctcggatccgagagggcatggccgccctgcagtctgacccctggcagcaagagctctaccgcaacttcaaaagcatctccaaggccttggtggagcggggtggtgtggtcaccagcaacccacttggcttctgaatactcccggccagggcctgtcccagttatgtgccttccctcaagccaaagccgaagcccctttccttaaggccctggtttgtcccgaaggggcctagtgttcccagcactgtgcctgctctcaagagcacttactgcctcgcaaataataaaaatttctagccagtca

SEQ ID NO: 104330 - DNA, 799 bp, Homo sapiens
  Payload ID: 495
  Gene Symbol: ACADVL
  Gene Name: acyl-CoA dehydrogenase, very long chain
  ENST ID: ENST00000583312
  CDS Start-End: 126-799
cgcaaccgtccgccgcccggtgcactgtggacgatgagtcagggttaggggcgccaggacgtgggcgtgcaggacgccagagctgggtcagagctcgagccagcggcgcccggagagattcggagatgcaggcggctcggatggccgcgagcttggggcggcagctgctgaggctcgggggcggaagctcgcggctcacggcgctcctggggcagccccggcccggccctgcccggcggccctatgccgggggtgccgctcagctggctctggacaagtcagattcccacccctctgacgctctgaccaggaaaaaaccggccaaggcggaatctaagtcctttgctgtgggaatgttcaaaggccagctcaccacagatcaggtgttcccatacccgtccgtgctcaacgaagagcagacacagtttcttaaagagctggtggagcctgtgtcccgtttcttcgaggaagtgaacgatcccgccaagaatgacgctctggagatggtggaggagaccacttggcagggcctcaaggagctgggggcctttggtctgcaagtgcccagtgagctgggtggtgtgggcctttgcaacacccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctgctctctccccaacaggggagactgtggccgctttctgtctaaccgagccctc

SEQ ID NO: 104331 - DNA, 7514 bp, Homo sapiens
  Payload ID: 496
  Gene Symbol: ACOX1
  Gene Name: acyl-CoA oxidase 1, palmitoyl
  Uniprot ID: Q15067
  ENST ID: ENST00000293217
  CDS Start-End: 291-2273
cgaggatccgctcgggagcctcccctggccaggagcaggggattagtctgccccgcgaccggccccagccacgacgcggacatcgccccctctgtctgggccgctgtcactcacgcgccaaagggccacggagaaagaaggggcgggccggggcgggccgggcgagcggaggcggggacttgcgccgtcctgaggctgcctcctagggtccggccggcgctggagctgcggatttagattgtcactgccacctcggtcggtgcttacttcgctgccagctggtcgtcgccatgaacccggacctgcgcagggagcgggattccgccagcttcaacccggagctgcttacacacatcctggacggcagccccgagaaaacccggcgccgccgagagatcgagaacatgatcctgaacgacccagacttccagcatgaggacttgaacttcctcactcgcagccagcgttatgaggtggctgtcaggaaaagtgccatcatggtgaagaagatgagggagtttggcatcgctgaccctgatgaaattatgtggtttaaaaattttgtgcaccgagggcggcctgagcctctggatcttcacttgggcatgttcctgcccaccttgcttcaccaggcaactgcggagcagcaggagcgcttcttcatgcccgcctggaacttggagatcattggcacttatgcccagacagagatgggtcatggaactcaccttcgaggcttggaaaccacagccacgtatgaccctgaaacccaggagttcattctcaacagtcctactgtgacctccattaaatggtggcctggtgggcttggaaagacttcaaatcatgcaatagttcttgcccagctcatcactaaggggaaatgctatggattacatgcctttatcgtacctattcgtgaaatcgggacccataagcctttgccaggaattaccgttggtgacatcggccccaaatttggttatgatgagatagacaatggctacctcaaaatggacaaccatcgtattcccagagaaaacatgctgatgaagtatgcccaggtgaagcctgatggcacatacgtgaaaccgctgagtaacaagctgacttacgggaccatggtgtttgtcaggtccttccttgtgggagaagctgctcgggctctgtctaaggcgtgcaccattgccatccgatacagcgctgtgaggcaccagtctgaaatcaagccaggtgaaccagaaccacagattttggattttcaaacccagcagtataaactctttccactcctggccactgcctatgccttccagtttgtgggcgcatacatgaaggagacctatcaccggattaacgaaggcattggtcaaggggacctgagtgaactgcctgagcttcatgccctcaccgctggactgaaggctttcacctcctggactgcaaacactggcattgaagcatgtcggatggcttgtggtgggcatggctattctcattgcagtggtcttccaaatatttatgtcaatttcaccccaagctgtacctttgagggagaaaacactgtcatgatgctccagacggctaggttcctgatgaaaagttatgatcaggtgcactcaggaaagttggtgtgtggcatggtgtcctatttgaacgacctgcccagtcagcgcatccagccacagcaggtagcagtctggccaaccatggtggatatcaacagccccgaaagcctaaccgaagcatataaactccgtgcagccagattagtagaaattgctgcaaaaaaccttcaaaaagaagtgattcacagaaaaagcaaggaggtagcttggaacctaacttctgttgaccttgttcgagcaagtgaggcacattgccactatgtggtagttaagctcttttcagaaaaactcctcaaaattcaagataaagccattcaagctgtcttaaggagtttatgtctgctgtattctctgtatggaatcagtcagaacgcgggggatttccttcaggggagcatcatgacagagcctcagattacacaagtaaaccagcgtgtaaaggagttactcactctgattcgctcagatgctgttgctttggttgatgcatttgattttcaggatgtgacacttggctctgtgcttggccgctatgatgggaatgtgtatgaaaacttgtttgagtgggctaagaactccccactgaacaaagcagaggtccacgaatcttacaagcacctgaagtcactgcagtccaagctctgaagtgtcacaaggacaagtttaatctgcttcagaaagcgcctgtgtgcaactcaaattttgtggaatctttttcgaattcaaatagctatagagcaaatgataaattgacccctttttataaatggagggaaaaaatgaacagatttcagagattaaatgaaaaaaagcagatgttttaagtgcaattaacactgaaagagacctgttaaaccattcagaaaaagcttaagaaatgcgatatgacttccttttgtaatgctgctgatcccagtagactatgacttttgataattagcagaatttaactactgagtagttgattattttcacattttaattgctaatcactggctatataagtgtttttaagcaaaggtatttttgaagtggtgtagaacccttccaagctttcctgctcagtgttctaccagacttaccctggggcctggcttaaaagcaggattgaagaaaagggactgggggaaggaaacttattggaaaacttgatgcgaatgagtttctgcttggcacagtctctgcctgcttgctctcctttgctgatggattgcatttatcaaactattcatgctagcatttttccaacgagggaacttattccgcacgggcctactgtaggaccattgtctcgtgtaattaggaattttccatttgaaggattgctaaattgtcacagtagtaggaagtatagggaaacctctcagctgtggcactgttgtagctttggagtgcagagtgtaactctgggacaatcagatttcacatattctgtcatcttggcataagccattaaaagcttggagattactgtatttggcattaaaaaaaaatgtcacttaggtcagcactcccagacgtagcacagaaaaaccctttgacacaaaccatgtgttctgatttttggttcagaaaatattgaaactgtgagttgttttttttttaacaactgggaaaaaacaaaaacaaaaaactatagttagaaaaatggaagttccataggttctatttcttactctatgtatggctttgttttcagtctatttctaggagctttctctgaatcgctaattgtcctttcagttgaaatctaatttatacaatcattctatacttaaaggttaaatacatcttaattaattttttcttaaagtcaatgtaagtcactttgttttgtttttttttaatctacgccatatgcctcatgaaaccagctgttctagaatcagtcctgagaatatggcttaattccatggaaacataactcctatcttgggacctgacataatatctatctatcctggggaactggtaatatgagacttataggttacagcagaaatgctacatgttgacaaaagccttaatcgttccactgggagaactaattgataattgtgttaagattgaagattaaccctgtgttaatctcacttgagtctatcctgacagtagttcagattctggaaaatgataaactgacctgctagatgtagaattgtttcaaaattagtgttgaaataccttgttcacagatgaatatctgggcaggatctgagggtgtttggaatgacaccccccaatccagttgcatagatgggatgtctttgcaggtttgaggagatcatcgacctgcagagccccctttgacccagtacctcacgttttatttaaaatctaaatctggggccaggcgtggtggctcacgcctgtaatccaagcactttgggaggccgaagcgggtggatcacctgaggtcaggagtttgagaccatcctggccaacatggtgaaaccccgtctctactgaaaaaaatacaaaaattagctgggcatggtggtagcacgcgcctgtagtcccagctactcgggaggctgaggcaggataatcgcttgaacttggcgggtagaggttgcagtgagccaagatggtgccactacactgcagcctgggtggctgagcgagactccgtctcaaaaaaaaaatctaaatctgacatttgatgctatttttattaatattggaatgttctgtcttgaactttattcaatataatcaagaataaagatagagtaaacgtcactgatttgtactattaagagagaaaaaatatgccacacaactaaacataggtttaaattatgaagaaatttagaatagaggtttattagatttagggaacactaagaacaaaaaaggaaggagtgatacctgcctgagtggacagctgtaaatcagctgtaattactgcagttgtaccaatagttgtgagtggctccagtcactttaggagtccttggaagtacttggtacacatttgttggctgtaccttaaaggaagtggcaagtccagtttgttctctctaccacactagactgccactgacaagtttgggtctgttggattcaaaattttgtaagccattttcacaagtacaaagatacattttaaccttgtcttctccaaaattactgagtaggaattttatttttatctttttgagacagggtatcactgtcacccagactggagtgcagtggtgggatcttggcttactgtgacctctgcctcccgggttcaaatggtcctccctcctcagtctcctgagtagctgggacgacaggcacgtgccaccatgcccagctaatttgttctattttttctgtagagacggggttttgccatgttgcccaggctggtctcagactcctgggctcaagcgatcatttcgcctcagcctcccaaagtgctgagattataggtgtgagccacagcatctggcccagagtgaggagaattaatgagattttttgtgtgtgttagataatattgatttaagcctttttttaaaaagtactctcaaccaaatacaaaattgaaaatgtgaggtttaatagaaatgtgttggctatttgcaatggattttcttcttgcccaagtgtttggagttctactttatgctctgtatttaaaaattagtgacctcaaagcagagttgatgacacaggctttggggccctcatgttcttgtctttagaacatatcactactaagtatcagcttatcttcagaacattacaacattcaccgtgttcatatgctttctgagaagtcaccacttgtaatttcagatcacatacacctgaaggcattttatagttcctaaagttaacatgttagatcttttttttccaccccatgagggtctcactctcacccaggctggaatgcagtggtgtgattgtagcacactttggccaccaactcctgggctcaagtgatcctcctgctttggcctcctctgagaagctgggattactggtgcacaccaccacacctggctaattttttatttttttttatttttggaaatagggtatggctatgttgccttgggcccgtcatgaactcctagcctcaggtgaccctcccacctcaggcctcccaaagggttgggattacaggagtgagctactgcactgggccaacatgttaatttttttttttttttttttgagatggagtctcccaggcgggaatgcaatggtgcgatctcgacttcactgcaatcttcacctcccgggttcgagcgattctcccacctcagcctcctgagtagctgggattacaggcacctgccatcacgctcggctaatttttgtattttgagcagagatggagtttcaccatgttggccaggtgatctgcactcccactccccccacacttcccaaagtgctgggattacaggcataagccacaagccacctcacccagccaacatgttacatcttaattcttggattttcttcactgcagggctttgggtggagaaataaaactcttcaaatgcatgatcttggagatccctgtgaatcaataattctttagacaactgcggctcaaaatccctcctttcccttttccgagttattccatccatcttattagaaaggaagtgaattaggtgtaggtggtctgtaacacctgcacatctttttatacgtgtagagggtatgcctgggatatataggttgtcttcaagcagtagctgctactacagctagagagaggaggagtgccaggaaactgatgacctgagaccaagagtcttgttgatgttctgacttagataaaggttttgatcattttcatgaaataatgcagggaagtcatttctgctgtttctttactactccattcttggaggattagaacaagtcacactgtaattgactaaaacgactttttattttaaaatattgatggtggggttttgcttttttttttttttttttttttgagacgttgtcttgctctttcacccagggtagagtgcagtggcgaaatcttggctcactgcaacctctgcctcccgggttcaagcaattctctgcctcagcctcctgagaagctgggattacagcgcctgccaccatgcctgtctagtttttttgtatttttagtagagacaggggtttcaccaagttggccaggctggtcttgaactcctgacctcgtgatccacccacctcggcctcccaaagtgctgggattacaggcgtgagccaccgtgccgggccagtgtttttaactgtccacacttactaaattttccagtacttcttcctatggttcatgatagtaaacacagaaacatataaggaacattattagagttaccagatgttagctgttgcatatgtgcacattcctagattcaagggtgtttttgccttaaatttaagtgggtcattggttgtcttgggaagatcatggaaaattcgggattttttagaattctgaaccaaaatatgttttgagtgtttcttagtaaatgtgtgatcttccaccttccacattcagactgcggactacacttcataaatgcctttttatttccagttatggattcaactaaatgactgccttgggagcacataattactttgctacctttttccccctttgctgttgtggctcgagtttggttctcacctgagaagatgcattgagcatatgttgttacccagccctggcttaatggtgtcctgtggggtaggggtgggaggacgaggggcacggggccagagcatgtgaatggatcatggttggacagctgtgacctgccagcactgcgggtaagcaaaactacaaaccgttctttcctctgtgacattgaataaaccttaataaaattcataattagcacatactagaaaaaa

SEQ ID NO: 104332 - DNA, 2215 bp, Homo sapiens
  Payload ID: 496
  Gene Symbol: ACOX1
  Gene Name: acyl-CoA oxidase 1, palmitoyl
  Uniprot ID: Q15067
  ENST ID: ENST00000301608
  CDS Start-End: 62-2044
ggatttagattgtcactgccacctcggtcggtgcttacttcgctgccagctggtcgtcgccatgaacccggacctgcgcagggagcgggattccgccagcttcaacccggagctgcttacacacatcctggacggcagccccgagaaaacccggcgccgccgagagatcgagaacatgatcctgaacgacccagacttccagcatgaggacttgaacttcctcactcgcagccagcgttatgaggtggctgtcaggaaaagtgccatcatggtgaagaagatgagggagtttggcatcgctgaccctgatgaaattatgtggtttaaaaaactacatttggtcaattttgtggaacctgtgggcctcaattactccatgtttattcctaccttgctgaatcagggcaccactgctcagaaagagaaatggctgctttcatccaaaggactccagataattggcacctacgcccagacggaaatgggccacggaactcaccttcgaggcttggaaaccacagccacgtatgaccctgaaacccaggagttcattctcaacagtcctactgtgacctccattaaatggtggcctggtgggcttggaaagacttcaaatcatgcaatagttcttgcccagctcatcactaaggggaaatgctatggattacatgcctttatcgtacctattcgtgaaatcgggacccataagcctttgccaggaattaccgttggtgacatcggccccaaatttggttatgatgagatagacaatggctacctcaaaatggacaaccatcgtattcccagagaaaacatgctgatgaagtatgcccaggtgaagcctgatggcacatacgtgaaaccgctgagtaacaagctgacttacgggaccatggtgtttgtcaggtccttccttgtgggagaagctgctcgggctctgtctaaggcgtgcaccattgccatccgatacagcgctgtgaggcaccagtctgaaatcaagccaggtgaaccagaaccacagattttggattttcaaacccagcagtataaactctttccactcctggccactgcctatgccttccagtttgtgggcgcatacatgaaggagacctatcaccggattaacgaaggcattggtcaaggggacctgagtgaactgcctgagcttcatgccctcaccgctggactgaaggctttcacctcctggactgcaaacactggcattgaagcatgtcggatggcttgtggtgggcatggctattctcattgcagtggtcttccaaatatttatgtcaatttcaccccaagctgtacctttgagggagaaaacactgtcatgatgctccagacggctaggttcctgatgaaaagttatgatcaggtgcactcaggaaagttggtgtgtggcatggtgtcctatttgaacgacctgcccagtcagcgcatccagccacagcaggtagcagtctggccaaccatggtggatatcaacagccccgaaagcctaaccgaagcatataaactccgtgcagccagattagtagaaattgctgcaaaaaaccttcaaaaagaagtgattcacagaaaaagcaaggaggtagcttggaacctaacttctgttgaccttgttcgagcaagtgaggcacattgccactatgtggtagttaagctcttttcagaaaaactcctcaaaattcaagataaagccattcaagctgtcttaaggagtttatgtctgctgtattctctgtatggaatcagtcagaacgcgggggatttccttcaggggagcatcatgacagagcctcagattacacaagtaaaccagcgtgtaaaggagttactcactctgattcgctcagatgctgttgctttggttgatgcatttgattttcaggatgtgacacttggctctgtgcttggccgctatgatgggaatgtgtatgaaaacttgtttgagtgggctaagaactccccactgaacaaagcagaggtccacgaatcttacaagcacctgaagtcactgcagtccaagctctgaagtgtcacaaggacaagtttaatctgcttcagaaagcgcctgtgtgcaactcaaattttgtggaatctttttcgaattcaaatagctatagagcaaatgataaattgacccctttttataaatggagggaaaaaatgaacagatttcagagattaaatgaaaaaaagcaga

SEQ ID NO: 104333 - DNA, 2417 bp, Homo sapiens
  Payload ID: 496
  Gene Symbol: ACOX1
  Gene Name: acyl-CoA oxidase 1, palmitoyl
  ENST ID: ENST00000573078
  CDS Start-End: 56-727
agattgtcactgccacctcggtcggtgcttacttcgctgccagctggtcgtcgccatgaacccggacctgcgcagggagcgggattccgccagcttcaacccggagctgcttacacacatcctggacggcagccccgagaaaacccggcgccgccgagagatcgagaacatgatcctgaacgacccagacttccagcatgaggacttgaacttcctcactcgcagccagcgttatgaggtggctgtcaggaaaagtgccatcatggtgaagaagatgagggagtttggcatcgctgaccctgatgaaattatgtggtttaaaaaactacatttggtcaattttgtggaacctgtgggcctcaattactccatgtttattcctaccttgctgaatcagggcaccactgctcagaaagagaaatggctgctttcatccaaaggactccagataattggcacctacgcccagacggaaatgggccacgttttgtgcaccgagggcggcctgagcctctggatcttcacttgggcatgttcctgcccaccttgcttcaccaggcaactgcggagcagcaggagcgcttcttcatgcccgcctggaacttggagatcattggcacttatgcccagacagagatgggtcatggaactcaccttcgaggcttggaaaccacagccacgtatgaccctgaaacccaggagttcattctcaacagtcctactgtgacctccattaaatggtggcctggtgggcttggaaagacttcaaatcatgcaatagttcttgcccagctcatcactaaggggaaatgctatggattacatgcctttatcgtacctattcgtgaaatcgggacccataagcctttgccaggaattaccgttggtgacatcggccccaaatttggttatgatgagatagacaatggctacctcaaaatggacaaccatcgtattcccagagaaaacatgctgatgaagtatgcccaggtgaagcctgatggcacatacgtgaaaccgctgagtaacaagctgacttacgggaccatggtgtttgtcaggtccttccttgtgggagaagctgctcgggctctgtctaaggcgtgcaccattgccatccgatacagcgctgtgaggcaccagtctgaaatcaagccaggtgaaccagaaccacagattttggattttcaaacccagcagtataaactctttccactcctggccactgcctatgccttccagtttgtgggcgcatacatgaaggagacctatcaccggattaacgaaggcattggtcaaggggacctgagtgaactgcctgagcttcatgccctcaccgctggactgaaggctttcacctcctggactgcaaacactggcattgaagcatgtcggatggcttgtggtgggcatggctattctcattgcagtggtcttccaaatatttatgtcaatttcaccccaagctgtacctttgagggagaaaacactgtcatgatgctccagacggctaggttcctgatgaaaagttatgatcaggtgcactcaggaaagttggtgtgtggcatggtgtcctatttgaacgacctgcccagtcagcgcatccagccacagcaggtagcagtctggccaaccatggtggatatcaacagccccgaaagcctaaccgaagcatataaactccgtgcagccagattagtagaaattgctgcaaaaaaccttcaaaaagaagtgattcacagaaaaagcaaggaggtagcttggaacctaacttctgttgaccttgttcgagcaagtgaggcacattgccactatgtggtagttaagctcttttcagaaaaactcctcaaaattcaagataaagccattcaagctgtcttaaggagtttatgtctgctgtattctctgtatggaatcagtcagaacgcgggggatttccttcaggggagcatcatgacagagcctcagattacacaagtaaaccagcgtgtaaaggagttactcactctgattcgctcagatgctgttgctttggttgatgcatttgattttcaggatgtgacacttggctctgtgcttggccgctatgatgggaatgtgtatgaaaacttgtttgagtgggctaagaactccccactgaacaaagcagaggtccacgaatcttacaagcacctgaagtcactgcagtccaagctctgaagtgtcacaaggacaagtttaatctgcttcagaaagcgcctgtgtgcaactcaaattttgtggaatctttttcgaattcaaatagctatagagcaaatgataaattgacccctttttataaatggagggaaaaaatgaacagatttcagagattaaatgaaaaaaagcagatgttttaagtgcaattaacactgaaagagacctgttaaaccattcag

SEQ ID NO: 104334 - DNA, 2441 bp, Homo sapiens
  Payload ID: 496
  Gene Symbol: ACOX1
  Gene Name: acyl-CoA oxidase 1, palmitoyl
  ENST ID: ENST00000572047
  CDS Start-End: 1-216
atgaacccggacctgcgcagggagcgggattccgccagcttcaacccggagctgcttacacacatcctggacggcagccccgagaaaacccggcgccgccgagagatcggtgagggcggcgggcgagacctccctcctttcccgagaaaagctggagactccctcgatgcggagtcaggggcgctgtggggcctaggccctctggcccagcgttaggggagccgggacccccacttcgaggaacagcctgtgtccctggtggggggatatcgccattccccagagaacatgatcctgaacgacccagacttccagcatgaggacttgaacttcctcactcgcagccagcgttatgaggtggctgtcaggaaaagtgccatcatggtgaagaagatgagggagtttggcatcgctgaccctgatgaaattatgtggtttaaaaattttgtgcaccgagggcggcctgagcctctggatcttcacttgggcatgttcctgcccaccttgcttcaccaggcaactgcggagcagcaggagcgcttcttcatgcccgcctggaacttggagatcattggcacttatgcccagacagagatgggtcatggaactcaccttcgaggcttggaaaccacagccacgtatgaccctgaaacccaggagttcattctcaacagtcctactgtgacctccattaaatggtggcctggtgggcttggaaagacttcaaatcatgcaatagttcttgcccagctcatcactaaggggaaatgctatggattacatgcctttatcgtacctattcgtgaaatcgggacccataagcctttgccaggaattaccgttggtgacatcggccccaaatttggttatgatgagatagacaatggctacctcaaaatggacaaccatcgtattcccagagaaaacatgctgatgaagtatgcccaggtgaagcctgatggcacatacgtgaaaccgctgagtaacaagctgacttacgggaccatggtgtttgtcaggtccttccttgtgggagaagctgctcgggctctgtctaaggcgtgcaccattgccatccgatacagcgctgtgaggcaccagtctgaaatcaagccaggtgaaccagaaccacagattttggattttcaaacccagcagtataaactctttccactcctggccactgcctatgccttccagtttgtgggcgcatacatgaaggagacctatcaccggattaacgaaggcattggtcaaggggacctgagtgaactgcctgagcttcatgccctcaccgctggactgaaggctttcacctcctggactgcaaacactggcattgaagcatgtcggatggcttgtggtgggcatggctattctcattgcagtggtcttccaaatatttatgtcaatttcaccccaagctgtacctttgagggagaaaacactgtcatgatgctccagacggctaggttcctgatgaaaagttatgatcaggtgcactcaggaaagttggtgtgtggcatggtgtcctatttgaacgacctgcccagtcagcgcatccagccacagcaggtagcagtctggccaaccatggtggatatcaacagccccgaaagcctaaccgaagcatataaactccgtgcagccagattagtagaaattgctgcaaaaaaccttcaaaaagaagtgattcacagaaaaagcaaggaggtagcttggaacctaacttctgttgaccttgttcgagcaagtgaggcacattgccactatgtggtagttaagctcttttcagaaaaactcctcaaaattcaagataaagccattcaagctgtcttaaggagtttatgtctgctgtattctctgtatggaatcagtcagaacgcgggggatttccttcaggggagcatcatgacagagcctcagattacacaagtaaaccagcgtgtaaaggagttactcactctgattcgctcagatgctgttgctttggttgatgcatttgattttcaggatgtgacacttggctctgtgcttggccgctatgatgggaatgtgtatgaaaacttgtttgagtgggctaagaactccccactgaacaaagcagaggtccacgaatcttacaagcacctgaagtcactgcagtccaagctctgaagtgtcacaaggacaagtttaatctgcttcagaaagcgcctgtgtgcaactcaaattttgtggaatctttttcgaattcaaatagctatagagcaaatgataaattgacccctttttataaatggagggaaaaaatgaacagatttcagagattaaatgaaaaaaagcagatgttttaagtgcaattaacactgaaagagacctgttaaaccattcagaaaaagcttaagaaatgcgatatgacttccttttgtaatgctgctgatcccagtagactatgactt

SEQ ID NO: 104335 - DNA, 637 bp, Homo sapiens
  Payload ID: 496
  Gene Symbol: ACOX1
  Gene Name: acyl-CoA oxidase 1, palmitoyl
  ENST ID: ENST00000576743
  CDS Start-End: 1-326
agaacatgatcctgaacgacccagacttccagcatgaggacttgaacttcctcactcgcagccagcgttatgaggtggctgtcaggaaaagtgccatcatggtgaagaagatgagggagtttggcatcgctgaccctgatgaaattatgtggtttaaaaaactacatttggtcaattttgtggaacctgtgggcctcaattactccatgtttattcctaccttgctgaatcagggcaccactgctcagaaagagaaatggctgctttcatccaaaggactccagataattggcacctacgcccagacggaaatgggccacggttagtccacattgagggtctgtgggtaacccacctcaggacatcagttaacagtgattgctggcatttgacttttttctgctgctacctgtttgggattctatttttaagttgttaagtcaaaattcaacttcttgttttctcctagacattttccctggaaactggtccagggctctggcctataaacgtcattcactgttatttcctaaagccttttattattgaacagcttgaaaagatggggtttacagtgcagcggggaaccccattatgttactctgggtctaatgagtaaagactttgttggaaattc

SEQ ID NO: 104336 - DNA, 574 bp, Homo sapiens
  Payload ID: 496
  Gene Symbol: ACOX1
  Gene Name: acyl-CoA oxidase 1, palmitoyl
  ENST ID: ENST00000588176
  CDS Start-End: 105-574
gtcctgaggctgcctcctagggtccggccggcgctggagctgcggatttagattgtcactgccacctcggtcggtgcttacttcgctgccagctggtcgtcgccatgaacccggacctgcgcagggagcgggattccgccagcttcaacccggagctgcttacacacatcctggacggcagccccgagaaaacccggcgccgccgagagatcgagaacatgatcctgaacgacccagacttccagcatgaggacttgaacttcctcactcgcagccagcgttatgaggtggctgtcaggaaaagtgccatcatggtgaagaagatgagggagtttggcatcgctgaccctgatgaaattatgtggtttaaaaaactacatttggtcaattttgtggaacctgtgggcctcaattactccatgtttattcctaccttgctgaatcagggcaccactgctcagaaagagaaatggctgctttcatccaaaggactccagataattggcacctacgcccagacggaaatgggccacgttggaaagacttcaaatcatgcaatagttcttgcccagct

SEQ ID NO: 104337 - DNA, 775 bp, Homo sapiens
  Payload ID: 496
  Gene Symbol: ACOX1
  Gene Name: acyl-CoA oxidase 1, palmitoyl
  ENST ID: ENST00000587927
  CDS Start-End: 1-398
cacattgccactatgtggtagttaagctcttttcagaaaaactcctcaaaattcaagataaagccattcaagctgtcttaaggagtttatgtctgctgtattctctgtatggaatcagtcagaacgcgggggatttccttcaggggagcatcatgacagagcctcagattacacaagtaaaccagcgtgtaaaggagttactcactctgattcgctcagatgctgttgctttggttgatgcatttgattttcaggatgtgacacttggctctgtgcttggccgctatgatgggaatgtgtatgaaaacttgtttgagtgggctaagaactccccactgaacaaagcagaggtccacgaatcttacaagcacctgaagtcactgcagtccaagctctgaagtgtcacaaggacaagtttaatctgcttcagaaagcgcctatggagtctcccaggcgggaatgcaatggtgcgatctcgacttcactgcaatcttcacctcccgggttcgagcgattctcccacctcagcctcctgagtagctgggattacaggcacctgccatcacgctcggctaatttttgtattttgagcagagatggagtttcaccatgttggccaggtgatctgcactcccactccccccacacttcccaaagtgctgggattacaggcataagccacaagccacctcacccagccaacatgttacatcttaattcttggattttcttcactgcagggctttgggtggagaaataaaactcttcaaatgca

SEQ ID NO: 104338 - DNA, 550 bp, Homo sapiens
  Payload ID: 496
  Gene Symbol: ACOX1
  Gene Name: acyl-CoA oxidase 1, palmitoyl
  ENST ID: ENST00000589301
  CDS Start-End: 56-271
agattgtcactgccacctcggtcggtgcttacttcgctgccagctggtcgtcgccatgaacccggacctgcgcagggagcgggattccgccagcttcaacccggagctgcttacacacatcctggacggcagccccgagaaaacccggcgccgccgagagatcggtgagggcggcgggcgagacctccctcctttcccgagaaaagctggagactccctcgatgcggagtcaggggcgctgtggggcctaggccctctggcccagcgttaggggagccgggacccccacttcgaggaacagcctgtgtccctggtggggggatatcgccattccccagagaacatgatcctgaacgacccagacttccagcatgaggacttgaacttcctcactcgcagccagcgttatgaggtggctgtcaggaaaagtgccatcatggtgaagaagatgagggagtttggcatcgctgaccctgatgaaattatgtggtttaaaaagaactcaccttcgaggcttggaaaccacagccacgtatgaccctgaaaccca

SEQ ID NO: 104339 - DNA, 706 bp, Homo sapiens
  Payload ID: 496
  Gene Symbol: ACOX1
  Gene Name: acyl-CoA oxidase 1, palmitoyl
  ENST ID: ENST00000588968
  CDS Start-End: 1-461
ggaacctaacttctgttgaccttgttcgagcaagtgaggcacattgccactatgtggtagttaagctcttttcagaaaaactcctcaaaattcaagataaagccattcaagctgtcttaaggagtttatgtctgctgtattctctgtatggaatcagtcagaacgcgggggatttccttcaggggagcatcatgacagagcctcagattacacaagtaaaccagcgtgtaaaggagttactcactctgattcgctcagatgctgttgctttggttgatgcatttgattttcaggatgtgacacttggctctgtgcttggccgctatgatgggaatgtgtatgaaaacttgtttgagtgggctaagaactccccactgaacaaagcagagggctttgggtggagaaataaaactcttcaaatgcatgatcttggagatccctgtgaatcaataattctttagacaactgcggctcaaaatccctcctttcccttttccgagttattccatccatcttattagaaaggaagtgaattaggtgtaggtggtctgtaacacctgcacatctttttatacgtgtagagggtatgcctgggatatataggttgtcttcaagcagtagctgctactacagctagagagaggaggagtgccaggaaactgatgacctgagaccaagagtcttgttgatgttctgacttagataa

SEQ ID NO: 104340 - DNA, 2426 bp, Homo sapiens
  Payload ID: 497
  Gene Symbol: ACOX2
  Gene Name: acyl-CoA oxidase 2, branched chain
  Uniprot ID: Q99424
  ENST ID: ENST00000302819
  CDS Start-End: 293-2338
acaagggcttgagagcagacaagggcttgagagcagacaagggcttgagagctggccaagcagtttctctcagcttctgtgttccagcccctatgtgggaggagagaagggcaggaccacaagcctgccagaggctgcggcctacagccggggagaggccagcccggcctacagtgcggacacaggacagaggggagccaggttctttgcactgaccaatgctgagagcagaccctcggagcagccgggttggaagtgtctctccatagtcaccagacagatccaggataggatgggcagcccagtgcaccgagtgtcattgggggatacctggagcaggcaaatgcaccccgacatagagagcgagaggtatatgcagtcctttgacgtggaacggctcaccaacatccttgatggaggtgcccagaacactgcactccgcaggaaagttgagagcatcatccacagttacccggagtttagctgtaaggacaattatttcatgacccagaatgagcgttataaggctgccatgcggagggcattccacatccggttgatagctcggcgcctgggttggttagaagatggtcgtgaattaggctacgcttacagagccctttctggagacgtggccttaaatatacacagagtcttcgtgagagccctcaggagcctgggctcagaggagcagattgccaaatgggacccactctgcaaaaacatccagatcatcgcaacgtatgcacagacagagttgggacatgggacatatcttcagggcctggagactgaagccacctatgacgcagccacccaggagtttgtgatacacagccccacgctgactgccaccaaatggtggcctggagacttgggacggtcagccacccatgccctggtccaggcccagctgatctgctcaggagccaggcggggcatgcacgcttttattgtgccaatccggagtcttcaggaccacaccccactgccaggaatcatcattggggacatcggacccaagatggactttgatcaaacagacaatggcttcctgcagctgaaccatgtgcgggtccccagggagaacatgctgagtcgctttgcacaggtcttgccagatggcacctacgtcaaactcggtacagcacagagcaactaccttcccatggtggtggtgcgggtggagctgctgtcaggggagatcctccctatactgcagaaggcctgtgtcatcgccatgcgctactcggtcatccgccgccaatcccggctccggcccagtgacccagaggcaaaggtcctggactaccagacacaacagcagaaactctttcctcagctggccatcagttatgccttccatttcctggcagtcagcctcttggagttcttccagcactcctacactgccattctgaaccaagacttcagcttcctgcctgagctccacgcactgagcacgggcatgaaggccatgatgtcagaattctgcacccagggagctgagatgtgccgcagggcctgtggcggacatggctactcaaagctgagtggcctgccatcactggtcaccaaattgtcggcctcctgtacctacgagggtgagaacacagtgctctacctgcaggtggccaggttcctggtgaagagctacctgcagactcagatgtcccctggctccacgccacagagatctctctctccatctgtcgcatatctcaccgcacctgacctggccaggtgtccagcccagagggcagccgacttcctctgcccggagctctacaccacggcctgggcacatgtggcagtaaggctcataaaggactcagtgcagcatttacagaccctgacgcaatccggagctgaccagcacgaggcttggaaccagaccactgtcatacacctccaggctgctaaggtgcactgctactatgtcactgtgaagggttttacagaagctctggagaaactagaaaatgaaccagcgattcagcaggtgctcaagcgcctctgtgacctccatgccatacatggaatcttgactaactcgggtgactttctccatgacgccttcctgtctggtgcccaagtggacatggcaagaacagcctacctggacctgctccgcctgatccggaaggatgccatcctgttaactgatgcttttgacttcaccgatcagtgtttaaattcagcacttggctgttatgatggaaacgtctacgaacgcctgttccagtgggctcagaagtcaccaaccaatactcaggagaaccctgcctatgaggaatatataagaccacttttacaaagttggagatccaagctatgaaataaccaacagtattcaagaagcaaccagcaccatcatgtgataatggtactatggcatatatgcaacattaaaattttaaattaga

SEQ ID NO: 104341 - DNA, 540 bp, Homo sapiens
  Payload ID: 497
  Gene Symbol: ACOX2
  Gene Name: acyl-CoA oxidase 2, branched chain
  ENST ID: ENST00000460921
  CDS Start-End: 1-282
gaagctctggagaaactagaaaatgaaccagcgattcagcaggtgctcaagcgcctctgtgacctccatgccatacatggaatcttgactaactcgggtgactttctccatgacgccttcctgtctggtgcccaagtggacatggcaagaacagcctacctggacctgctccgcctgatccgtgaaatacgatgtaaagccatccaggcaaaagagatgggaaaggtggatagtgtcaatctgaggatcaaagagatggaaggatgccatcctgttaactgatgcttttgacttcaccgatcagtgtttaaattcagcacttggctgttatgatggaaacgtctacgaacgcctgttccagtgggctcagaagtcaccaaccaatactcaggagaaccctgcctatgaggaatatataagaccacttttacaaagttggagatccaagctatgaaataaccaacagtattcaagaagcaaccagcaccatcatgtgataatggtactatggcatatatgcaacattaaaattttaaatta

SEQ ID NO: 104342 - DNA, 869 bp, Homo sapiens
  Payload ID: 497
  Gene Symbol: ACOX2
  Gene Name: acyl-CoA oxidase 2, branched chain
  ENST ID: ENST00000489472
  CDS Start-End: 1-324
gggacatatcttcagggcctggagactgaagccacctatgacgcagccacccaggagtttgtgatacacagccccacgctgactgccaccaaatggtggcctggagacttgggacggtcagccacccatgccctggtccaggcccagctgatctgctcaggagccaggcggggcatgcacgcttttattgtgccaatccggagtcttcaggaccacaccccactgccaggtgtcctcatctccatctccttcaaggaatcatcattggggacatcggacccaagatggactttgatcaaacagacaatggcttcctgcagctgaaccatgtgcgggtccccagggagaacatgctgagtcgctttgcacagtgacccagaggcaaaggtcctggactaccagacacaacagcagaaactctttcctcagctggccatcagttatgccttccatttcctggcagtcagcctcttggagttcttccagcactcctacactgccattctgaaccaagacttcagcttcctgcctgagctccacgcactgagcacgggcatgaaggccatgatgtcagaattctgcacccagggagctgagatgtgccgcagggcctgtggcggacatggctactcaaagctgagtggcctgccatcactggtcaccaaattgtcggcctcctgtacctacgagggtgagaacacagtgctctacctgcaggtggccaggttcctggtgaagagctacctgcagactcagatgtcccctggctccacgccacagagatctctctctccatctgtcgcatatctcaccgcacctgacctggccaggtgtccagcccagagggcagccgacttcctctgcccgga

SEQ ID NO: 104343 - DNA, 2348 bp, Homo sapiens
  Payload ID: 497
  Gene Symbol: ACOX2
  Gene Name: acyl-CoA oxidase 2, branched chain
  ENST ID: ENST00000459701
  CDS Start-End: 257-2260
acaagggcttgagagctggccaagcagtttctctcagcttctgtgttccagcccctatgtgggaggagagaagggcaggaccacaagcctgccagaggctgcggcctacagccggggagaggccagcccggcctacagtgcggacacaggacagaggggagccaggttctttgcactgaccaatgctgagagcagaccctcggagcagccgggttggaagtgtctctccatagtcaccagacagatccaggataggatgggcagcccagtgcaccgagtgtcattgggggatacctggagcaggcaaatgcaccccgacatagagagcgagaggtatatgcagtcctttgacgtggaacggctcaccaacatccttgatggaggtgcccagaacactgcactccgcaggaaagttgagagcatcatccacagttacccggagtttagctgtaaggacaattatttcatgacccagaatgagcgttataaggctgccatgcggagggcattccacatccggttgatagctcggcgcctgggttggttagaagatggtcgtgaattaggctacgcttacagagccctttctggagacgtggccttaaatatacacagagtcttcgtgagagccctcaggagcctgggctcagaggagcagattgccaaatgggacccactctgcaaaaacatccagatcatcgcaacgtatgcacagacagagttgggacatgggacatatcttcagggcctggagactgaagccacctatgacgcagccacccaggagtttgtgatacacagccccacgctgactgccaccaaatggtggcctggagacttgggacggtcagccacccatgccctggtccaggcccagctgatctgctcaggagccaggcggggcatgcacgcttttattgtgccaatccggagtcttcaggaccacaccccactgccaggaatcatcattggggacatcggacccaagatggactttgatcaaacagacaatggcttcctgcagctgaaccatgtcttgccagatggcacctacgtcaaactcggtacagcacagagcaactaccttcccatggtggtggtgcgggtggagctgctgtcaggggagatcctccctatactgcagaaggcctgtgtcatcgccatgcgctactcggtcatccgccgccaatcccggctccggcccagtgacccagaggcaaaggtcctggactaccagacacaacagcagaaactctttcctcagctggccatcagttatgccttccatttcctggcagtcagcctcttggagttcttccagcactcctacactgccattctgaaccaagacttcagcttcctgcctgagctccacgcactgagcacgggcatgaaggccatgatgtcagaattctgcacccagggagctgagatgtgccgcagggcctgtggcggacatggctactcaaagctgagtggcctgccatcactggtcaccaaattgtcggcctcctgtacctacgagggtgagaacacagtgctctacctgcaggtggccaggttcctggtgaagagctacctgcagactcagatgtcccctggctccacgccacagagatctctctctccatctgtcgcatatctcaccgcacctgacctggccaggtgtccagcccagagggcagccgacttcctctgcccggagctctacaccacggcctgggcacatgtggcagtaaggctcataaaggactcagtgcagcatttacagaccctgacgcaatccggagctgaccagcacgaggcttggaaccagaccactgtcatacacctccaggctgctaaggtgcactgctactatgtcactgtgaagggttttacagaagctctggagaaactagaaaatgaaccagcgattcagcaggtgctcaagcgcctctgtgacctccatgccatacatggaatcttgactaactcgggtgactttctccatgacgccttcctgtctggtgcccaagtggacatggcaagaacagcctacctggacctgctccgcctgatccggaaggatgccatcctgttaactgatgcttttgacttcaccgatcagtgtttaaattcagcacttggctgttatgatggaaacgtctacgaacgcctgttccagtgggctcagaagtcaccaaccaatactcaggagaaccctgcctatgaggaatatataagaccacttttacaaagttggagatccaagctatgaaataaccaacagtattcaagaagcaaccagcaccatcatgtgataatggtactatggcatatatgcaacattaaaattttaaattaga

SEQ ID NO: 104344 - DNA, 578 bp, Homo sapiens
  Payload ID: 497
  Gene Symbol: ACOX2
  Gene Name: acyl-CoA oxidase 2, branched chain
  ENST ID: ENST00000492530
  CDS Start-End: 1-41
gtgcccagaacactgcactccgcaggaaagttgatccatgaagcaagtgggtgagaagatttcaaggtgccagaaacctcacccaggtccctaagccctctgttctctgtcctctgcagagagcatcatccacagttacccggagtttagctagccctttctggagacgtggccttaaatatacacagagtcttcgtgagagccctcaggagcctgggctcagaggagcagattgccaaatgggacccactctgcaaaaacatccagatcatcgcaacgtatgcacagacagagttgggacatgggacatatcttcagggcctggagactgaagccacctatgacgcagccacccaggagtttgtgatacacagccccacgctgactgccaccaaatggtggcctggagacttgggacggtcagccacccatgccctggtccaggcccagctgatctgctcaggagccaggcggggcatgcacgcttttattgtgccaatccggagtcttcaggaccacaccccactgccaggaatcatcattggggacatcggacccaagatggactttgatcaaac

SEQ ID NO: 104345 - DNA, 708 bp, Homo sapiens
  Payload ID: 497
  Gene Symbol: ACOX2
  Gene Name: acyl-CoA oxidase 2, branched chain
  ENST ID: ENST00000474098
  CDS Start-End: 195-708
ctacagccggggagaggccagcccggcctacagtgcggacacaggacagaggggagccagccctggctgacacccagccctaggcagttcctcttgcacacaggttctttgcactgaccaatgctgagagcagaccctcggagcagccgggttggaagtgtctctccatagtcaccagacagatccaggataggatgggcagcccagtgcaccgagtgtcattgggggatacctggagcaggcaaatgcaccccgacatagagagcgagaggtatatgcagtcctttgacgtggaacggctcaccaacatccttgatggaggtgcccagaacactgcactccgcaggaaagttgagagcatcatccacagttacccggagtttagctgtaaggacaattatttcatgacccagaatgagcgttataaggctgccatgcggagggcattccacatccggttgatagctcggcgcctgggttggttagaagatggtcgtgaattaggctacgcttacagagccctttctggagacgtggccttaaatatacacagagtcttcgtgagagccctcaggagcctgggctcagaggagcagattgccaaatgggacccactctgcaaaaacatccagatcatcgcaacgtatgcacagacagagttgggacatgggacatatcttcagggcctggagactgaagccacctatg

SEQ ID NO: 104346 - DNA, 2860 bp, Homo sapiens
  Payload ID: 498
  Gene Symbol: ACOX3
  Gene Name: acyl-CoA oxidase 3, pristanoyl
  Uniprot ID: O15254
  ENST ID: ENST00000356406
  CDS Start-End: 79-2181
cgccgctggagatcctttcctgcttttggtttccctggcaggggttgaactgtggagtgtgtgggctcttatcacgcgatggcatccactgtggaaggaggcgacacagctctgctcccagaattccccagggggcccctcgatgcctaccgagcaagagcgtccttcagctggaaggagctggcgctgttcacggaaggggagggcatgctccgctttaagaaaaccatcttctcagctcttgagaatgaccctcttttcgctcgttcccctggagccgatctgtccttggagaagtatcgcgagctgaacttccttcgatgcaagcggatcttcgagtatgacttcctcagtgtcgaagacatgttcaagagccctctgaaggtccccgccttgattcagtgcctgggcatgtatgactcttctctggctgccaagtacctcctccatagcttggtttttggatcagcagtttacagttctggttctgaaagacatctcacatatattcaaaagatcttcaggatggagatttttggatgttttgctctgaccgaattaagccacggcagtaataccaaggccattcgcacaactgcccactacgatcctgccactgaggaattcatcatacattcccctgatttcgaagctgccaagttttgggttggcaacatgggcaagacagccactcacgcggtggtgtttgctaagctgtgtgtgccaggggaccagtgccatgggctgcatccctttatcgtgcagatccgggacccgaagacccttcttcccatgcctggagtgatggttggcgacataggaaaaaaactcgggcagaacggtctggataatggtttcgccatgttccacaaggtcagagttcctcgccagagccttctgaaccggatgggagacgtcacccccgagggcacctatgtcagcccctttaaggacgtcaggcagcgctttggagcgtccctggggagcctgtcctcgggccgggtctccatcgtgagcctggccatccttaacctaaagctggccgtggccatcgctcttcgcttctcagccactcggcgtcagtttggacccacagaggaggaggaaataccagtgcttgagtatccaatgcagcaatggcgcttgcttccatatctggcagctgtctacgccttagaccatttctccaagtcgctcttcctggacctggtggagctccagcgaggacttgcatcgggagaccgcagcgccagacaggcagagcttggacgtgagatccacgccctggcatcggccagcaagcccctggcctcgtggaccacccagcaaggaattcaggaatgccgggaggcgtgtggaggacacggctatctggccatgaaccggttgggtgtccttagagatgacaacgatcccaactgcacatacgaaggtgacaacaacatcctgctgcagcagacaagcaactatttgctgggtctcctggcacaccaggtccacgatggagcttgcttccgcagtccgctgaagtcagtggactttctggacgcctatcccggcatccttgaccagaagtttgaggtctccagtgttgccgactgcttggactctgcagtcgccctggcagcatacaagtggctggtttgctacctgctccgagagacttatcaaaaattaaaccaagagaaaagatcaggaagcagtgactttgaagcaaggaacaaatgccaggtgtcccacggccgtccgttggcgctggccttcgtggagctcacggtggtccagaggttccacgagcacgtgcaccagccttccgtgccgccctcgctgcgggccgtgctggggcggctcagtgctctgtacgccctgtggtccctgagccgccacgcggccctgctctaccgaggaggatacttctccggtgagcaggcgggagaagtgttggagagcgccgtcctggctttgtgttcccagctgaaagacgatgcagttgccctggtagacgtgatcgctcctcctgactttgttctggactcaccgattggcagagccgacggcgagctctacaaaaacctctggggcgctgtcctgcaggaaagcaaggtgttggagcgggcatcctggtggccagagttttctgtgaacaaacctgtcataggaagtctgaaatcgaagctctagtgggactggcacacattcagccaagtctaatgaaacgaagggaactaatcagacgtggacctcaacttctgattccagaacacgccggagattgctgctgctttctgagcccgcacctgtgcgcctaaactgctgattggcctcaactgcccaggcggacgggagggaggcacccggccggctggactaatctgggatcgcggtgatttgcagcgtggaaaagaaatgcagatgatcatgtctacctgatgcgccgtgggttttttgataattagaatttcgcacattcagttttcagggttcagctcctttctctaaagtaaacagcccattgtcagggatcttctggtcagacaacctgtgattcatctagattttttaccgagctccacttcattgagaagtcaatgatgccagtctggttctttgtcaactctccctcggctttgtcacataattgaattatgtcataaccttattaatttgcacatagatcatctgaatgtcgtggtttaagacttaaggaggaacatctgtttgattactttcttttgtggaactggaaatttccatcgaggaaatgtttttttaaaaagtctaatgatttgaatgggcaattcagtctccaaccgcccccctccccctgccgccagttatatacaaatcactttattggtaa

SEQ ID NO: 104347 - DNA, 2374 bp, Homo sapiens
  Payload ID: 498
  Gene Symbol: ACOX3
  Gene Name: acyl-CoA oxidase 3, pristanoyl
  Uniprot ID: O15254
  ENST ID: ENST00000413009
  CDS Start-End: 91-1965
aaatgagaatggcgccgctggagatcctttcctgcttttggtttccctggcaggggttgaactgtggagtgtgtgggctcttatcacgcgatggcatccactgtggaaggaggcgacacagctctgctcccagaattccccagggggcccctcgatgcctaccgagcaagagcgtccttcagctggaaggagctggcgctgttcacggaaggggagggcatgctccgctttaagaaaaccatcttctcagctcttgagaatgaccctcttttcgctcgttcccctggagccgatctgtccttggagaagtatcgcgagctgaacttccttcgatgcaagcggatcttcgagtatgacttcctcagtgtcgaagacatgttcaagagccctctgaaggtccccgccttgattcagtgcctgggcatgtatgactcttctctggctgccaagtacctcctccatagcttggtttttggatcagcagtttacagttctggttctgaaagacatctcacatatattcaaaagatcttcaggatggagatttttggatgttttgctctgaccgaattaagccacggcagtaataccaaggccattcgcacaactgcccactacgatcctgccactgaggaattcatcatacattcccctgatttcgaagctgccaagttttgggttggcaacatgggcaagacagccactcacgcggtggtgtttgctaagctgtgtgtgccaggggaccagtgccatgggctgcatccctttatcgtgcagatccgggacccgaagacccttcttcccatgcctggagtgatggttggcgacataggaaaaaaactcgggcagaacggtctggataatggtttcgccatgttccacaaggtcagagttcctcgccagagccttctgaaccggatgggagacgtcacccccgagggcacctatgtcagcccctttaaggacgtcaggcagcgctttggagcgtccctggggagcctgtcctcgggccgggtctccatcgtgagcctggccatccttaacctaaagctggccgtggccatcgctcttcgcttctcagccactcggcgtcagtttggacccacagaggaggaggaaataccagtgcttgagtatccaatgcagcaatggcgcttgcttccatatctggcagctgtctacgccttagaccatttctccaagtcgctcttcctggacctggtggagctccagcgaggacttgcatcgggagaccgcagcgccagacaggcagagcttggacgtgagatccacgccctggcatcggccagcaagcccctggcctcgtggaccacccagcaaggaattcaggaatgccgggaggcgtgtggaggacacggctatctggccatgaaccggttgggtgtccttagagatgacaacgatcccaactgcacatacgaaggtgacaacaacatcctgctgcagcagacaagcaactatttgctgggtctcctggcacaccaggtccacgatggagcttgcttccgcagtccgctgaagtcagtggactttctggacgcctatcccggcatccttgaccagaagtttgaggtctccagtgttgccgactgcttggactctgcagtcgccctggcagcatacaagtggctggtttgctacctgctccgagagacttatcaaaaattaaaccaagagaaaagatcaggaagcagtgactttgaagcaaggaacaaatgccaggtgtcccacggccgtccgttggcgctggccttcgtggagctcacggtggtccagaggttccacgagcacgtgcaccagccttccgtgccgccctcgctgcgggccgtgctggggcggctcagtgctctgtacgccctgtggtccctgagccgccacgcggccctgctctaccgagctgaaagacgatgcagttgccctggtagacgtgatcgctcctcctgactttgttctggactcaccgattggcagagccgacggcgagctctacaaaaacctctggggcgctgtcctgcaggaaagcaaggtgttggagcgggcatcctggtggccagagttttctgtgaacaaacctgtcataggaagtctgaaatcgaagctctagtgggactggcacacattcagccaagtctaatgaaacgaagggaactaatcagacgtggacctcaacttctgattccagaacacgccggagattgctgctgctttctgagcccgcacctgtgcgcctaaactgctgattggcctcaactgcccaggcggacgggagggaggcacccggccggctggactaatctgggatcgcggtgatttgcagcgtggaaaagaaatgcagatgatcatgtctacctga

SEQ ID NO: 104348 - DNA, 2253 bp, Homo sapiens
  Payload ID: 498
  Gene Symbol: ACOX3
  Gene Name: acyl-CoA oxidase 3, pristanoyl
  Uniprot ID: O15254
  ENST ID: ENST00000503233
  CDS Start-End: 151-2253
atgggacggacggaggccgagaggcgtggcgggggagcagtggggccaggccagagacagctgcgctgtgcgggcagctagtcccagtactccgagtcggtcgcgggccgacaggcatcccctgagcgcctgctgggctcttatcacgcgatggcatccactgtggaaggaggcgacacagctctgctcccagaattccccagggggcccctcgatgcctaccgagcaagagcgtccttcagctggaaggagctggcgctgttcacggaaggggagggcatgctccgctttaagaaaaccatcttctcagctcttgagaatgaccctcttttcgctcgttcccctggagccgatctgtccttggagaagtatcgcgagctgaacttccttcgatgcaagcggatcttcgagtatgacttcctcagtgtcgaagacatgttcaagagccctctgaaggtccccgccttgattcagtgcctgggcatgtatgactcttctctggctgccaagtacctcctccatagcttggtttttggatcagcagtttacagttctggttctgaaagacatctcacatatattcaaaagatcttcaggatggagatttttggatgttttgctctgaccgaattaagccacggcagtaataccaaggccattcgcacaactgcccactacgatcctgccactgaggaattcatcatacattcccctgatttcgaagctgccaagttttgggttggcaacatgggcaagacagccactcacgcggtggtgtttgctaagctgtgtgtgccaggggaccagtgccatgggctgcatccctttatcgtgcagatccgggacccgaagacccttcttcccatgcctggagtgatggttggcgacataggaaaaaaactcgggcagaacggtctggataatggtttcgccatgttccacaaggtcagagttcctcgccagagccttctgaaccggatgggagacgtcacccccgagggcacctatgtcagcccctttaaggacgtcaggcagcgctttggagcgtccctggggagcctgtcctcgggccgggtctccatcgtgagcctggccatccttaacctaaagctggccgtggccatcgctcttcgcttctcagccactcggcgtcagtttggacccacagaggaggaggaaataccagtgcttgagtatccaatgcagcaatggcgcttgcttccatatctggcagctgtctacgccttagaccatttctccaagtcgctcttcctggacctggtggagctccagcgaggacttgcatcgggagaccgcagcgccagacaggcagagcttggacgtgagatccacgccctggcatcggccagcaagcccctggcctcgtggaccacccagcaaggaattcaggaatgccgggaggcgtgtggaggacacggctatctggccatgaaccggttgggtgtccttagagatgacaacgatcccaactgcacatacgaaggtgacaacaacatcctgctgcagcagacaagcaactatttgctgggtctcctggcacaccaggtccacgatggagcttgcttccgcagtccgctgaagtcagtggactttctggacgcctatcccggcatccttgaccagaagtttgaggtctccagtgttgccgactgcttggactctgcagtcgccctggcagcatacaagtggctggtttgctacctgctccgagagacttatcaaaaattaaaccaagagaaaagatcaggaagcagtgactttgaagcaaggaacaaatgccaggtgtcccacggccgtccgttggcgctggccttcgtggagctcacggtggtccagaggttccacgagcacgtgcaccagccttccgtgccgccctcgctgcgggccgtgctggggcggctcagtgctctgtacgccctgtggtccctgagccgccacgcggccctgctctaccgaggaggatacttctccggtgagcaggcgggagaagtgttggagagcgccgtcctggctttgtgttcccagctgaaagacgatgcagttgccctggtagacgtgatcgctcctcctgactttgttctggactcaccgattggcagagccgacggcgagctctacaaaaacctctggggcgctgtcctgcaggaaagcaaggtgttggagcgggcatcctggtggccagagttttctgtgaacaaacctgtcataggaagtctgaaatcgaagctctag

SEQ ID NO: 104349 - DNA, 584 bp, Homo sapiens
  Payload ID: 498
  Gene Symbol: ACOX3
  Gene Name: acyl-CoA oxidase 3, pristanoyl
  ENST ID: ENST00000514423
  CDS Start-End: 253-584
gtggcgggggagcagtggggccaggccagagacagctgcgctgtgcgggcagctagtcccagtactccgagtcggtcgcgggccgacaggcatcccctgagcgcctgctggaaaaccatcttctcagctcttgagaatgaccctcttttcgctcgttcccctggagccgatctgtccttggagaagtatcgcgagctgaacttccttcgatgcaagcggatcttcgagtatgacttcctcagtgtcgaagacatgttcaagagccctctgaaggtccccgccttgattcagtgcctgggcatgtatgactcttctctggctgccaagtacctcctccatagcttggtttttggatcagcagtttacagttctggttctgaaagacatctcacatatattcaaaagatcttcaggatggagatttttggatgttttgctctgaccgaattaagccacggcagtaataccaaggccattcgcacaactgcccactacgatcctgccactgaggaattcatcatacattcccctgatttcgaagctgccaagttttgggttggcaacatgggcaagacagccactca

SEQ ID NO: 104350 - DNA, 2188 bp, Homo sapiens
  Payload ID: 499
  Gene Symbol: ACOXL
  Gene Name: acyl-CoA oxidase-like
  Uniprot ID: Q9NUZ1
  ENST ID: ENST00000340561
  CDS Start-End: 164-1003
agaggcaggtgagcgcgatgcagccggcgccgggtctggggctcggggactcctccctgcaccgctacctggacggcgacttctggagcctcaagaacgagctgcgcggactcctcggcggcgcccgctcttccggcaaaggtatgatttaagcttggatgaaatgagagctttgacagttcagagagtgaagtttgccatggacctgcctctgttaaaacgtgcaggtcaggatctggcagagaaaacaaagaattttgtcagccgaagccttgtcataggagaagtcctctccatggcggacatggccacaggagtgaagtgcggaataatttattggctatttggtggtgctatcaggaatctcggaagccctgaacatgttactaagtggtttcagccactccaggagcagaaatacactgggatgtttgcaatgaccgagaggggccatgggagcaacgcgagagggatccagaccgaagccacctttgacctctctgcccaggagtttgtaattgacacgccgtgtgaaaatgcggagaagatgtatattggaaatgccatgtacgggaattatgcagctgtctttgcccagctcatcatagatggaagatctcaagggccccactgtttcatcgttcctgtccgggatgaaaacggaagcttgtacccaggagtcacagctattgatatgatgtacaaggagggtctgcatggtgtggacaatgggatattaatatttgacaaggttcggatacccagggagaacctgctggataagtttggttccgtggctccagatggacagtaccattcgcctattaggaacaagagtgcaagattcaatgccatgctggcagcactgaccccttcgagattagctgtggctttccaagctatgggtgccatgaagcttgggttgacgatagccattcgctatagccacaggtccagaatcatctcccagaactgctgttcagctccagctggtctttattgagcccctcttgtggaccaggctaatttcctgaaaactggtttttgctaacgtttcttacgcttgctcgtgaaatcagccacttaactgttctgggttttcccgtggcagatccctataggcttctcactgcactatcccaaactttttatctgagaatgttgtgtggcaagatgtctgcagagtgccgcttaggagatgctggcctggcgtccacgggtctgctgtgtatgtctctccaggcagatggcctgtctctgcctggcaaggacgatctggggtggaaaaactctgatctgaaagtgaaatcattgactccgttaccatgttctgaattcccagatctccctgatatggaaagtgaaaattggcttctattacacaatgcatcaaaattcttttgtataggaccagaccactgatatcaagggcagtgcactgactttcagttcctctgcatcccttggtcatgttcccacctttcaatgggaacagagaataaaaattccagctctagggcccagcctagtggccacctctcacggacaggcacccggctgctcagtgttatccaattactagaggccattcctagcatttcaacttggggaattaatttactattactttatttttatctttagagacagagtcttgctctgtcacccagactagagtgtagtggcatgatcatagctcactgcagccttgaactcctgagctcaggcaatcctcctgccacagccacctgagtagctggaactataggcatgtgccatcatgcccaactaattttatttttatttcagttgtagagatggagccttaccctgttgcccaggctggtctctgactcctggtctctagtgatcctcctgccttggcctcccaaagtgctaggattataggtgtgagccaacatgctgtccccattattgactgttaccctaaagtgtgtgttgcctttctagtttgagtagaaagtccagcattatctttttggataatatccaggttttgctgtttctttctttatttttcataatgagaacatttgctctcttgctgacattggagggcgtctgtttacctctcctgtaggcacacaaaattcccaacgtttatttgaagaaaaagacaattatttgagtaatttgaataaataaacattttaagtgattcccaaaa

SEQ ID NO: 104351 - DNA, 2714 bp, Homo sapiens
  Payload ID: 499
  Gene Symbol: ACOXL
  Gene Name: acyl-CoA oxidase-like
  Uniprot ID: Q9NUZ1
  ENST ID: ENST00000389811
  CDS Start-End: 225-1868
acctgctgggagctggaggaggcgcggagcgaagccggccctgccagccacgcggagaagcagaggcaggtgagcgcgatgcagccggcgccgggtctggggctcggggactcctccctgcaccgctacctggacggcgacttctggagcctcaagaacgagctgcgcggactcctcggcggcgcccgctcttccggcaaaggtatgatttaagcttggatgaaatgagagctttgacagttcagagagtgaagtttgccatggacctgcctctgttaaaacgtgcaggtcaggatctggcagagaaaacaaagaattttgtcagccgaagccttgtcataggagaagtcctctccatggcggacatggccacaggagtgaagtgcggaataatttattggctatttggtggtgctatcaggaatctcggaagccctgaacatgttactaagtggtttcagccactccaggagcagaaatacactgggatgtttgcaatgaccgagaggggccatgggagcaacgcgagagggatccagaccgaagccacctttgacctctctgcccaggagtttgtaattgacacgccgtgtgaaaatgcggagaagatgtatattggaaatgccatgtacgggaattatgcagctgtctttgcccagctcatcatagatggaagatctcaagggccccactgtttcatcgttcctgtccgggatgaaaacggaagcttgtacccaggagtcacagctattgatatgatgtacaaggagggtctgcatggtgtggacaatgggatattaatatttgacaaggttcggatacccagggagaacctgctggataagtttggttccgtggctccagatggacagtaccattcgcctattaggaacaagagtgcaagattcaatgccatgctggcagcactgaccccttcgagattagctgtggctttccaagctatgggtgccatgaagcttgggttgacgatagccattcgctatagccacagccggaggcagtttgggcccaaaaccaaggaagaggtgaagatcattgagcaccaaacacagaccctgcggctgatgccccacctggccacagccttggccctgaccttcgtcagcaggtatgctggggccctcctggatgaggatgtcttccagggaaaggagctggtcaacagtcgctcgctgcaggctctggtggcggggctgaaggcctacagcacctgggagaacatccgctgcctgcaggactgccgcgagtgcactggaggcatgggttacatgatggaaaatcgaatctcaggcttaaagtgtgacacagatgtgtttgccacttttgaaggtgacgatgttgttatgcttcaggttgtggggcgggaactgctggcccaatacaccaaacagtatgaagaaaaaccactctttggcctgctccaaaactgggctgaatctgtgggggacaagctgagaaccagtttcctggcatttaacatggacacagttgatgatctcgcctttctgttgaaagcagtgaaatttcgtgaaagggttcttcagcggggtttggtggccagaatttattataaggtaaagaccaagaaggaggattttttccatgcctggaactcgtgtctgcaccacgtggcttctctgtccctggcacacactcaccgagttaccttagagcagttctccctagcagtgaagagctgtcctgaccaagaggaccagactttgttaatgaagttttgtctgttgtatggaaccaagctggtgtttcaggagcgggcctggtatttagaacataaatacttgactcccatggccagcacgaggatcaggaatcaggagagatgctgaaacacaaacaggtataagactcagtctccacatgaagggagctcatatccaaggacacaaaaccactttaaaaacataaatactggccaggtgcagtggctcatgcctgtaatcccagcactatgggaggctgaggcgggcagatctcctgagctcaggagttcgacaccatcttgggcaacatggtgaaaccctgtctactaaaatacaaaaaaattagctgggcgtggtggcatgtggctgtagtcccagctactcgggaggctgaggcacgagaatcgcttgagccctggagttggaggttgcagtgagcagagattgcgccactgtactccagtttggactacagagtgagactccatctcaaaacaaaacaaaacaacaacagcaaaaaacaacaaaacaaaacacaaatactctcacagggcatggaggttttcgaatgaacttggccataagaataaattcagagttgacagaacagacgtcttaggaataaatgccattcttatgctagaccttgaagagtagaaaattaagagatggtggcccaattgagaggggaaaatgcagttgaaacttcagacagggttgataaagtgaggacgatcatagacatggagtacttagacatattaataaacaataaagactttacctgtctaatggaaaacctggagaagtcgtcaggaaccagactacagtggaccctggagaaccttgaagaacatttttccttttcaggaaaacggaggttacagagaaaagtatatgtaatgatgctacagtaatgtatttctgtataacaaatgactccaaacttacgacttaaaacaaccaccactt

SEQ ID NO: 104352 - DNA, 1793 bp, Homo sapiens
  Payload ID: 499
  Gene Symbol: ACOXL
  Gene Name: acyl-CoA oxidase-like
  ENST ID: ENST00000417074
  CDS Start-End: 1-1068
cgggatgaaaacggaagcttgtacccaggagtcacagctattgatatgatgtacaaggagggtctgcatggtgtggacaatgggatattaatatttgacaaggttcggatacccagggagaacctgctggataagtttggttccgtggctccagatggacagtaccattcgcctattaggaacaagagtgcaagattcaatgccatgctggcagcactgaccccttcgagattagctgtggctttccaagctatgggtgccatgaagcttgggttgacgatagccattcgctatagccacagccggaggcagtttgggcccaaaaccaaggaagaggtgaagatcattgagcaccaaacacagaccctgcggctgatgccccacctggccacagccttggccctgaccttcgtcagcaggtatgctggggccctcctggatgaggatgtcttccagggaaaggagctggtcaacagtcgctcgctgcaggctctggtggcggggctgaaggcctacagcacctgggagaacatccgctgcctgcaggactgccgcgagtgcactggaggcatggttgtggggcgggaactgctggcccaatacaccaaacagtatgaagaaaaaccactctttggcctgctccaaaactgggctgaatctgtgggggacaagctgagaaccagtttcctggcatttaacatggacacagttgatgatctcgcctttctgttgaaagcagtgaaatttcgtgaaagggttcttcagcggggtttggtggccagaatttattataaggtaaagaccaagaaggaggattttttccatgcctggaactcgtgtctgcaccacgtggcttctctgtccctggcacacactcaccgagttaccttagagcagttctccctagcagtgaagagctgtcctgaccaagaggaccagactttgttaatgaagttttgtctgttgtatggaaccaagctggtgtttcaggagcgggcctggtatttagaacataaatacttgactcccatggccagcacgaggatcaggaatcaggagagatgctgaaacacaaacaggtataagactcagtctccacatgaagggagctcatatccaaggacacaaaaccactttaaaaacataaatactggccaggtgcagtggctcatgcctgtaatcccagcactatgggaggctgaggcgggcagatctcctgagctcaggagttcgacaccatcttgggcaacatggtgaaaccctgtctactaaaatacaaaaaaattagctgggcgtggtggcatgtggctgtagtcccagctactcgggaggctgaggcacgagaatcgcttgagccctggagttggaggttgcagtgagcagagattgcgccactgtactccagtttggactacagagtgagactccatctcaaaacaaaacaaaacaacaacagcaaaaaacaacaaaacaaaacacaaatactctcacagggcatggaggttttcgaatgaacttggccataagaataaattcagagttgacagaacagacgtcttaggaataaatgccattcttatgctagaccttgaagagtagaaaattaagagatggtggcccaattgagaggggaaaatgcagttgaaacttcagacagggttgataaagtgaggacgatcatagacatggagtacttagacatattaataaacaataaagactttacctgtctaatggaaaacctggagaagtcgtcaggaaccagactacagtggaccctggagaaccttgaa

SEQ ID NO: 104353 - DNA, 399 bp, Homo sapiens
  Payload ID: 499
  Gene Symbol: ACOXL
  Gene Name: acyl-CoA oxidase-like
  ENST ID: ENST00000441974
  CDS Start-End: 1-282
ggggacaagctgagaaccagtttcctggcatttaacatggacacagttgatgatctcgcctttctgttgaaagcagtgaaatttcgtgaaagggttcttcagcggggtttggtggccagaatttattataaggtaaagaccaagaaggaggattttttccatgcctggaactcgtgtctgcaccacgtggcttctctgtccctggcacacactcaccgagttttgtctgttgtatggaaccaagctggtgtttcaggagcgggcctggtatttagaacataaatacttgactcccatggccagcacgaggatcaggaatcagttgctggatttgtgcgactcggtgaaggatgatgcccggagggtgatctcgacctttaacattccacacacctacct

SEQ ID NO: 104354 - DNA, 486 bp, Homo sapiens
  Payload ID: 499
  Gene Symbol: ACOXL
  Gene Name: acyl-CoA oxidase-like
  ENST ID: ENST00000448863
  CDS Start-End: 277-486
ggacaacgccctggcgagggcgaggtggggtgtgcgccgcgcctgagaggcgggtccctgcctcgccgcaggtgacgggctcccctccccaggtgtgtgggcgcagccggccgccgccgacctcttcggccccctgagaggtgccctctcctcccgagctccctcccccacgaagagtcgggtgcagggctgggccccgcggtgacaggcgcggtgtctacgaagaccgtgtggctggaagatcggccttgctggtatgatttaagcttggatgaaatgagagctttgacagttcagagagtgaagtttgccatggacctgcctctgttaaaacgtgcaggtcaggatctggcagagaaaacaaagaattttgtcagccgaagccttgtcataggagaagtcctctccatggcggacatggccacaggagtgaagtgcggaataatttattggctatttggtggtgctatcaggaatctcggaagc

SEQ ID NO: 104355 - DNA, 483 bp, Homo sapiens
  Payload ID: 499
  Gene Symbol: ACOXL
  Gene Name: acyl-CoA oxidase-like
  ENST ID: ENST00000433706
  CDS Start-End: 1-483
caagattcaatgccatgctggcagcactgaccccttcgagattagctgtggctttccaagctatgggtgccatgaagcttgggttgacgatagccattcgctatagccacaggtatgctggggccctcctggatgaggatgtcttccagggaaaggagctggtcaacagtcgctcgctgcaggctctggtggcggggctgaaggcctacagcacctgggagaacatccgctgcctgcaggactgccgcgagtgcactggaggcatgggttacatgatggaaaatcgaatctcaggcttaaagtgtgacacagatgtgtttgccacttttgaaggtgacgatgttgttatgcttcaggttgtggggcgggaactgctggcccaatacaccaaacagtatgaagaaaaaccactctttggcctgctccaaaactgggctgaatctgtgggggacaagctgagaaccagtttcctggcatttaaca

SEQ ID NO: 104356 - DNA, 2373 bp, Homo sapiens
  Payload ID: 499
  Gene Symbol: ACOXL
  Gene Name: acyl-CoA oxidase-like
  Uniprot ID: Q9NUZ1
  ENST ID: ENST00000439055
  CDS Start-End: 225-1967
acctgctgggagctggaggaggcgcggagcgaagccggccctgccagccacgcggagaagcagaggcaggtgagcgcgatgcagccggcgccgggtctggggctcggggactcctccctgcaccgctacctggacggcgacttctggagcctcaagaacgagctgcgcggactcctcggcggcgcccgctcttccggcaaaggtatgatttaagcttggatgaaatgagagctttgacagttcagagagtgaagtttgccatggacctgcctctgttaaaacgtgcaggtcaggatctggcagagaaaacaaagaattttgtcagccgaagccttgtcataggagaagtcctctccatggcggacatggccacaggagtgaagtgcggaataatttattggctatttggtggtgctatcaggaatctcggaagccctgaacatgttactaagtggtttcagccactccaggagcagaaatacactgggatgtttgcaatgaccgagaggggccatgggagcaacgcgagagggatccagaccgaagccacctttgacctctctgcccaggagtttgtaattgacacgccgtgtgaaaatgcggagaagatgtatattggaaatgccatgtacgggaattatgcagctgtctttgcccagctcatcatagatggaagatctcaagggccccactgtttcatcgttcctgtccgggatgaaaacggaagcttgtacccaggagtcacagctattgatatgatgtacaaggagggtctgcatggtgtggacaatgggatattaatatttgacaaggttcggatacccagggagaacctgctggataagtttggttccgtggctccagatggacagtaccattcgcctattaggaacaagagtgcaagattcaatgccatgctggcagcactgaccccttcgagattagctgtggctttccaagctatgggtgccatgaagcttgggttgacgatagccattcgctatagccacagccggaggcagtttgggcccaaaaccaaggaagaggtgaagatcattgagcaccaaacacagaccctgcggctgatgccccacctggccacagccttggccctgaccttcgtcagcaggtatgctggggccctcctggatgaggatgtcttccagggaaaggagctggtcaacagtcgctcgctgcaggctctggtggcggggctgaaggcctacagcacctgggagaacatccgctgcctgcaggactgccgcgagtgcactggaggcatggttgtggggcgggaactgctggcccaatacaccaaacagtatgaagaaaaaccactctttggcctgctccaaaactgggctgaatctgtgggggacaagctgagaaccagtttcctggcatttaacatggacacagttgatgatctcgcctttctgttgaaagcagtgaaatttcgtgaaagggttcttcagcggggtttggtggccagaatttattataaggtaaagaccaagaaggaggattttttccatgcctggaactcgtgtctgcaccacgtggcttctctgtccctggcacacactcaccgagttaccttagagcagttctccctagcagtgaagagctgtcctgaccaagaggaccagactttgttaatgaagttttgtctgttgtatggaaccaagctggtgtttcaggagcgggcctggtatttagaacataaatacttgactcccatggccagcacgaggatcaggaatcagttgctggatttgtgcgactcggtgaaggatgatgcccggagggtgatctcgacctttaacattccacacacctacctccacgcaccaatcgccggaatctccaacccgcgggccgcgtgggctttctaccctgcaccgctgcagccgcggccacgggaagaggcgcgctcccggcggcccaagctgggagccaagctctaacgggtgtggcgggaagtgtggtggcccgccagcagctgccacgacgctcgctccaccgacgcccagagctgtggccgaggccgggggctggcacccgctgggccgccactctcggggattttggtggcaaagcggaggtcccgccgaggctggcgaggtgcgcggctggctgctaggaaagagatccagacggtcgcctggtgcgctggatccctgtgccctttccctgaaacccagcctggcctgactgcaacctctcccaacttcagtgccggatcccctagacaatcagggtgggctccccgctgcgagcgcgccccacagccgggtgccgccaaaggtctcctgctgttagcggtgactcacattcccagtgatttagaaaaactgtggtgccgagtgaaag

SEQ ID NO: 104357 - DNA, 668 bp, Homo sapiens
  Payload ID: 499
  Gene Symbol: ACOXL
  Gene Name: acyl-CoA oxidase-like
  ENST ID: ENST00000443586
  CDS Start-End: 1-321
ggttacatgatggaaaatcgaatctcaggcttaaagtgtgacacagatgtgtttgccacttttgaaggtgacgatgttgttatgcttcaggttgtggggcgggaactgctggcccaatacaccaaacagtatgaagaaaaaccactctttggcctgctccaaaactgggctgaatctgtgggggacaagctgagaaccagtttcctggcatttaacatggacacagttgatgatctcgcctttctgttgaaagcagtgaaatttcgtgaaagggttcttcagcggggtttggtggccagaatttattataagttaccttagagcagttctccctagcagtgaagagctgtcctgaccaagaggaccagactttgttaatgaagttttgtctgttgtatggaaccaagctggtgtttcaggagcgggcctggtatttagaacataaatacttgactcccatggccagcacgaggatcaggaatcaggagatgtggcttggaggaagaatgcgcagaagtgtggtagacaccaggcccccaagccaggatgctgcttggctcctttgaacgtagaagatggattacactcgtttactattttaatctaagcataaagtataaatgcagtcactgcttagtgtcacaaaggcttgtgattaaagaacacac

SEQ ID NO: 104358 - DNA, 6357 bp, Homo sapiens
  Payload ID: 500
  Gene Symbol: ACSBG1
  Gene Name: acyl-CoA synthetase bubblegum family member 1
  Uniprot ID: Q96GR2
  ENST ID: ENST00000258873
  CDS Start-End: 207-2381
aaaccacaaagaaaaggaaagttttaattctgagaaacttcactgaggagcaattttttttgagcttctaaaaatagagaggaaatgagcctctttgggtcactctagttgccgcctcccctgccccatgcccacccccactgctcactcaaggctagcctctctcagtgggtgactgagctgtcttcagtggaagcccgaggcagatgccacgcaattctggagctggatacggctgcccacacggggaccccagcatgctggacagcagagagaccccacaggagagccggcaggacatgattgtgaggaccacccaagaaaaattgaaaaccagctcactgactgacaggcagccactctccaaagagtccctgaaccatgctctcgagctctcagtgccagagaaggtgaataatgcccagtgggatgctccagaggaggcgctgtggacgactcgggccgatgggcgggtgcgcctgcgcatagaccccagctgcccacagcttccctacactgtgcatcggatgttctacgaggccctggataagtatggggacctcatcgctttgggcttcaagcgccaggacaagtgggaacacatctcctactcccaatactacctgctcgcccgcagagccgccaagggcttcctgaagctcggcctgaagcaggcccacagtgtggccatcctcggcttcaactccccggagtggttcttctcggcagtgggcacagtatttgcaggtggcatcgtcactggcatctacaccaccagctccccagaggcctgccagtacatcgcttatgactgctgcgccaatgtcatcatggtcgacacgcagaagcagctggaaaagatcctgaagatctggaaacagttgccacatctaaaggcagtcgtgatatataaagaacctcctccaaacaagatggccaatgtgtacacgatggaggaattcatggagctggggaatgaagtgcctgaggaagccctggacgccatcattgacacccagcagcccaaccagtgctgtgtgctagtctacacttccggcaccactgggaaccccaagggcgtgatgctgagtcaagacaatatcacgtggacggcacggtacggcagccaggccggtgacatccggccggcagaagtccagcaggaggtggtagtcagctacctgcccctcagccatattgccgcccagatctacgacctgtggacaggcatccagtggggggcccaggtttgctttgccgaacccgacgccctgaaggggagcctggtgaacacgctgcgggaggtggagcccacatcacacatgggggtgccccgggtatgggagaagatcatggagcgcatccaggaggtggcggctcagtctggcttcatccggcgaaagatgctgctgtgggccatgtcggtgaccttggagcagaacctcacctgccccggcagcgacctgaagcccttcacaaccagactggcagattacctggtgctagccaaggttcgccaggcactgggatttgccaagtgtcaaaagaacttctatggagcggcccccatgatggcagagacacagcacttcttcctgggtctcaacatccgcttgtatgcgggctacggcctcagtgagacctcaggcccccacttcatgtccagtccctacaactaccggctgtacagctcaggcaagttggtgcccggctgtcgggtgaagctggtgaaccaggacgcagagggcattggcgagatctgcctgtggggccgcaccatattcatgggctacctgaacatggaggacaagacttgtgaggccatcgacgaggaaggctggctgcacacgggtgatgctggccgcctggacgccgatggcttcctctacatcactgggcgcctcaaagaattaatcatcacagctggtggggagaatgtgccccctgtgcccatcgaggaggccgtgaagatggagctgcccatcatcagcaacgccatgctcattggggaccagaggaagttcctgtccatgctgctcaccttgaagtgcactctggacccagacacctctgaccagactgataatctgactgaacaagctatggagttctgccagagggtgggcagcagagccaccacagtgtccgagatcatagagaagaaggatgaggccgtgtaccaggccatcgaagaggggatccggagggtcaacatgaacgcggcggcccggccctaccacatccagaagtgggccattctcgagagagacttctccatttcgggtggagagttgggtcccacgatgaaactgaaacggctcacagttttggagaagtacaaaggtatcattgactccttttaccaagagcaaaaaatgtaatcagggcctatgcctgcagtttctatagaatagagggcaggcgttccgagcctcttcctgagccccaggtctcttcagtctgggcacaggcatttctgccaagtctgttagatctccaggtcagggcacagcactggctctacatttaccaggtcttacgccaacaatagctgacaattccaagaagcttcacgtgtgggtagttttaattcagtttaagtattgctttttgttcaggtgacaaatgagatcagctctccttccagaacgaaagggctgataatttttggccttagttccaggtagattaaaaagctgctagctcacatacaggacagccagcagtaggctgtggagcgggtaggagagagatggctgatactgctcacgtgcgctgcaggaaaagcaatcagtcacaactcacctagcgacctgacttactctggaatcttggcgggcatcgccgaccctattattccattaccaggcactccgccacccacatgccaactgacttgatgcttaataaaactgctgctgcctgtttgattctatttaatgtataatttgaatattaaaccttttaacagaactgtcaacaaggacctgattttttttgtcaattgagcaggtgggaccagtgcagagagtagtgggcatttaactcacaggactgtgcacagcgggcatgcgagtgaccattagtgccctggaataaacaaaggtgcaggatggggtcaagtggcgcattctcataaaagcagccagctctacgttagcctgtcgccaccagaccaccccacttccattctgaatacgggaagcagccattctcagtagcaagctgagccaaaatgaccgaaggcatctgaacaggaaacaggtagagaaagcaaacatctcagttttggaattctttattactttgaacccaagagccactgataactggcacaatccaatgaaacagaggaagcagcagcttaaacaaaggaaaatacatttaagattataagtctgggggggcggttacaagcttaaaaagtgacccagacagggatatcattgctaaaaaaaaaaaaatccccttgtgacctgggtacattttgcaaagccacaggtttgcaatgttacacaagggccaaaggaggccatgagttgtctttggttgtggggacagagggtaactgttcatgaaaatagtgagtgtctgaagattaagaaaatcatgctgcagcagaggagaagggagaggaagacaggaagggaaaggagatgcctgagggtcaaaagctgagcccaagcctaagcccaagctcaagctcaagccccagcatggcataattttgtgaattaactcaggctgagttgcctccagtctttggaatgtcatcttatactggtactgctgaggcagagggcagtaattggtgctttgggataggagaaggggcagttgctgaaatacaaaattaatagcatcccaagttcctcaattgcagccaaaatacatgtgttcgggcctttcggcagtatcgcccccagaactacctgctgtagtgtggtccattcccagacagcaacatgcaagaataagtttacaatacactcagcccttctggcttcagatcaggggctcagaggctgtgacaactcatgatgctgaaaatgtatccagtgaaaatgaagtactagctctctgcttcattaaaagctcttggaaagaatattaaatctcaagacaacaaaataattgaacacacaatacatttgtgtctttgtatccaatatattacctttgtcttattaacaaaaattatatctctcattatatatttcttggatctgaagtttttattcacactcagtaatttctgtaaaggacaaatctgtctctattttccatatcatttagaaatataccacattcactctttttgatgtgaactttcccaggaaaattctcttgtgcccatttagttttagaagagtgtcattttgtgctattatgtcaatatcctgttttatttccattatgtttttcaaaaaccgaagaaaataaggtttttcttaaaaagttagacattttctcttgttaattctgtatcctgttatttacagctgaagagaaactattttaacttaagtgtaaaatggtttagaatagcaaatgatacagtccactcagagtttacaaaaaaaacatttaccaggtagacacttaataaataaaacaagcacttggaaaaagttctttgaaaacagacctagggacatccacctgcatcttttgcacagattttgttaagaaaaggccagatctaaaaatgtactgtcaagaaacaagcaaaccaatgcatacatacgtaggtattctaaacagaggttcatgtggtgtccatttagagtgactgatgtaaatgccagttgtagaagtgttaatctaaatcttttactcggcgacagatttcctctgtgaagtctgagcattttgcattgcctcccaaatcttttgtcaagctctgagaaaaggaaaaagcaaaaataaaagatgtatccgcaaactaaactaaaccaaggagattttaaagccctcagtgagatgccacctgggcaagttactcggctgctctttcatttagttcctcatttcaaagtgaggaaccactccaccaccatctacccagcccaggaggatcgggatccaatctcatagtgtatacaacagcactctgcaaagaataaggtgctcttgatgcaaagggaggcagggagctttaccaaaattttccctttgttcacacaatagaccctaacccagattagttggtcatggatatttaaataaaagcgaatctaaataagaagtttcataaaaatccttgggaaatatgtctcaggaatagacctgagacatattttgatctatttttgtttttattattattttttttttagatggagtctcactctgttgcccaggctggagtgcagtggcacgatcccagctcaccacaacctctgcctcctgggttcaagcgattctcctgcctcagcgtcctgaatagctggaattacaagtgcatgccaccatacccaactaatttttgtatctgatctatttttggaggctgggacacaaatacgaaagaaatatttaaatcattaactcttttttttttttttaagagacggggtctcactatgtggcccaggctggtcttgaactcagaggctaaggtgatcctcctgcctcagcctatagctgcaactacaggcatgcaccaccacacctgcctaaatcattaactcttaaacctccctctttaggaaagaaagcctcccatacaactgatctgttctaccagcttatcctttctttcctgcatacagaccccaatatatttaattctctttatctttccatcctacacaataaaagggcccactatgtaattcaggcacctctctactgggctgtagattataacttcccaaatataactttaaagaataagaaaatcatatgacctccaatgtgactatcaggctgttaaaaacaagcctgaatttcttgtattttggccacacgatataatttcaaattacagaatttttttaaaagaagggaccaactttgaagatattacgctaagtgaaataagccagactcaaaggacaaatactgtatgattccacttacatgaggtacctagagtagtcaaattcatagagacaggaagcagaatggcaggtgtcagaggatgggagggggaagggaaagttactgtttaacgggtgcagagtctcagtttgagaaaatgaaactggtctggagatgactgatggtgatggttacattacaatgtgaatgtacttaacattattgaactgtatacctaaatacggctaaaatggcaaattttatgttatgcatatttttcacaatttttgttaaaaaggacctcaaattagg

SEQ ID NO: 104359 - DNA, 1474 bp, Homo sapiens
  Payload ID: 500
  Gene Symbol: ACSBG1
  Gene Name: acyl-CoA synthetase bubblegum family member 1
  ENST ID: ENST00000559707
  CDS Start-End: 74-316
acccccactgctcactcaaggctagcctctctcagtgggtgactgagctgtcttcagtggaagcccgaggcagatgccacgcaattctggagctggatacggctgcccacacggggaccccagcatgctggacagcagagagaccccacaggagagccggcaggacatgattgtgaggaccacccaagaaaaattgaaaaccagaggaggcgctgtggacgactcgggccgatgggcgggtgcgcctgcgcatagaccccagctgcccacagcttccctacactgtgcatcggatgttctacgaggccctggataagtatggggacctcatcgctttgggcttcaagcgccaggacaagtgggaacacatctcctactcccaatactacctgctcgcccgcagagccgccaagggcttcctgaagctcggcctgaagcaggcccacagtgtggccatcctcggcttcaactccccggagtggttcttctcggcagtgggcacagtatttgcaggtggcatcgtcactggcatctacaccaccagctccccagaggcctgccagtacatcgcttatgactgctgcgccaatgtcatcatggtcgacacgcagaagcagctggaaaagatcctgaagatctggaaacagttgccacatctaaaggcagtcgtgatatataaagaacctcctccaaacaagatggccaatgtgtacacgatggaggaattcatggagctggggaatgaagtgcctgaggaagccctggacgccatcattgacacccagcagcccaaccagtgctgtgtgctagtctacacttccggcaccactgggaaccccaagggcgtgatgctgagtcaagacaatatcacgtggacggcacggtacggcagccaggccggtgacatccggccggcagaagtccagcaggaggtggtagtcagctacctgcccctcagccatattgccgcccagatctacgacctgtggacaggcatccagtggggggcccaggtttgctttgccgaacccgacgccctgaaggggagcctggtgaacacgctgcgggaggtggagcccacatcacacatgggggtgccccgggtatgggagaagatcatggagcgcatccaggaggtggcggctcagtctggcttcatccggcgaaagatgctgctgtgggccatgtcggtgaccttggagcagaacctcacctgccccggcagcgacctgaagcccttcacaaccagactggcagattacctggtgctagccaaggttcgccaggcactgggatttgccaagtgtcaaaagaacttctatggagcggcccccatgatggcagagacacagcacttcttcctgggtctcaacatccgcttgtatgcgggctacggcctcagtgagacctcaggcccccacttcatgtccagtccctacaactaccggctgtacagctgtaagtcccctgtaaa

SEQ ID NO: 104360 - DNA, 2462 bp, Homo sapiens
  Payload ID: 500
  Gene Symbol: ACSBG1
  Gene Name: acyl-CoA synthetase bubblegum family member 1
  ENST ID: ENST00000560817
  CDS Start-End: 484-1932
ggcaacccgctccggtcaccttccacgctgtgaaagctttattcttttgctctttgcaataaatcttgctactgctcagtctttgggtccacgctgcttttatgagctgtaacactcactggaaagtctgcagcttcattcctgaagccagcaagaccgcgagccccccgggggaggaatgaacaactccagagacgccactttaagagctgtaacactcaccgtgaaggtctgcagcttcactcctgagccagcgagaccacgaacccaccagaaggaagaaactccgaacacatccgaacgtcagaaggaacaaactccagacgcgcccccttaagagctgtaacactcaccgcgagggtctgcggcgtcagtcttgaagtcagtgagaccaagaacccaccaattcgggacacatagatctggaaacagttgccacatctaaaggcagtcgtgatatataaagaacctcctccaaacaagatggccaatgtgtacacgatggaggaattcatggagctggggaatgaagtgcctgaggaagccctggacgccatcattgacacccagcagcccaaccagtgctgtgtgctagtctacacttccggcaccactgggaaccccaagggcgtgatgctgagtcaagacaatatcacgtggacggcacggtacggcagccaggccggtgacatccggccggcagaagtccagcaggaggtggtagtcagctacctgcccctcagccatattgccgcccagatctacgacctgtggacaggcatccagtggggggcccaggtttgctttgccgaacccgacgccctgaaggggagcctggtgaacacgctgcgggaggtggagcccacatcacacatgggggtgccccgggtatgggagaagatcatggagcgcatccaggaggtggcggctcagtctggcttcatccggcgaaagatgctgctgtgggccatgtcggtgaccttggagcagaacctcacctgccccggcagcgacctgaagcccttcacaaccagactggcagattacctggtgctagccaaggttcgccaggcactgggatttgccaagtgtcaaaagaacttctatggagcggcccccatgatggcagagacacagcacttcttcctgggtctcaacatccgcttgtatgcgggctacggcctcagtgagacctcaggcccccacttcatgtccagtccctacaactaccggctgtacagctcaggcaagttggtgcccggctgtcgggtgaagctggtgaaccaggacgcagagggcattggcgagatctgcctgtggggccgcaccatattcatgggctacctgaacatggaggacaagacttgtgaggccatcgacgaggaaggctggctgcacacgggtgatgctggccgcctggacgccgatggcttcctctacatcactgggcgcctcaaagaattaatcatcacagctggtggggagaatgtgccccctgtgcccatcgaggaggccgtgaagatggagctgcccatcatcagcaacgccatgctcattggggaccagaggaagttcctgtccatgctgctcaccttgaagtgcactctggacccagacacctctgaccagactgataatctgactgaacaagctatggagttctgccagagggtgggcagcagagccaccacagtgtccgagatcatagagaagaaggatgaggccgtgtaccaggccatcgaagaggggatccggagggtcaacatgaacgcggcggcccggccctaccacatccagaagtgggccattctcgagagagacttctccatttcgggtggagagttgggtcccacgatgaaactgaaacggctcacagttttggagaagtacaaaggtatcattgactccttttaccaagagcaaaaaatgtaatcagggcctatgcctgcagtttctatagaatagagggcaggcgttccgagcctcttcctgagccccaggtctcttcagtctgggcacaggcatttctgccaagtctgttagatctccaggtcagggcacagcactggctctacatttaccaggtcttacgccaacaatagctgacaattccaagaagcttcacgtgtgggtagttttaattcagtttaagtattgctttttgttcaggtgacaaatgagatcagctctccttccagaacgaaagggctgataatttttggccttagttccaggtagattaaaaagctgctagctcacatacaggacagccagcagtaggctgtggagcgggtaggagagagatggctgatactgctcacgtgcgctgcaggaaaagcaatcagtcacaactcacctagcgacctgacttactctggaatcttggcgggcatcgccgaccctattattccattaccaggcactccgccacccacatgccaactgacttgatgcttaataaa

SEQ ID NO: 104361 - DNA, 925 bp, Homo sapiens
  Payload ID: 500
  Gene Symbol: ACSBG1
  Gene Name: acyl-CoA synthetase bubblegum family member 1
  ENST ID: ENST00000559241
  CDS Start-End: 195-925
atgccttagctgagggagcagaggggttgctgagccctgtgcctgccaggtgcaagaaggaggaagggcggtccggtggagccgggcctctctggggctgctgtggctctcccggggggactccgtgacatgttctctgaggttctggctctctcctgggcaagctcacagattgcagccaccccccaggcaccatgccagaggtgctcctgctcaggtctgccagctccatcctgaggactgcgttcttaagcagatggctgccaggtgggcctaggtgtgttcacaaacttagttttgttcggaacctgcagtgccgacaaggagtgaggctgaatgtgagaagcagctcactgactgacaggcagccactctccaaagagtccctgaaccatgctctcgagctctcagtgccagagaaggtgaataatgcccagtgggatgctccagaggaggcgctgtggacgactcgggccgatgggcgggtgcgcctgcgcatagaccccagctgcccacagcttccctacactgtgcatcggatgttctacgaggccctggataagtatggggacctcatcgctttgggcttcaagcgccaggacaagtgggaacacatctcctactcccaatactacctgctcgcccgcagagccgccaagggcttcctgaagctcggcctgaagcaggcccacagtgtggccatcctcggcttcaactccccggagtggttcttctcggcagtgggcacagtatttgcaggtggcatcgtcactggcatctacaccaccagctccccagaggcctgccagtacatcgcttatgactgctgcgccaatgtcatcatggtcgacacgcagaagcagctggaaaagatcctgaagatctggaaacagttgccacatctaaaggcagtcgtgatatataa

SEQ ID NO: 104362 - DNA, 895 bp, Homo sapiens
  Payload ID: 500
  Gene Symbol: ACSBG1
  Gene Name: acyl-CoA synthetase bubblegum family member 1
  ENST ID: ENST00000557935
  CDS Start-End: 102-269
tagttgccgcctcccctgccccatgcccacccccactgctcactcaaggctagcctctctcagtgggtgactgagctgtcttcagtggaagcccgaggcagatgccacgcaattctggagctggatacggctgcccacacggggaccccagcatgctggacagcagagagaccccacaggagagccggcaggacatgattgtgaggaccacccaagaaaaattgaaaaccagagatggagtcttgctacattgcccaggctggccttgaactcctggcctgaagcgatcttcccaccttggccttccaaagtgctgggatgaacaggctggagccactacacctggcccactactacagccttatactaaatcttgaaatcagaggaggcgctgtggacgactcgggccgatgggcgggtgcgcctgcgcatagaccccagctgcccacagcttccctacactgtgcatcggatgttctacgaggccctggataagtatggggacctcatcgctttgggcttcaagcgccaggacaagtgggaacacatctcctactcccaatactacctgctcgcccgcagagccgccaagggcttcctgaagctcggcctgaagcaggcccacagtgtggccatcctcggcttcaactccccggagtggttcttctcggcagtgggcacagtatttgcaggtggcatcgtcactggcatctacaccaccagctccccagaggcctgccagtacatcgcttatgactgctgcgccaatgtcatcatggtcgacacgcagaagcagctggaaaagatcctgaagatctggaaacagttgccacatctaaaggcagtcgtgatatataaagaacctcctccaaacaagatggccaatgtgtacacg

SEQ ID NO: 104363 - DNA, 2257 bp, Homo sapiens
  Payload ID: 500
  Gene Symbol: ACSBG1
  Gene Name: acyl-CoA synthetase bubblegum family member 1
  ENST ID: ENST00000560124
  CDS Start-End: 25-180
gtcttcagtggaagcccgaggcagatgccacgcaattctggagctggatacggctgcccacacggggaccccagcatgctggacagcagagagaccccacaggagagccggcaggacatgattgtgaggaccacccaagaaaaattgaaaaccagatctggaaacagttgccacatctaaaggcagtcgtgatatataaagaacctcctccaaacaagatggccaatgtgtacacgatggaggaattcatggagctggggaatgaagtgcctgaggaagccctggacgccatcattgacacccagcagcccaaccagtgctgtgtgctagtctacacttccggcaccactgggaaccccaagggcgtgatgctgagtcaagacaatatcacgtggacggcacggtacggcagccaggccggtgacatccggccggcagaagtccagcaggaggtggtagtcagctacctgcccctcagccatattgccgcccagatctacgacctgtggacaggcatccagtggggggcccaggtttgctttgccgaacccgacgccctgaaggggagcctggtgaacacgctgcgggaggtggagcccacatcacacatgggggtgccccgggtatgggagaagatcatggagcgcatccaggaggtggcggctcagtctggcttcatccggcgaaagatgctgctgtgggccatgtcggtgaccttggagcagaacctcacctgccccggcagcgacctgaagcccttcacaaccagactggcagattacctggtgctagccaaggttcgccaggcactgggatttgccaagtgtcaaaagaacttctatggagcggcccccatgatggcagagacacagcacttcttcctgggtctcaacatccgcttgtatgcgggctacggcctcagtgagacctcaggcccccacttcatgtccagtccctacaactaccggctgtacagctcaggcaagttggtgcccggctgtcgggtgaagctggtgaaccaggacgcagagggcattggcgagatctgcctgtggggccgcaccatattcatgggctacctgaacatggaggacaagacttgtgaggccatcgacgaggaaggctggctgcacacgggtgatgctggccgcctggacgccgatggcttcctctacatcactgggcgcctcaaagaattaatcatcacagctggtggggagaatgtgccccctgtgcccatcgaggaggccgtgaagatggagctgcccatcatcagcaacgccatgctcattggggaccagaggaagttcctgtccatgctgctcaccttgaagtgcactctggacccagacacctctgaccagactgataatctgactgaacaagctatggagttctgccagagggtgggcagcagagccaccacagtgtccgagatcatagagaagaaggatgaggccgtgtaccaggccatcgaagaggggatccggagggtcaacatgaacgcggcggcccggccctaccacatccagaagtgggccattctcgagagagacttctccatttcgggtggagagttgggtcccacgatgaaactgaaacggctcacagttttggagaagtacaaaggtatcattgactccttttaccaagagcaaaaaatgtaatcagggcctatgcctgcagtttctatagaatagagggcaggcgttccgagcctcttcctgagccccaggtctcttcagtctgggcacaggcatttctgccaagtctgttagatctccaggtcagggcacagcactggctctacatttaccaggtcttacgccaacaatagctgacaattccaagaagcttcacgtgtgggtagttttaattcagtttaagtattgctttttgttcaggtgacaaatgagatcagctctccttccagaacgaaagggctgataatttttggccttagttccaggtagattaaaaagctgctagctcacatacaggacagccagcagtaggctgtggagcgggtaggagagagatggctgatactgctcacgtgcgctgcaggaaaagcaatcagtcacaactcacctagcgacctgacttactctggaatcttggcgggcatcgccgaccctattattccattaccaggcactccgccacccacatgccaactgacttgatgcttaataaaactgctgctgcctgtttgattctatttaatgtataatttgaatattaaaccttttaacag

SEQ ID NO: 104364 - DNA, 569 bp, Homo sapiens
  Payload ID: 500
  Gene Symbol: ACSBG1
  Gene Name: acyl-CoA synthetase bubblegum family member 1
  ENST ID: ENST00000558130
  CDS Start-End: 25-569
gtcttcagtggaagcccgaggcagatgccacgcaattctggagctggatacggctgcccacacggggaccccagcatgctggacagcagagagaccccacaggagagccggcaggacatgattgtgaggaccacccaagaaaaattgaaaaccagctcactgactgacaggcagccactctccaaagagtccctgaaccatgctctcgagctctcagtgccagagaaggtgaataatgcccagtgggatgctccagaggaggcgctgtggacgactcgggccgatgggcgggtgcgcctgcgcatagaccccagctgcccacagcttccctacactgtgcatcggatgttctacgaggccctggataagtatggggacctcatcgctttgggcttcaagcgccaggacaagtgggaacacatctcctactcccaatactacctgctcgcccgcagagccgccaagggcttcctgaagcaggcccacagtgtggccatcctcggcttcaactccccggagtggttcttctcggcagtgggcacagtatttgcaggtggcatcgtcactgg

SEQ ID NO: 104365 - DNA, 559 bp, Homo sapiens
  Payload ID: 500
  Gene Symbol: ACSBG1
  Gene Name: acyl-CoA synthetase bubblegum family member 1
  ENST ID: ENST00000559114
  CDS Start-End: 144-559
agatttcttcttcaagaaagctgggaagaagagaggccagagatagagagacagaggaggcgctgtggacgactcgggccgatgggcgggtgcgcctgcgcatagaccccagctgcccacagcttccctacactgtgcatcggatgttctacgaggccctggataagtatggggacctcatcgctttgggcttcaagcgccaggacaagtgggaacacatctcctactcccaatactacctgctcgcccgcagagccgccaagggcttcctgaagctcggcctgaagcaggcccacagtgtggccatcctcggcttcaactccccggagtggttcttctcggcagtgggcacagtatttgcaggtggcatcgtcactggcatctacaccaccagctccccagaggcctgccagtacatcgcttatgactgctgcgccaatgtcatcatggtcgacacgcagaagcagctggaaaagatcctgaagatctggaaacagttgccacatctaaaggcagtcgtgatatataaagaacctcctccaaacaagatggccaatgt

SEQ ID NO: 104366 - DNA, 2759 bp, Homo sapiens
  Payload ID: 501
  Gene Symbol: ACSBG2
  Gene Name: acyl-CoA synthetase bubblegum family member 2
  Uniprot ID: Q5FVE4
  ENST ID: ENST00000588304
  CDS Start-End: 447-2297
gaggtggctgggatggaacgttctggaaggttgaatggggtagaaggcctgttgtggagggaaaccacccatcctcctgcctcccaccaccaccatcatcctggctggacggagagggtgacgggggctgggaaggggcagctcatgttcaggtttccaggaggggctacctgttgactgtctttgcaggaagaagaaaacacctgagtgaccagatgtcccagctccaggtgccttgccagatggccagaaccacacctcttgaagagtgacagtgctgtggagcatggtttctgcacacctggaatgactggaaccccaaagactcaagaaggagctaaagatcttgaagtagacatgaataaaacagaaggctgtggaccacctgtcgagatggagaagtccttctgaggctatccaaacacggaccaggccatgagaccccgatgaccatccctgaattttttcgagagtcagtcaaccgatttggaacttatccagccctcgcatccaagaatggcaaaaagtgggaaattctgaatttcaaccagtactatgaggcttgtcggaaggctgcaaaatccttgatcaagctgggtttggagcgtttccacggagttggtatcctggggtttaactctgcagagtggtttatcactgctgttggtgccatcctagccgggggtctttgtgttggtatttatgccaccaactctgccgaggtttgtcaatatgtcatcactcatgccaaagtgaacatcttgctggttgagaatgatcaacagttacagaaaatcctttcgattccacagagcagcctagagcccctaaaagcgatcatccagtacagactgccaatgaagaagaacaacaacttgtactcttgggatgatttcatggaacttggcagaagtatccctgacacccaactggagcaggtcatcgagagccagaaggcgaatcaatgcgcagtgctcatctacacttcagggaccacaggcatacccaagggagtgatgctcagtcatgacaacatcacgtggattgcaggagcagtgacaaaggactttaaactgacagacaagcatgagacggtggttagctacctcccactcagccatattgcagcacagatgatggacatctgggtacccataaagattggggcgctcacatactttgctcaagcagatgctctcaagggcaccttggtaagtactctaaaggaggtaaaacctactgtcttcattggagtgcctcaaatttgggagaagatacatgagatggtgaagaaaaatagtgccaagtccatgggcttgaagaagaaggcattcgtgtgggcaagaaacattggcttcaaggtcaactcaaaaaagatgttggggaaatataatactcccgtgagctaccgcatggctaagactctcgtgttcagcaaagtcaagacatcccttggcttggatcactgtcactcttttatcagtgggactgcgcccctcaaccaagagactgccgagttctttctaagcttggacatacctataggcgagttgtatgggttgagtgagagctcgggaccccacacgatatccaaccagaataactacaggcttctaagctgtggcaagatcttgactgggtgtaagaatatgctgttccagcagaacaaggatggcattggggagatctgcctctggggtaggcacatcttcatgggctatctggaaagtgagactgaaactacagaggccatcgatgatgaaggctggctacactctggggatctgggccagctggacggtctgggtttcctctatgtcaccggccacatcaaagaaatccttatcactgctggtggtgaaaatgtgccccccattcctgttgagaccttggttaagaagaagatccccatcatcagtaacgccatgttagtaggagataaactgaagtttctgagcatgttgctgacgctgaagtgtgagatgaatcagatgagcggagaacctctggacaagctgaacttcgaggccatcaacttctgtcggggtctgggcagccaggcatccaccgtgactgagattgtgaagcagcaagaccccctggtctacaaggccatccagcaaggcatcaatgctgtgaaccaggaagccatgaacaatgcacagaggattgaaaagtgggtcatcttggagaaggacttttccatctatggtggagagctaggtccaatgatgaaacttaagagacattttgtagcccagaaatacaaaaaacaaattgatcacatgtaccactgactgctttgatggagctgctctcagctgttctgatgccttcagcaggaagacctcattgcaataagtgaaatgctgctctaggtagaagctctccctgctgtttttaagaagccacattcctcattggtcagtttcttgattgttcgtctgttggagaggtgctccctagaagaacctgccatacgtttcaaagcaataaaatcactgtatatctttctaaggaccttcaagtcatgactccagggaagcctattgggaagtctactaaaaactgcctgatttacaagaaagacctgaacttgtgggctcccatttgatttttttctcctcaggggactcagacattagaaagaaaaagcctcacagatttgaagaactggacccccaaatcaactcacctgcctggaagcaactgggaaacccttccaataagtcctgataataaagcacttcagggtccca

SEQ ID NO: 104367 - DNA, 789 bp, Homo sapiens
  Payload ID: 501
  Gene Symbol: ACSBG2
  Gene Name: acyl-CoA synthetase bubblegum family member 2
  ENST ID: ENST00000587617
  CDS Start-End: 196-600
acccatcctcctgcctcccaccaccaccatcatcctggctggacggagagggtgacgggggctgggaaggggcagctcatgttcaggtttccaggaggggctacctgttgactgtctttgcaggaagaagaaaacacctgagtgaccagatgtcccagctccagtgctgtggagcatggtttctgcacacctggaatgactggaaccccaaagactcaagaaggagctaaagatcttgaagtagacatgaataaaacagaagttactcccaggctgtggaccacctgtcgagatggagaagtccttctgaggctatccaaacacggaccaggccatgagaccccgatgaccatccctgaattttttcgagagtcagtcaaccgatttggaacttatccagccctcgcatccaagaatggcaaaaagtgggaaattctgaatttcaaccagtactatgaggcttgtcggaaggctgcaaaatccttgatcaagctgggtttggagcgtttccacggagttggtatcctggggtttaactctgcagagtggtttatcactgctgttggtgccatcctagccggattccacagagcagcctagagcccctaaaagcgatcatccagtacagactgccaatgaagaagaacaacaacttgtactcttgggatgatttcatggaacttggcagaagtatccctgacacccaactggagcaggtcatcgagagccagaaggcgaatcaatgcgcagtgctcatctacacttcagggaccacaggcatacccaagg

SEQ ID NO: 104368 - DNA, 605 bp, Homo sapiens
  Payload ID: 501
  Gene Symbol: ACSBG2
  Gene Name: acyl-CoA synthetase bubblegum family member 2
  ENST ID: ENST00000587227
  CDS Start-End: 1-354
tatgccaccaactctgccgaggtttgtcaatatgtcatcactcatgccaaagtgaacatcttgctggttgagaatgatcaacagttacagaaaatcctttcgattccacagagcagcctagagcccctaaaagcgatcatccagtacagactgccaatgaagaagaacaacaacttgtactcttgggatgatttcatggaacttggcagaagtatccctgacacccaactggagcaggtcatcgagagccagaaggcgaatcaatgcgcagtgctcatctacacttcagggaccacaggcatacccaagggagtgatgctcagtcatgacaacaaaaattcattgagcacctagtatgtactggggaatattccaggagcaggggaaacagcagcaaacaagacagactcaatctggaccttgggaacagataagaaatgaacaaatgaaaacattcagtttgtgtgacatgatcacgtggattgcaggagcagtgacaaaggactttaaactgacagacaagcatgagacggtggttagctacctcccactcagccatattgcagcacagatgatggacatctgggtacccataaagattgggg

SEQ ID NO: 104369 - DNA, 2739 bp, Homo sapiens
  Payload ID: 501
  Gene Symbol: ACSBG2
  Gene Name: acyl-CoA synthetase bubblegum family member 2
  Uniprot ID: Q5FVE4
  ENST ID: ENST00000586696
  CDS Start-End: 277-2277
gtagaaggcctgttgtggagggaaaccacccatcctcctgcctcccaccaccaccatcatcctggctggacggagagggtgacgggggctgggaaggggcagctcatgttcaggtttccaggaggggctacctgttgactgtctttgcaggaagaagaaaacacctgagtgaccagatgtcccagctccaggtgccttgccagatggccagaaccacacctcttgaagagtgacaggtgccagtgtgctgtggagcatggtttctgcacacctggaatgactggaaccccaaagactcaagaaggagctaaagatcttgaagtagacatgaataaaacagaagttactcccaggctgtggaccacctgtcgagatggagaagtccttctgaggctatccaaacacggaccaggccatgagaccccgatgaccatccctgaattttttcgagagtcagtcaaccgatttggaacttatccagccctcgcatccaagaatggcaaaaagtgggaaattctgaatttcaaccagtactatgaggcttgtcggaaggctgcaaaatccttgatcaagctgggtttggagcgtttccacggagttggtatcctggggtttaactctgcagagtggtttatcactgctgttggtgccatcctagccgggggtctttgtgttggtatttatgccaccaactctgccgaggtttgtcaatatgtcatcactcatgccaaagtgaacatcttgctggttgagaatgatcaacagttacagaaaatcctttcgattccacagagcagcctagagcccctaaaagcgatcatccagtacagactgccaatgaagaagaacaacaacttgtactcttgggatgatttcatggaacttggcagaagtatccctgacacccaactggagcaggtcatcgagagccagaaggcgaatcaatgcgcagtgctcatctacacttcagggaccacaggcatacccaagggagtgatgctcagtcatgacaacatcacgtggattgcaggagcagtgacaaaggactttaaactgacagacaagcatgagacggtggttagctacctcccactcagccatattgcagcacagatgatggacatctgggtacccataaagattggggcgctcacatactttgctcaagcagatgctctcaagggcaccttggtaagtactctaaaggaggtaaaacctactgtcttcattggagtgcctcaaatttgggagaagatacatgagatggtgaagaaaaatagtgccaagtccatgggcttgaagaagaaggcattcgtgtgggcaagaaacattggcttcaaggtcaactcaaaaaagatgttggggaaatataatactcccgtgagctaccgcatggctaagactctcgtgttcagcaaagtcaagacatcccttggcttggatcactgtcactcttttatcagtgggactgcgcccctcaaccaagagactgccgagttctttctaagcttggacatacctataggcgagttgtatgggttgagtgagagctcgggaccccacacgatatccaaccagaataactacaggcttctaagctgtggcaagatcttgactgggtgtaagaatatgctgttccagcagaacaaggatggcattggggagatctgcctctggggtaggcacatcttcatgggctatctggaaagtgagactgaaactacagaggccatcgatgatgaaggctggctacactctggggatctgggccagctggacggtctgggtttcctctatgtcaccggccacatcaaagaaatccttatcactgctggtggtgaaaatgtgccccccattcctgttgagaccttggttaagaagaagatccccatcatcagtaacgccatgttagtaggagataaactgaagtttctgagcatgttgctgacgctgaagtgtgagatgaatcagatgagcggagaacctctggacaagctgaacttcgaggccatcaacttctgtcggggtctgggcagccaggcatccaccgtgactgagattgtgaagcagcaagaccccctggtctacaaggccatccagcaaggcatcaatgctgtgaaccaggaagccatgaacaatgcacagaggattgaaaagtgggtcatcttggagaaggacttttccatctatggtggagagctaggtccaatgatgaaacttaagagacattttgtagcccagaaatacaaaaaacaaattgatcacatgtaccactgactgctttgatggagctgctctcagctgttctgatgccttcagcaggaagacctcattgcaataagtgaaatgctgctctaggtagaagctctccctgctgtttttaagaagccacattcctcattggtcagtttcttgattgttcgtctgttggagaggtgctccctagaagaacctgccatacgtttcaaagcaataaaatcactgtatatctttctaaggaccttcaagtcatgactccagggaagcctattgggaagtctactaaaaactgcctgatttacaagaaagacctgaacttgtgggctcccatttgatttttttctcctcaggggactcagacattagaaagaaaaagcctcacagatttgaagaactggacccccaaatcaactcacctgcctggaagcaactgggaaacccttccaataagtcctgataataaagcacttcagggtccca

SEQ ID NO: 104370 - DNA, 571 bp, Homo sapiens
  Payload ID: 501
  Gene Symbol: ACSBG2
  Gene Name: acyl-CoA synthetase bubblegum family member 2
  ENST ID: ENST00000588722
  CDS Start-End: 145-571
atggaacgttctggaaggttgaatggggaagaagaaaacacctgagtgaccagatgtcccagctccaggtgccttgccagatggccagaaccacacctcttgaagagtgacagtgctgtggagcatggtttctgcacacctggaatgactggaaccccaaagactcaagaaggagctaaagatcttgaagtagacatgaataaaacagaagttactcccaggctgtggaccacctgtcgagatggagaagtccttctgaggctatccaaacacggaccaggccatgagaccccgatgaccatccctgaattttttcgagagtcagtcaaccgatttggaacttatccagccctcgcatccaagaatggcaaaaagtgggaaattctgaatttcaaccagtactatgaggcttgtcggaaggctgcaaaatccttgatcaagctgggtttggagcgtttccacggagttggtatcctggggtttaactctgcagagtggtttatcactgctgttggtgccatcctagccgggggtctttgtgttggtatttatgccaccaactctgccgagg

SEQ ID NO: 104371 - DNA, 2478 bp, Homo sapiens
  Payload ID: 501
  Gene Symbol: ACSBG2
  Gene Name: acyl-CoA synthetase bubblegum family member 2
  Uniprot ID: Q5FVE4
  ENST ID: ENST00000588485
  CDS Start-End: 582-2021
ggctgggatggaacgttctggaaggaagaagaaaacacctgagtgaccagatgtcccagctccaggtgccttgccagatggccagaaccacacctcttgaagagtgacagtgctgtggagcatggtttctgcacacctggaatgactggaaccccaaagactcaagaaggagctaaagatcttgaagtagacatgaataaaacagaagttactcccaggctgtggaccacctgtcgagatggagaagtccttctgaggctatccaaacacggaccaggccatgagaccccgatgaccatccctgaattttttcgagagtcagtcaaccgatttggaacttatccagccctcgcatccaagaatggcaaaaagtgggaaattctgaatttcaaccagtactatgaggcttgtcggaaggctgcaaaatccttgatcaagctgggtttggagcgtttccacggagttggtatcctggggtttaactctgcagagtggtttatcactgctgttggtgccatcctagccggattccacagagcagcctagagcccctaaaagcgatcatccagtacagactgccaatgaagaagaacaacaacttgtactcttgggatgatttcatggaacttggcagaagtatccctgacacccaactggagcaggtcatcgagagccagaaggcgaatcaatgcgcagtgctcatctacacttcagggaccacaggcatacccaagggagtgatgctcagtcatgacaacatcacgtggattgcaggagcagtgacaaaggactttaaactgacagacaagcatgagacggtggttagctacctcccactcagccatattgcagcacagatgatggacatctgggtacccataaagattggggcgctcacatactttgctcaagcagatgctctcaagggcaccttggtaagtactctaaaggaggtaaaacctactgtcttcattggagtgcctcaaatttgggagaagatacatgagatggtgaagaaaaatagtgccaagtccatgggcttgaagaagaaggcattcgtgtgggcaagaaacattggcttcaaggtcaactcaaaaaagatgttggggaaatataatactcccgtgagctaccgcatggctaagactctcgtgttcagcaaagtcaagacatcccttggcttggatcactgtcactcttttatcagtgggactgcgcccctcaaccaagagactgccgagttctttctaagcttggacatacctataggcgagttgtatgggttgagtgagagctcgggaccccacacgatatccaaccagaataactacaggcttctaagctgtggcaagatcttgactgggtgtaagaatatgctgttccagcagaacaaggatggcattggggagatctgcctctggggtaggcacatcttcatgggctatctggaaagtgagactgaaactacagaggccatcgatgatgaaggctggctacactctggggatctgggccagctggacggtctgggtttcctctatgtcaccggccacatcaaagaaatccttatcactgctggtggtgaaaatgtgccccccattcctgttgagaccttggttaagaagaagatccccatcatcagtaacgccatgttagtaggagataaactgaagtttctgagcatgttgctgacgctgaagtgtgagatgaatcagatgagcggagaacctctggacaagctgaacttcgaggccatcaacttctgtcggggtctgggcagccaggcatccaccgtgactgagattgtgaagcagcaagaccccctggtctacaaggccatccagcaaggcatcaatgctgtgaaccaggaagccatgaacaatgcacagaggattgaaaagtgggtcatcttggagaaggacttttccatctatggtggagagctaggtccaatgatgaaacttaagagacattttgtagcccagaaatacaaaaaacaaattgatcacatgtaccactgactgctttgatggagctgctctcagctgttctgatgccttcagcaggaagacctcattgcaataagtgaaatgctgctctaggtagaagctctccctgctgtttttaagaagccacattcctcattggtcagtttcttgattgttcgtctgttggagaggtgctccctagaagaacctgccatacgtttcaaagcaataaaatcactgtatatctttctaaggaccttcaagtcatgactccagggaagcctattgggaagtctactaaaaactgcctgatttacaagaaagacctgaacttgtgggctcccatttgatttttttctcctcaggggactcagacattagaaagaaaaagcctcacagatttgaagaactggacccccaaatcaactcacctgcctggaagcaactgggaaacccttccaataagtcctgataataaagcacttcaggg

SEQ ID NO: 104372 - DNA, 683 bp, Homo sapiens
  Payload ID: 501
  Gene Symbol: ACSBG2
  Gene Name: acyl-CoA synthetase bubblegum family member 2
  ENST ID: ENST00000590132
  CDS Start-End: 1-113
agaccttggttaagaagaagatccccatcatcagtaacgccatgttagtaggagataaactgaagtttctgagcatgttgctgacgctgaagccaggcatccaccgtgactgagattgtgaagcagcaagaccccctggtctacaaggccatccagcaaggcatcaatgctgtgaaccaggaagccatgaacaatgcacagaggattgaaaagtgggtcatcttggagaaggacttttccatctatggtggagagctagccttcagcaggaagacctcattgcaataagtgaaatgctgctctaggtagaagctctccctgctgtttttaagaagccacattcctcattggtcagtttcttgattgttcgtctgttggagaggtgctccctagaagaacctgccatacgtttcaaagcaataaaatcactgtatatctttctaaggaccttcaagtcatgactccagggaagcctattgggaagtctactaaaaactgcctgatttacaagaaagacctgaacttgtgggctcccatttgatttttttctcctcaggggactcagacattagaaagaaaaagcctcacagatttgaagaactggacccccaaatcaactcacctgcctggaagcaactgggaaacccttccaataagtcctgataataaagcacttcagggtc

SEQ ID NO: 104373 - DNA, 2690 bp, Homo sapiens
  Payload ID: 501
  Gene Symbol: ACSBG2
  Gene Name: acyl-CoA synthetase bubblegum family member 2
  Uniprot ID: Q5FVE4
  ENST ID: ENST00000591403
  CDS Start-End: 228-2228
atggggtagaaggcctgttgtggagggaaaccacccatcctcctgcctcccaccaccaccatcatcctggctggacggagagggtgacgggggctgggaaggggcagctcatgttcaggtttccaggaggggctacctgttgactgtctttgcaggaagaagaaaacacctgagtgaccagatgtcccagctccagtgctgtggagcatggtttctgcacacctggaatgactggaaccccaaagactcaagaaggagctaaagatcttgaagtagacatgaataaaacagaagttactcccaggctgtggaccacctgtcgagatggagaagtccttctgaggctatccaaacacggaccaggccatgagaccccgatgaccatccctgaattttttcgagagtcagtcaaccgatttggaacttatccagccctcgcatccaagaatggcaaaaagtgggaaattctgaatttcaaccagtactatgaggcttgtcggaaggctgcaaaatccttgatcaagctgggtttggagcgtttccacggagttggtatcctggggtttaactctgcagagtggtttatcactgctgttggtgccatcctagccgggggtctttgtgttggtatttatgccaccaactctgccgaggtttgtcaatatgtcatcactcatgccaaagtgaacatcttgctggttgagaatgatcaacagttacagaaaatcctttcgattccacagagcagcctagagcccctaaaagcgatcatccagtacagactgccaatgaagaagaacaacaacttgtactcttgggatgatttcatggaacttggcagaagtatccctgacacccaactggagcaggtcatcgagagccagaaggcgaatcaatgcgcagtgctcatctacacttcagggaccacaggcatacccaagggagtgatgctcagtcatgacaacatcacgtggattgcaggagcagtgacaaaggactttaaactgacagacaagcatgagacggtggttagctacctcccactcagccatattgcagcacagatgatggacatctgggtacccataaagattggggcgctcacatactttgctcaagcagatgctctcaagggcaccttggtaagtactctaaaggaggtaaaacctactgtcttcattggagtgcctcaaatttgggagaagatacatgagatggtgaagaaaaatagtgccaagtccatgggcttgaagaagaaggcattcgtgtgggcaagaaacattggcttcaaggtcaactcaaaaaagatgttggggaaatataatactcccgtgagctaccgcatggctaagactctcgtgttcagcaaagtcaagacatcccttggcttggatcactgtcactcttttatcagtgggactgcgcccctcaaccaagagactgccgagttctttctaagcttggacatacctataggcgagttgtatgggttgagtgagagctcgggaccccacacgatatccaaccagaataactacaggcttctaagctgtggcaagatcttgactgggtgtaagaatatgctgttccagcagaacaaggatggcattggggagatctgcctctggggtaggcacatcttcatgggctatctggaaagtgagactgaaactacagaggccatcgatgatgaaggctggctacactctggggatctgggccagctggacggtctgggtttcctctatgtcaccggccacatcaaagaaatccttatcactgctggtggtgaaaatgtgccccccattcctgttgagaccttggttaagaagaagatccccatcatcagtaacgccatgttagtaggagataaactgaagtttctgagcatgttgctgacgctgaagtgtgagatgaatcagatgagcggagaacctctggacaagctgaacttcgaggccatcaacttctgtcggggtctgggcagccaggcatccaccgtgactgagattgtgaagcagcaagaccccctggtctacaaggccatccagcaaggcatcaatgctgtgaaccaggaagccatgaacaatgcacagaggattgaaaagtgggtcatcttggagaaggacttttccatctatggtggagagctaggtccaatgatgaaacttaagagacattttgtagcccagaaatacaaaaaacaaattgatcacatgtaccactgactgctttgatggagctgctctcagctgttctgatgccttcagcaggaagacctcattgcaataagtgaaatgctgctctaggtagaagctctccctgctgtttttaagaagccacattcctcattggtcagtttcttgattgttcgtctgttggagaggtgctccctagaagaacctgccatacgtttcaaagcaataaaatcactgtatatctttctaaggaccttcaagtcatgactccagggaagcctattgggaagtctactaaaaactgcctgatttacaagaaagacctgaacttgtgggctcccatttgatttttttctcctcaggggactcagacattagaaagaaaaagcctcacagatttgaagaactggacccccaaatcaactcacctgcctggaagcaactgggaaacccttccaataagtcctgataataaagcacttcagggtccca

SEQ ID NO: 104374 - DNA, 619 bp, Homo sapiens
  Payload ID: 501
  Gene Symbol: ACSBG2
  Gene Name: acyl-CoA synthetase bubblegum family member 2
  ENST ID: ENST00000591738
  CDS Start-End: 232-619
caagactcccgtctcaaaaaacgaaagaaaagaaagaaaccactcccagactccctgcctgggcgggatcctttgatcaagccctcaacatgccttggggctctcttcacaatggaagaagaaaacacctgagtgaccagatgtcccagctccaggtgccttgccagatggccagaaccacacctcttgaagagtgacagtgctgtggagcatggtttctgcacacctggaatgactggaaccccaaagactcaagaaggagctaaagatcttgaagtagacatgaataaaacagaagttactcccaggctgtggaccacctgtcgagatggagaagtccttctgaggctatccaaacacggaccaggccatgagaccccgatgaccatccctgaattttttcgagagtcagtcaaccgatttggaacttatccagccctcgcatccaagaatggcaaaaagtgggaaattctgaatttcaaccagtactatgaggcttgtcggaaggctgcaaaatccttgatcaagctgggtttggagcgtttccacggagttggtatcctggggtttaactctgcagagtggtttatcactgctgttggtgccatcctagccgggt

SEQ ID NO: 104375 - DNA, 599 bp, Homo sapiens
  Payload ID: 501
  Gene Symbol: ACSBG2
  Gene Name: acyl-CoA synthetase bubblegum family member 2
  ENST ID: ENST00000589401
  CDS Start-End: 372-599
ctgttgtggagggaaaccacccatcctcctgcctcccaccaccaccatcatcctggctggacggagagggtgacgggggctgggaaggggcagctcatgttcaggtttccaggaggggctacctgttgactgtctttgcaggaagaagaaaacacctgagtgaccagatgtcccagctccaggtgccttgccagatggccagaaccacacctcttgaagagtgacaggtgccagtgccaggcgtagtggcatgcttctgtagtcccagctatctgaggggaagagagttccaggcagagggcacagcccgtacgaaggccccaaggaaggactgcacctgtgctgtggagcatggtttctgcacacctggaatgactggaaccccaaagactcaagaaggagctaaagatcttgaagtagacatgaataaaacagaagttactcccaggctgtggaccacctgtcgagatggagaagtccttctgaggctatccaaacacggaccaggccatgagaccccgatgaccatccctgaattttttcgagagtcagtcaaccgatttggaacttatccagccctcgcatccaagaatggcaaa

SEQ ID NO: 104376 - DNA, 881 bp, Homo sapiens
  Payload ID: 501
  Gene Symbol: ACSBG2
  Gene Name: acyl-CoA synthetase bubblegum family member 2
  ENST ID: ENST00000592677
  CDS Start-End: 261-665
gcctgttgtggagggaaaccacccatcctcctgcctcccaccaccaccatcatcctggctggacggagagggtgacgggggctgggaaggggcagctcatgttcaggtttccaggaggggctacctgttgactgtctttgcaggaagaagaaaacacctgagtgaccagatgtcccagctccaggtgccttgccagatggccagaaccacacctcttgaagagtgacagtgctgtggagcatggtttctgcacacctggaatgactggaaccccaaagactcaagaaggagctaaagatcttgaagtagacatgaataaaacagaagttactcccaggctgtggaccacctgtcgagatggagaagtccttctgaggctatccaaacacggaccaggccatgagaccccgatgaccatccctgaattttttcgagagtcagtcaaccgatttggaacttatccagccctcgcatccaagaatggcaaaaagtgggaaattctgaatttcaaccagtactatgaggcttgtcggaaggctgcaaaatccttgatcaagctgggtttggagcgtttccacggagttggtatcctggggtttaactctgcagagtggtttatcactgctgttggtgccatcctagccggattccacagagcagcctagagcccctaaaagcgatcatccagtacagactgccaatgaagaagaacaacaacttgtactcttgggatgatttcatggaacttggcagaagtatccctgacacccaactggagcaggtcatcgagagccagaaggcgaatcaatgcgcagtgctcatctacacttcagggaccacaggcatacccaagggagtgatgctcagtcatgacaacgtac

SEQ ID NO: 104377 - DNA, 2235 bp, Homo sapiens
  Payload ID: 502
  Gene Symbol: ACSF2
  Gene Name: acyl-CoA synthetase family member 2
  Uniprot ID: Q96CM8
  ENST ID: ENST00000300441
  CDS Start-End: 105-1952
ataggcagaggccaccctccccgcctccccgcccgctgcgcgcccgccccgccccggctcactttaaaagtttactcgggccgggacgcagggcaaagcgagccatggctgtctacgtcgggatgctgcgcctggggaggctgtgcgccgggagctcgggggtgctgggggcccgggccgccctctctcggagttggcaggaagccaggttgcagggtgtccgcttcctcagttccagagaggtggatcgcatggtctccacgcccatcggaggcctcagctacgttcaggggtgcaccaaaaagcatcttaacagcaagactgtgggccagtgcctggagaccacagcacagagggtcccagaacgagaggccttggtcgtcctccatgaagacgtcaggttgacctttgcccaactcaaggaggaggtggacaaagctgcttctggcctcctgagcattggcctctgcaaaggtgaccggctgggcatgtggggacctaactcctatgcatgggtgctcatgcagttggccaccgcccaggcgggcatcattctggtgtctgtgaacccagcctaccaggctatggaactggagtatgtcctcaagaaggtgggctgcaaggcccttgtgttccccaagcaattcaagacccagcaatactacaacgtcctgaagcagatctgtccagaagtggagaatgcccagccaggggccttgaagagtcagaggctcccagatctgaccacagtcatctcggtggatgcccctttgccggggaccctgctcctggatgaagtggtggcggctggcagcacacggcagcatctggaccagctccaatacaaccagcagttcctgtcctgccatgaccccatcaacatccagttcacctcggggacaacaggcagccccaagggggccaccctctcccactacaacattgtcaacaactccaacattttaggagagcgcctgaaactgcatgagaagacaccagagcagttgcggatgatcctgcccaaccccctgtaccattgcctgggttccgtggcaggcacaatgatgtgtctgatgtacggtgccaccctcatcctggcctctcccatcttcaatggcaagaaggcactggaggccatcagcagagagagaggcaccttcctgtatggtacccccacgatgttcgtggacattctgaaccagccagacttctccagttatgacatctcgaccatgtgtggaggtgtcattgctgggtcccctgcacctccagagttgatccgagccatcatcaacaagataaatatgaaggacctggtggttgcttatggaaccacagagaacagtcccgtgacattcgcgcacttccctgaggacactgtggagcagaaggcagaaagcgtgggcagaattatgcctcacacggaggcccggatcatgaacatggaggcagggacgctggcaaagctgaacacgcccggggagctgtgcatccgagggtactgcgtcatgctgggctactggggtgagcctcagaagacagaggaagcagtggatcaggacaagtggtattggacaggagatgtcgccacaatgaatgagcagggcttctgcaagatcgtgggccgctctaaggatatgatcatccggggtggtgagaacatctaccccgcagagctcgaggacttctttcacacacacccgaaggtgcaggaagtgcaggtggtgggagtgaaggacgatcggatgggggaagagatttgtgcctgcattcggctgaaggacggggaggagaccacggtggaggagataaaagctttctgcaaagggaagatctctcacttcaagattccgaagtacatcgtgtttgtcacaaactaccccctcaccatttcaggaaagatccagaaattcaaacttcgagagcagatggaacgacatctaaatctgtgaataaagcagcaggcctgtcctggccggttggcttgactctctcctgtcagaatgcaacctggctttatgcacctagatgtccccagcacccagttctgagccaggcacatcaaatgtcaaggaattgactgaacgaactaagagctcctggatgggtccgggaactcgcctgggcacaaggtgccaaaaggcaggcagcctgcccaggccctccctcctgtccatcccccacattcccctgtctgtccttgtgatttggcataaagagcttctgttttctttg

SEQ ID NO: 104378 - DNA, 2251 bp, Homo sapiens
  Payload ID: 502
  Gene Symbol: ACSF2
  Gene Name: acyl-CoA synthetase family member 2
  Uniprot ID: Q96CM8
  ENST ID: ENST00000427954
  CDS Start-End: 44-1966
ctttaaaagtttactcgggccgggacgcagggcaaagcgagccatggctgtctacgtcgggatgctgcgcctggggaggctgtgcgccgggagctcgggggtgctgggggcccgggccgccctctctcggagttggcaggaagccaggttgcagggtgtccgcttcctcagtgcaaggggtgggatggaagctggcaggcagaggatttcagttcccagtagcttcactgcctctgcagcagcacattccagagaggtggatcgcatggtctccacgcccatcggaggcctcagctacgttcaggggtgcaccaaaaagcatcttaacagcaagactgtgggccagtgcctggagaccacagcacagagggtcccagaacgagaggccttggtcgtcctccatgaagacgtcaggttgacctttgcccaactcaaggaggaggtggacaaagctgcttctggcctcctgagcattggcctctgcaaaggtgaccggctgggcatgtggggacctaactcctatgcatgggtgctcatgcagttggccaccgcccaggcgggcatcattctggtgtctgtgaacccagcctaccaggctatggaactggagtatgtcctcaagaaggtgggctgcaaggcccttgtgttccccaagcaattcaagacccagcaatactacaacgtcctgaagcagatctgtccagaagtggagaatgcccagccaggggccttgaagagtcagaggctcccagatctgaccacagtcatctcggtggatgcccctttgccggggaccctgctcctggatgaagtggtggcggctggcagcacacggcagcatctggaccagctccaatacaaccagcagttcctgtcctgccatgaccccatcaacatccagttcacctcggggacaacaggcagccccaagggggccaccctctcccactacaacattgtcaacaactccaacattttaggagagcgcctgaaactgcatgagaagacaccagagcagttgcggatgatcctgcccaaccccctgtaccattgcctgggttccgtggcaggcacaatgatgtgtctgatgtacggtgccaccctcatcctggcctctcccatcttcaatggcaagaaggcactggaggccatcagcagagagagaggcaccttcctgtatggtacccccacgatgttcgtggacattctgaaccagccagacttctccagttatgacatctcgaccatgtgtggaggtgtcattgctgggtcccctgcacctccagagttgatccgagccatcatcaacaagataaatatgaaggacctggtggttgcttatggaaccacagagaacagtcccgtgacattcgcgcacttccctgaggacactgtggagcagaaggcagaaagcgtgggcagaattatgcctcacacggaggcccggatcatgaacatggaggcagggacgctggcaaagctgaacacgcccggggagctgtgcatccgagggtactgcgtcatgctgggctactggggtgagcctcagaagacagaggaagcagtggatcaggacaagtggtattggacaggagatgtcgccacaatgaatgagcagggcttctgcaagatcgtgggccgctctaaggatatgatcatccggggtggtgagaacatctaccccgcagagctcgaggacttctttcacacacacccgaaggtgcaggaagtgcaggtggtgggagtgaaggacgatcggatgggggaagagatttgtgcctgcattcggctgaaggacggggaggagaccacggtggaggagataaaagctttctgcaaagggaagatctctcacttcaagattccgaagtacatcgtgtttgtcacaaactaccccctcaccatttcaggaaagatccagaaattcaaacttcgagagcagatggaacgacatctaaatctgtgaataaagcagcaggcctgtcctggccggttggcttgactctctcctgtcagaatgcaacctggctttatgcacctagatgtccccagcacccagttctgagccaggcacatcaaatgtcaaggaattgactgaacgaactaagagctcctggatgggtccgggaactcgcctgggcacaaggtgccaaaaggcaggcagcctgcccaggccctccctcctgtccatcccccacattcccctgtctgtccttgtgatttggcataaagagcttctgttttctttggc

SEQ ID NO: 104379 - DNA, 407 bp, Homo sapiens
  Payload ID: 502
  Gene Symbol: ACSF2
  Gene Name: acyl-CoA synthetase family member 2
  ENST ID: ENST00000510262
  CDS Start-End: 1-314
atggcaagaaggcactggaggccatcagcagagagagaggcaccttcctgtatggtacccccacgatgttcgtggacattctgaaccagccagacttctccagttatgacatctcgaccatgtgtggaggtgtcattgctgggtcccctgcacctccagagttgatccgagccatcatcaacaagataaatatgaaggacctggtgaaatctcaggaagaaattgcagcatgggaagatggacagcaaagcaccgatgtcctgctagaacgtcctggcaggttgcttatggaaccacagagaacagtcccgtgacattcgcgcacttccctgaggacactgtggagcagaaggcagaaagcgtgggcagaattatgcctcacacggaggcccggatcatgaacatgg

SEQ ID NO: 104380 - DNA, 2098 bp, Homo sapiens
  Payload ID: 502
  Gene Symbol: ACSF2
  Gene Name: acyl-CoA synthetase family member 2
  Uniprot ID: Q96CM8
  ENST ID: ENST00000502667
  CDS Start-End: 11-1819
aaagcgagccatggctgtctacgtcgggatgctgcgcctggggaggctgtgcgccgggagctcgggggtgctgggggcccgggccgccctctctcggagttggcaggaagccaggttgcagggtgtccgcttcctcagttccagagaggtggatcgcatggtctccacgcccatcggaggcctcagctacgttcaggggtgcaccaaaaagcatcttaacagcaagactgtgggccagtgcctggagaccacagcacagagggtcccagaacgagaggccttggtcgtcctccatgaagacgtcaggttgacctttgcccaactcaaggaggaggtggacaaagctgcttctggcctcctgagcattggcctctgcaaaggtgaccggctgggcatgtggggacctaactcctatgcatgggtgctcatgcagttggccaccgcccaggctatggaactggagtatgtcctcaagaaggtgggctgcaaggcccttgtgttccccaagcaattcaagacccagcaatactacaacgtcctgaagcagatctgtccagaagtggagaatgcccagccaggggccttgaagagtcagaggctcccagatctgaccacagtcatctcggtggatgcccctttgccggggaccctgctcctggatgaagtggtggcggctggcagcacacggcagcatctggaccagctccaatacaaccagcagttcctgtcctgccatgaccccatcaacatccagttcacctcggggacaacaggcagccccaagggggccaccctctcccactacaacattgtcaacaactccaacattttaggagagcgcctgaaactgcatgagaagacaccagagcagttgcggatgatcctgcccaaccccctgtaccattgcctgggttccgtggcaggcacaatgatgtgtctgatgtacggtgccaccctcatcctggcctctcccatcttcaatggcaagaaggcactggaggccatcagcagagagagaggcaccttcctgtatggtacccccacgatgttcgtggacattctgaaccagccagacttctccagttatgacatctcgaccatgtgtggaggtgtcattgctgggtcccctgcacctccagagttgatccgagccatcatcaacaagataaatatgaaggacctggtggttgcttatggaaccacagagaacagtcccgtgacattcgcgcacttccctgaggacactgtggagcagaaggcagaaagcgtgggcagaattatgcctcacacggaggcccggatcatgaacatggaggcagggacgctggcaaagctgaacacgcccggggagctgtgcatccgagggtactgcgtcatgctgggctactggggtgagcctcagaagacagaggaagcagtggatcaggacaagtggtattggacaggagatgtcgccacaatgaatgagcagggcttctgcaagatcgtgggccgctctaaggatatgatcatccggggtggtgagaacatctaccccgcagagctcgaggacttctttcacacacacccgaaggtgcaggaagtgcaggtggtgggagtgaaggacgatcggatgggggaagagatttgtgcctgcattcggctgaaggacggggaggagaccacggtggaggagataaaagctttctgcaaagggaagatctctcacttcaagattccgaagtacatcgtgtttgtcacaaactaccccctcaccatttcaggaaagatccagaaattcaaacttcgagagcagatggaacgacatctaaatctgtgaataaagcagcaggcctgtcctggccggttggcttgactctctcctgtcagaatgcaacctggctttatgcacctagatgtccccagcacccagttctgagccaggcacatcaaatgtcaaggaattgactgaacgaactaagagctcctggatgggtccgggaactcgcctgggcacaaggtgccaaaaggcaggcagcctgcccaggccctccctcctgtccatcccccacattcccctgtctgtccttgtgatttggcataaagagcttctgttttc

SEQ ID NO: 104381 - DNA, 665 bp, Homo sapiens
  Payload ID: 502
  Gene Symbol: ACSF2
  Gene Name: acyl-CoA synthetase family member 2
  ENST ID: ENST00000508245
  CDS Start-End: 1-258
acggtgccaccctcatcctggcctctcccatcttcaatggcaagaaggcactggaggccatcagcagagagaggtgtcattgctgggtcccctgcacctccagagttgatccgagccatcatcaacaagataaatatgaaggacctggtgaaatctcaggaagaaattgcagcatgggaagatggacagcaaagcaccgatgtcctgctagaacgtcctggcaggttgcttatggaaccacagagaacagtcccgtgacattcgcgcacttccctgaggacactgtggagcagaaggcagaaagcgtgggcagaattatgcctcacacggaggcccggatcatgaacatggaggcagggacgctggcaaagctgaacacgcccggggagctgtgcatccgagggtactgcgtcatgctgggctactggggtgagcctcagaagacagaggaagcagtggatcaggacaagtggtattggacaggagatgtcgccacaatgaatgagcagggcttctgcaagatcgtgggccgctctaaggatatgatcatccggggtggtgagaacatctaccccgcagagctcgaggacttctttcacacacacccgaaggtgcaggaagtgcaggtggtgggagtgaaggacgatcggatgggggaagagatt

SEQ ID NO: 104382 - DNA, 594 bp, Homo sapiens
  Payload ID: 502
  Gene Symbol: ACSF2
  Gene Name: acyl-CoA synthetase family member 2
  ENST ID: ENST00000506582
  CDS Start-End: 45-594
actttaaaagtttactcgggccgggacgcagggcaaagcgagccatggctgtctacgtcgggatgctgcgcctggggaggctgtgcgccgggagctcgggggtgctgggggcccgggccgccctctctcggagttggcaggaagccaggttgcagggtgtccgcttcctcagttccagagaggtggatcgcatggtctccacgcccatcggaggcctcagctacgttcaggggtgcaccaaaaagcatcttaacagcaagactgtgggccagtgcctggagaccacagcacagagggtcccagaacgagaggccttggtcgtcctccatgaagacgtcaggttgacctttgcccaactcaaggaggaggtggacaaagctgcttctggcctcctgagcattggcctctgcaaaggtgtctgtgaacccagcctaccaggctatggaactggagtatgtcctcaagaaggtgggctgcaaggcccttgtgttccccaagcaattcaagacccagcaatactacaacgtcctgaagcagatctgtccagaagtggagaatgcccagccaggggccttgaagagtcagaggctccca

SEQ ID NO: 104383 - DNA, 1745 bp, Homo sapiens
  Payload ID: 502
  Gene Symbol: ACSF2
  Gene Name: acyl-CoA synthetase family member 2
  ENST ID: ENST00000510410
  CDS Start-End: 105-242
ataggcagaggccaccctccccgcctccccgcccgctgcgcgcccgccccgccccggctcactttaaaagtttactcgggccgggacgcagggcaaagcgagccatggctgtctacgtcgggatgctgcgcctggggaggctgtgcgccgggagctcgggggtgctgggggcccgggccgccctctctcggagttggcaggaagccaggttgcagggtgtccgcttcctcaggtgtctgtgaacccagcctaccaggctatggaactggagtatgtcctcaagaaggtgggctgcaaggcccttgtgttccccaagcaattcaagacccagcaatactacaacgtcctgaagcagatctgtccagaagtggagaatgcccagccaggggccttgaagagtcagaggctcccagatctgaccacagtcatctcggtggatgcccctttgccggggaccctgctcctggatgaagtggtggcggctggcagcacacggcagcatctggaccagctccaatacaaccagcagttcctgtcctgccatgaccccatcaacatccagttcacctcggggacaacaggcagccccaagggggccaccctctcccactacaacattgtcaacaactccaacattttaggagagcgcctgaaactgcatgagaagacaccagagcagttgcggatgatcctgcccaaccccctgtaccattgcctgggttccgtggcaggcacaatgatgtgtctgatgtacggtgccaccctcatcctggcctctcccatcttcaatggcaagaaggcactggaggccatcagcagagagagaggcaccttcctgtatggtacccccacgatgttcgtggacattctgaaccagccagacttctccagttatgacatctcgaccatgtgtggaggtgtcattgctgggtcccctgcacctccagagttgatccgagccatcatcaacaagataaatatgaaggacctggtggttgcttatggaaccacagagaacagtcccgtgacattcgcgcacttccctgaggacactgtggagcagaaggcagaaagcgtgggcagaattatgcctcacacggaggcccggatcatgaacatggaggcagggacgctggcaaagctgaacacgcccggggagctgtgcatccgagggtactgcgtcatgctgggctactggggtgagcctcagaagacagaggaagcagtggatcaggacaagtggtattggacaggagatgtcgccacaatgaatgagcagggcttctgcaagatcgtgggccgctctaaggatatgatcatccggggtggtgagaacatctaccccgcagagctcgaggacttctttcacacacacccgaaggtgcaggaagtgcaggtggtgggagtgaaggacgatcggatgggggaagagatttgtgcctgcattcggctgaaggacggggaggagaccacggtggaggagataaaagctttctgcaaagggaagatctctcacttcaagattccgaagtacatcgtgtttgtcacaaactaccccctcaccatttcaggaaagatccagaaattcaaacttcgagagcagatggaacgacatctaaatctgtgaataaagcagcaggcctgtcctggccggttggcttgactctctcctgtcagaatgcaacctggctttatgcacctagatgtccccagcacccagttctgagccaggcacatcaaatgtc

SEQ ID NO: 104384 - DNA, 1881 bp, Homo sapiens
  Payload ID: 502
  Gene Symbol: ACSF2
  Gene Name: acyl-CoA synthetase family member 2
  ENST ID: ENST00000504392
  CDS Start-End: 45-1763
actttaaaagtttactcgggccgggacgcagggcaaagcgagccatggctgtctacgtcgggatgctgcgcctggggaggctgtgcgccgggagctcgggggtgctgggggcccgggccgccctctctcggagttggcaggaagccaggttgcagggtgtccgcttcctcagttccagagaggtggatcgcatggtctccacgcccatcggaggcctcagctacgttcaggggtgcaccaaaaagcatcttaacagcaagactgtgggccagtgcctggagaccacagcacagagggtcccagaacgagaggccttggtcgtcctccatgaagacgtcaggttgacctttgcccaactcaaggaggaggtgtctgtgaacccagcctaccaggctatggaactggagtatgtcctcaagaaggtgggctgcaaggcccttgtgttccccaagcaattcaagacccagcaatactacaacgtcctgaagcagatctgtccagaagtggagaatgcccagccaggggccttgaagagtcagaggctcccagatctgaccacagtcatctcggtggatgcccctttgccggggaccctgctcctggatgaagtggtggcggctggcagcacacggcagcatctggaccagctccaatacaaccagcagttcctgtcctgccatgaccccatcaacatccagttcacctcggggacaacaggcagccccaagggggccaccctctcccactacaacattgtcaacaactccaacattttaggagagcgcctgaaactgcatgagaagacaccagagcagttgcggatgatcctgcccaaccccctgtaccattgcctgggttccgtggcaggcacaatgatgtgtctgatgtacggtgccaccctcatcctggcctctcccatcttcaatggcaagaaggcactggaggccatcagcagagagagaggcaccttcctgtatggtacccccacgatgttcgtggacattctgaaccagccagacttctccagttatgacatctcgaccatgtgtggaggtgtcattgctgggtcccctgcacctccagagttgatccgagccatcatcaacaagataaatatgaaggacctggtggttgcttatggaaccacagagaacagtcccgtgacattcgcgcacttccctgaggacactgtggagcagaaggcagaaagcgtgggcagaattatgcctcacacggaggcccggatcatgaacatggaggcagggacgctggcaaagctgaacacgcccggggagctgtgcatccgagggtactgcgtcatgctgggctactggggtgagcctcagaagacagaggaagcagtggatcaggacaagtggtattggacaggagatgtcgccacaatgaatgagcagggcttctgcaagatcgtgggccgctctaaggatatgatcatccggggtggtgagaacatctaccccgcagagctcgaggacttctttcacacacacccgaaggtgcaggaagtgcaggtggtgggagtgaaggacgatcggatgggggaagagatttgtgcctgcattcggctgaaggacggggaggagaccacggtggaggagataaaagctttctgcaaagggaagatctctcacttcaagattccgaagtacatcgtgtttgtcacaaactaccccctcaccatttcaggaaagatccagaaattcaaacttcgagagcagatggaacgacatctaaatctgtgaataaagcagcaggcctgtcctggccggttggcttgactctctcctgtcagaatgcaacctggctttatgcacctagatgtccccagcacccagttctgagccaggcacatcaaatgtc

SEQ ID NO: 104385 - DNA, 554 bp, Homo sapiens
  Payload ID: 502
  Gene Symbol: ACSF2
  Gene Name: acyl-CoA synthetase family member 2
  ENST ID: ENST00000503408
  CDS Start-End: 45-209
actttaaaagtttactcgggccgggacgcagggcaaagcgagccatggctgtctacgtcgggatgctgcgcctggggaggctgtgcgccgggagctcgggggtgctgggggcccgggccgccctctctcggagttggcaggaagccaggttgcagggtgtccgcttcctcaggccctcaggagaaaaactggcccaccaaggagtctaaaatcctaagaccttggattcaagcccagggtccaggcacgcttccctggttcctcaggaaggaccccagtgacctgtttattctccaggaggcaggggctaggggtgaaggcatggtcctgctttttccagagaggtggatcgcatggtctccacgcccatcggaggcctcagctacgttcaggggtgcaccaaaaagcatcttaacagcaagactgtgggccagtgcctggagaccacagcacagagggtcccagaacgagaggccttggtcgtcctccatgaagacgtcaggttgacctttgcccaactcaaggaggaggtggacaaagctgcttctggcctc

SEQ ID NO: 104386 - DNA, 3664 bp, Homo sapiens
  Payload ID: 503
  Gene Symbol: ACSF3
  Gene Name: acyl-CoA synthetase family member 3
  Uniprot ID: Q4G176
  ENST ID: ENST00000317447
  CDS Start-End: 378-2108
gggggacgcgcttgggcgacggacgcgccgcgccggggaagctgttgggcgccggaactggtccggcccgactcacgaccccgcgggacccggccggaacccggcccgaccccggcgcgcgcgcggcggaggacgaggaagagttgtggcgaggcagatcctgccccgtggccgcggccgtctcgtgtcccaccggccttccgggttccagcgccaggcctggtgcctgccccaggaggatgagcatttgcattgcctgcaccttatcgtgcccttccacctgctgaagcagctgtgcctgccgctcttgtgaactgcgaacttccccttacctcctctctctggctcgggagctggctcggccgcctgtcagtgcaatgctgccccatgtggtgctcaccttccggcgcctgggctgcgccttggcgtcctgccggctggcgcctgcgagacacagaggaagtggtcttctgcacacagccccagtggcccgctcggacaggagcgccccggtgttcacccgtgccctggcctttggggacagaatcgccctggttgaccagcacggccgccacacgtacagggagctttattcccgcagccttcgcctgtcccaggagatctgcaggctctgcgggtgtgtcggcggggacctccgggaggagagggtctccttcctatgcgctaacgatgcctcctacgtcgtggcccagtgggcgtcatggatgagtggcggtgtggcagtccccctctacaggaagcatcccgcggcccagctggagtatgtcatctgcgactcccagagctctgtggtccttgccagccaggagtacctggagctcctgagcccggtggtcaggaagctgggggtcccgctgctgccgctcacaccagccatctacactggagcagtagaggaaccggcagaggtcccggtcccagagcagggatggaggaacaagggcgccatgatcatctacaccagtgggaccacggggaggcccaagggcgtgctgagcacgcaccaaaacatcagggctgtggtgaccgggctggtccacaagtgggcatggaccaaagacgacgtgatcctccacgtgctcccgctgcaccacgtccatggtgtggtcaacgcgctgctctgtcctctctgggtgggagccacctgtgtgatgatgcctgagttcagccctcagcaggtttgggaaaagttcttaagttctgaaacgccgcggatcaatgtctttatggcagtgcctacaatatacaccaagctgatggagtactacgacaggcattttacccagccgcacgcccaggatttcttgcgtgcagtttgtgaagaaaaaattaggctgatggtctcaggctcagctgccctgcccctcccagtgctggagaagtggaagaacatcacgggccacaccctgctggagcggtatggcatgaccgagatcggcatggctctgtccgggcccctgaccactgccgtgcgcctgccaggttccgtggggaccccactgcctggagtacaggtgcgcattgtctcagaaaacccacagagggaagcctgctcctacaccatccacgcagagggagacgagagggggaccaaggtgaccccagggtttgaagaaaaggagggggagctgctggtgaggggaccctccgtgtttcgagaatactggaataaaccagaagaaactaagagtgcattcaccctggatggctggtttaagacaggggacaccgtggtgtttaaggatggccagtactggatccgaggccggacctcagtggacatcatcaagactggaggctacaaggtcagcgccctggaggtggagtggcacctgctggcccaccccagcatcacagatgtggctgtgattggagttccggatatgacatggggccagcgggtcactgctgtggtgaccctccgagaaggacactcactgtcccacagggagctcaaagagtgggccagaaatgtcctggccccgtacgcggtgccctcggagctggtgctggtggaggagatcccgcggaaccagatgggcaagattgacaagaaggcgctcatcaggcacttccacccctcatgacccggcagactgggactgcgggtctggtggggagcagcagacgtccccttcacaccgagaaccacgggggcccgtccaagacctggcctcccttaaacctgaaccccccaaatcaggtcacgtagaatcaagaactgtttgggatgaaatcaccatgtggggtccccagcctcgggccagttgttgcagctcaaggagaccgtccctggtgtcacctctgcctggtcaccgccgacctcatctgtgcagcgcggtgcagccagcccctggccccacgtgctgaggcacctcccgccccacagtgccctgcagttgccaggctctccagggcaggtcccagaggtttcccacaaaaaacaaagactccactggaggaaacaagcccctgtcccacgccgtctgcacgtgcctgtgcctcacccagagccagtgtctcccggcccacataggaggtctgggcagccacccagggggccctcctgggaggagctgagggttcacaagcctcccagaaccagccctgtcccatgggttccgtgcatttcctggtgctgctcttggaggagagcagctcccactgtggggacacctgccaccctgcacactactgtgtgtccatcagcatgtgtcacagaaagtgcgtggacggatggccccggagctgctctgccgtgaccctgcctcaccccccagcgcagggactttccaggtcatctccacaccagcccctcagccggtgaaccctctctcccatcaccgtctccacccagacccccacctgccccatggcccccatttcatgtctgtggctcaccagcttttccccagacccagctccggagcccacaggcgtggccgatgcagaaacctcaggaaggtgtgttgtgaatgttgggtgcacccacgttgcatttacttagcggggccaattcagatgcacaggggccacatgcagaatccagaagtttctggacaattttcagaagaataggctgcctcctccccacagcctgggggaagtaacagtcatcgcccagcagtgtctggcctgaacttacccagaacattctgcccccggaatgcacgtctgaaagagtggccagaaacgagtgtgccgggcaggaggccagccccatctcaggctcacgtgcctctgacaggagaccagccccatctcaggctcacatgcctcgcggacagttggacgtggcctggggcccctgctcacttgagcatgtcgcccaccaagcttgtctgaggccacagagcagcgtcccagccctgttttccaggactggtgggtgccccagtccacggccctgccccacccgaactcctgcctcacggtgtggccttgtgcatccccatggcctgaccccgggaacagtcagaggaaggggtcccgccctcccgccagaggcctggacccaagggaacggcagtcagagactacagtccagacgtttgtgtctaggccttgctggtagctaaggaaatgccttctgttgggaaaaggtcaaatttaacatagcaaaatttttacttaattccactaa

SEQ ID NO: 104387 - DNA, 1541 bp, Homo sapiens
  Payload ID: 503
  Gene Symbol: ACSF3
  Gene Name: acyl-CoA synthetase family member 3
  ENST ID: ENST00000378345
  CDS Start-End: 225-1160
ccggccggaacccggcccgaccccggcgcgcgcgcggcggaggacgaggaagagttgtggcgaggcagatcctgccccgtggccgcggccgtctcgtgaccgggctggtccacaagtgggcatggaccaaagacgacgtgatcctccacgtgctcccgctgcaccacgtccatggtgtggtcaacgcgctgctctgtcctctctgggtgggagccacctgtgtgatgatgcctgagttcagccctcagcaggtttgggaaaagttcttaagttctgaaacgccgcggatcaatgtctttatggcagtgcctacaatatacaccaagctgatggagtactacgacaggcattttacccagccgcacgcccaggatttcttgcgtgcagtttgtgaagaaaaaattaggctgatggtctcaggctcagctgccctgcccctcccagtgctggagaagtggaagaacatcacgggccacaccctgctggagcggtatggcatgaccgagatcggcatggctctgtccgggcccctgaccactgccgtgcgcctgccaggttccgtggggaccccactgcctggagtacaggtgcgcattgtctcagaaaacccacagagggaagcctgctcctacaccatccacgcagagggagacgagagggggaccaaggtgaccccagggtttgaagaaaaggagggggagctgctggtgaggggaccctccgtgtttcgagaatactggaataaaccagaagaaactaagagtgcattcaccctggatggctggtttaagacaggggacaccgtggtgtttaaggatggccagtactggatccgaggccggacctcagtggacatcatcaagactggaggctacaaggtcagcgccctggaggtggagtggcacctgctggcccaccccagcatcacagatgtggctgtgattggagttccggatatgacatggggccagcgggtcactgctgtggtgaccctccgagaaggacactcactgtcccacagggagctcaaagagtgggccagaaatgtcctggccccgtacgcggtgccctcggagctggtgctggtggaggagatcccgcggaaccagatgggcaagattgacaagaaggcgctcatcaggcacttccacccctcatgacccggcagactgggactgcgggtctggtggggagcagcagacgtccccttcacaccgagaaccacgggggcccgtccaagacctggcctcccttaaacctgaaccccccaaatcaggtcacgtagaatcaagaactgtttgggatgaaatcaccatgtggggtccccagcctcgggccagttgttgcagctcaaggagaccgtccctggtgtcacctctgcctggtcaccgccgacctcatctgtgcagcgcggtgcagccagcccctggccccacgtgctgaggcacctcccgccccacagtgccctgcagttgccaggctctccagggcaggtcccagaggtttcccacaaaaaacaaagactccactggaggaaacaa

SEQ ID NO: 104388 - DNA, 2247 bp, Homo sapiens
  Payload ID: 503
  Gene Symbol: ACSF3
  Gene Name: acyl-CoA synthetase family member 3
  Uniprot ID: Q4G176
  ENST ID: ENST00000406948
  CDS Start-End: 135-1865
acgaccccgcgggacccggccggaacccggcccgaccccggcgcgcgcgcggcggaggacgaggaagagttgtggcgaggcagatcctgccccgtggccgcggccgtctcgtagctcggccgcctgtcagtgcaatgctgccccatgtggtgctcaccttccggcgcctgggctgcgccttggcgtcctgccggctggcgcctgcgagacacagaggaagtggtcttctgcacacagccccagtggcccgctcggacaggagcgccccggtgttcacccgtgccctggcctttggggacagaatcgccctggttgaccagcacggccgccacacgtacagggagctttattcccgcagccttcgcctgtcccaggagatctgcaggctctgcgggtgtgtcggcggggacctccgggaggagagggtctccttcctatgcgctaacgatgcctcctacgtcgtggcccagtgggcgtcatggatgagtggcggtgtggcagtccccctctacaggaagcatcccgcggcccagctggagtatgtcatctgcgactcccagagctctgtggtccttgccagccaggagtacctggagctcctgagcccggtggtcaggaagctgggggtcccgctgctgccgctcacaccagccatctacactggagcagtagaggaaccggcagaggtcccggtcccagagcagggatggaggaacaagggcgccatgatcatctacaccagtgggaccacggggaggcccaagggcgtgctgagcacgcaccaaaacatcagggctgtggtgaccgggctggtccacaagtgggcatggaccaaagacgacgtgatcctccacgtgctcccgctgcaccacgtccatggtgtggtcaacgcgctgctctgtcctctctgggtgggagccacctgtgtgatgatgcctgagttcagccctcagcaggtttgggaaaagttcttaagttctgaaacgccgcggatcaatgtctttatggcagtgcctacaatatacaccaagctgatggagtactacgacaggcattttacccagccgcacgcccaggatttcttgcgtgcagtttgtgaagaaaaaattaggctgatggtctcaggctcagctgccctgcccctcccagtgctggagaagtggaagaacatcacgggccacaccctgctggagcggtatggcatgaccgagatcggcatggctctgtccgggcccctgaccactgccgtgcgcctgccaggttccgtggggaccccactgcctggagtacaggtgcgcattgtctcagaaaacccacagagggaagcctgctcctacaccatccacgcagagggagacgagagggggaccaaggtgaccccagggtttgaagaaaaggagggggagctgctggtgaggggaccctccgtgtttcgagaatactggaataaaccagaagaaactaagagtgcattcaccctggatggctggtttaagacaggggacaccgtggtgtttaaggatggccagtactggatccgaggccggacctcagtggacatcatcaagactggaggctacaaggtcagcgccctggaggtggagtggcacctgctggcccaccccagcatcacagatgtggctgtgattggagttccggatatgacatggggccagcgggtcactgctgtggtgaccctccgagaaggacactcactgtcccacagggagctcaaagagtgggccagaaatgtcctggccccgtacgcggtgccctcggagctggtgctggtggaggagatcccgcggaaccagatgggcaagattgacaagaaggcgctcatcaggcacttccacccctcatgacccggcagactgggactgcgggtctggtggggagcagcagacgtccccttcacaccgagaaccacgggggcccgtccaagacctggcctcccttaaacctgaaccccccaaatcaggtcacgtagaatcaagaactgtttgggatgaaatcaccatgtggggtccccagcctcgggccagttgttgcagctcaaggagaccgtccctggtgtcacctctgcctggtcaccgccgacctcatctgtgcagcgcggtgcagccagcccctggccccacgtgctgaggcacctcccgccccacagtgccctgcagttgccaggctctccagggcaggtcccagaggtttcccacaaaaaacaaagactccactggaggaaacaag

SEQ ID NO: 104389 - DNA, 550 bp, Homo sapiens
  Payload ID: 503
  Gene Symbol: ACSF3
  Gene Name: acyl-CoA synthetase family member 3
  ENST ID: ENST00000537895
  CDS Start-End: 234-550
agtttccagggggctcattaagggagatgtggacagaatccgtggcggggtggtgattcccacccagcctctgccagtttccagggagctccattaggccagaggtgaccgggctggtccacaagtgggcatggaccaaagacgacgtgatcctccacgtgctcccgctgcaccacgtccatggtgtggtcaacgcgctgctctgtcctctctgggtgggagccacctgtgtgatgatgcctgagttcagccctcagcaggtttgggaaaagttcttaagttctgaaacgccgcggatcaatgtctttatggcagtgcctacaatatacaccaagctgatggagtactacgacaggcattttacccagccgcacgcccaggatttcttgcgtgcagtttgtgaagaaaaaattaggctgatggtctcaggctcagctgccctgcccctcccagtgctggagaagtggaagaacatcacgggccacaccctgctggagcggtatggcatgaccgagatcggcatggctctgtccgggcccctgaccactgc

SEQ ID NO: 104390 - DNA, 869 bp, Homo sapiens
  Payload ID: 503
  Gene Symbol: ACSF3
  Gene Name: acyl-CoA synthetase family member 3
  ENST ID: ENST00000537290
  CDS Start-End: 159-869
gggcgccggaactggtccggcccgactcacgaccccgcgggacccggccggaacccggcccgaccccggcgcgcgcgcggcggaggacgaggaagagttgtggcgaggcagatcctgccccgtggccgcggccgtctcctcggccgcctgtcagtgcaatgctgccccatgtggtgctcaccttccggcgcctgggctgcgccttggcgtcctgccggctggcgcctgcgagacacagaggaagtggtcttctgcacacagccccagtggcccgctcggacaggagcgccccggtgttcacccgtgccctggcctttggggacagaatcgccctggttgaccagcacggccgccacacgtacagggagctttattcccgcagccttcgcctgtcccaggagatctgcaggctctgcgggtgtgtcggcggggacctccgggaggagagggtctccttcctatgcgctaacgatgcctcctacgtcgtggcccagtgggcgtcatggatgagtggcggtgtggcagtccccctctacaggaagcatcccgcggcccagctggagtatgtcatctgcgactcccagagctctgtggtccttgccagccaggagtacctggagctcctgagcccggtggtcaggaagctgggggtcccgctgctgccgctcacaccagccatctacactggagcagtagaggaaccggcagaggtcccggtcccagagcagggatggaggaacaagggcgccatgatcatctacaccagtgggaccacggggaggcccaagggcgtgctgagcacgcaccaaaacatcagggctgtggtgaccgggctggtccacaagtgggcatggaccaaagacgacgtg

SEQ ID NO: 104391 - DNA, 940 bp, Homo sapiens
  Payload ID: 503
  Gene Symbol: ACSF3
  Gene Name: acyl-CoA synthetase family member 3
  ENST ID: ENST00000543676
  CDS Start-End: 1-550
gctgctctgtcctctctgggtgggagccacctgtgtgatgatgcctgagttcagccctcagcaggtttgggaaaagttcttaagttctgaaacgccgcggatcaatgtctttatggcagtgcctacaatatacaccaagctgatggagtactacgacaggcattttacccagccgcacgcccaggatttcttgcgtgcagtttgtgaagaaaaaattaggctgatggtctcaggctcagctgccctgcccctcccagtgctggagaagtggaagaacatcacgggccacaccctgctggagcggtatggcatgaccgagatcggcatggctctgtccgggcccctgaccactgccgtgcgcctgccaggttccgtggggaccccactgcctggagtacaggtgcgcattgtctcagaaaacccacagagggaagcctgctcctacaccatccacgcagagggagacgagagggggaccaagggccccagcccatgctgttgtcctgacatgcctctcctgggattcctgcctctgccctgctggtactaggctgctggccacaccccacatctcaggttcctgaatacaccggcccttcctggctctcaagtctgtgccctgcagtgcccctgcccccaactcgaggacctcccagctcagccagttccaaccctgtctgcagggacggggctcagcctgtgcctgggttggggacaccatctagtcagaaatgtccccagcagagagcagaacgtgagtggcgtgtggaggagtgagacgccccgtggctgtgcagccctctccaggtgtcagtcagctgacactcctgcctctgagcacctgctctgccggaaatggcagaaatgttgccagagaaaggggcggagcgggggtggggagcatttctgtcttaaattaaaacaaaacttaactgcttca

SEQ ID NO: 104392 - DNA, 883 bp, Homo sapiens
  Payload ID: 503
  Gene Symbol: ACSF3
  Gene Name: acyl-CoA synthetase family member 3
  ENST ID: ENST00000544543
  CDS Start-End: 179-883
aattccctaaagcctctggctgtgtgtggcgctgtcctctgtccccagggtgaccgggctggtccacaagtgggcatggaccaaagacgacgtgatcctccacgtgctcccgctgcaccacgtccatggtgtggtcaacgcgctgctctgtcctctctgggtgggagccacctgtgtgatgatgcctgagttcagccctcagcaggtttgggaaaagttcttaagttctgaaacgccgcggatcaatgtctttatggcagtgcctacaatatacaccaagctgatggagtactacgacaggcattttacccagccgcacgcccaggatttcttgcgtgcagtttgtgaagaaaaaattaggctgatggtctcaggctcagctgccctgcccctcccagtgctggagaagtggaagaacatcacgggccacaccctgctggagcggtatggcatgaccgagatcggcatggctctgtccgggcccctgaccactgccgtgcgcctgccaggttccgtggggaccccactgcctggagtacaggtgcgcattgtctcagaaaacccacagagggaagcctgctcctacaccatccacgcagagggagacgagagggggaccaaggtgaccccagggtttgaagaaaaggagggggagctgctggtgaggggaccctccgtgtttcgagaatactggaataaaccagaagaaactaagagtgcattcaccctggatggctggtttaagacaggggacaccgtggtgtttaaggatggccagtactggatccgaggccggacctcagtggacatcatcaagactggaggctacaaggtcagcgccctggaggtggagtggcacctgctggcccaccccagcatcaca

SEQ ID NO: 104393 - DNA, 421 bp, Homo sapiens
  Payload ID: 503
  Gene Symbol: ACSF3
  Gene Name: acyl-CoA synthetase family member 3
  ENST ID: ENST00000535176
  CDS Start-End: 1-320
ttggagttccggatatgacatggggccagcgggtcactgctgtggtgaccctccgagaaggacactcactgtcccacagggagctcaaagagtgggccaggttgaaagaacacccaaccaagaggagagaaaacagcattctaaatatcggaaggaaacgaaacctcgcctcaggcatgcgggctctgacgggcaggatggcggcacggagggctgctgtatccagtgaagtcagcagttcagatgaaacagataactcccttaaaagacacaaattgccaagactgacgcaaacactgaaacagactgaacagttctgagttaccaatttaaaactgcaaagcaaatagcaggcccaaaaggcttcactgataaattatctcaaacattgaaggcaaaaaataaaaccagacacagcaaa

SEQ ID NO: 104394 - DNA, 829 bp, Homo sapiens
  Payload ID: 503
  Gene Symbol: ACSF3
  Gene Name: acyl-CoA synthetase family member 3
  ENST ID: ENST00000540697
  CDS Start-End: 259-829
ggtccggcccgactcacgaccccgcgggacccggccggaacccggcccgaccccggcgcgcgcgcggcggaggacgaggaagagttgtggcgaggcagatcctgccccgtggccgcggccgtctcgtaggtgaccgggctggtccacaagtgggcatggaccaaagacgacgtgatcctccacgtgctcccgctgcaccacgtccatggtgtggtcaacgcgctgctctgtcctctctgggtgggagccacctgtgtgatgatgcctgagttcagccctcagcaggtttgggaaaagttcttaagttctgaaacgccgcggatcaatgtctttatggcagtgcctacaatatacaccaagctgatggagtactacgacaggcattttacccagccgcacgcccaggatttcttgcgtgcagtttgtgaagaaaaaattaggctgatggtctcaggctcagctgccctgcccctcccagtgctggagaagtggaagaacatcacgggccacaccctgctggagcggtatggcatgaccgagatcggcatggctctgtccgggcccctgaccactgccgtgcgcctgccaggttccgtggggaccccactgcctggagtacaggtgcgcattgtctcagaaaacccacagagggaagcctgctcctacaccatccacgcagagggagacgagagggggaccaaggtgaccccagggtttgaagaaaaggagggggagctgctggtgaggggaccctccgtgtttcgagaatactggaataaaccagaagaaactaagagtgcattcaccctggatggctggtttaagacag

SEQ ID NO: 104395 - DNA, 434 bp, Homo sapiens
  Payload ID: 503
  Gene Symbol: ACSF3
  Gene Name: acyl-CoA synthetase family member 3
  ENST ID: ENST00000538340
  CDS Start-End: 1-434
ctggtccacaagtgggcatggaccaaagacgacgtgatcctccacgtgctcccgctgcaccacgtccatggtgtggtcaacgcgctgctctgtcctctctgggtgggagccacctgtgtgatgatgcctgagttcagccctcagcaggtttgggaaaagttcttaagttctgaaacgccgcggatcaatgtctttatggcagtgcctacaatatacaccaagctgatggagtactacgacaggcattttacccagccgcacgcccaggatttcttgcgtgcagtttgtgaagaaaaaattaggttccgtggggaccccactgcctggagtacaggtgcgcattgtctcagaaaacccacagagggaagcctgctcctacaccatccacgcagagggagacgagagggggaccaagggccccagcccatgctgtt

SEQ ID NO: 104396 - DNA, 2024 bp, Homo sapiens
  Payload ID: 503
  Gene Symbol: ACSF3
  Gene Name: acyl-CoA synthetase family member 3
  ENST ID: ENST00000542688
  CDS Start-End: 110-1216
ctcttgtgaactgcgaacttccccttacctcctctctctggctcgggagctggttgggcactcacgtcctgtgccttgcctttctccagctcggccgcctgtcagtgcaatgctgccccatgtggtgctcaccttccggcgcctgggctgcgccttggcgtcctgccggctggcgcctgcgagacacagaggaagtggtcttctgcacacagccccagtggcccgctcggacaggagcgccccggtgttcacccgtgccctggcctttggggacagaatcgccctggttgaccagcacggccgccacacgtacagggagctttattcccgcagccttcgcctgtcccaggagatctgcaggctctgcgggtgtgtcggcggggacctccgggaggagagggtctccttcctatgcgctaacgatgcctcctacgtcgtggcccagtgggcgtcatggatgagtggcggtgtggcagtccccctctacaggaagcatcccgcggcccagctggagtatgtcatctgcgactcccagagctctgtggtccttgccagccaggagtacctggagctcctgagcccggtggtcaggaagctgggggtcccgctgctgccgctcacaccagccatctacactggagcagtagaggaaccggcagaggtcccggtcccagagcagggatggaggaacaagggcgccatgatcatctacaccagtgggaccacggggaggcccaagggcgtgctgagcacgcaccaaaacatcagggctgtggtgaccgggctggtccacaagtgggcatggaccaaagacgacgtgatcctccacgtgctcccgctgcaccacgtccatggtgtggtcaacgcgctgctctgtcctctctgggtgggagccacctgtgtgatgatgcctgagttcagccctcagcaggtttgggaaaagttcttaagttctgaaacgccgcggatcaatgtctttatggcagtgcctacaatatacaccaagctgatggagtactacgacaggcattttacccagccgcacgcccaggatttcttgcgtgcagtttgtgaagaaaaaattaggttccgtggggaccccactgcctggagtacaggtgcgcattgtctcagaaaacccacagagggaagcctgctcctacaccatccacgcagagggagacgagagggggaccaaggtgaccccagggtttgaagaaaaggagggggagctgctggtgaggggaccctccgtgtttcgagaatactggaataaaccagaagaaactaagagtgcattcaccctggatggctggtttaagacaggggacaccgtggtgtttaaggatggccagtactggatccgaggccggacctcagtggacatcatcaagactggaggctacaaggtcagcgccctggaggtggagtggcacctgctggcccaccccagcatcacagatgtggctgtgattggagttccggatatgacatggggccagcgggtcactgctgtggtgaccctccgagaaggacactcactgtcccacagggagctcaaagagtgggccagaaatgtcctggccccgtacgcggtgccctcggagctggtgctggtggaggagatcccgcggaaccagatgggcaagattgacaagaaggcgctcatcaggcacttccacccctcatgacccggcagactgggactgcgggtctggtggggagcagcagacgtccccttcacaccgagaaccacgggggcccgtccaagacctggcctcccttaaacctgaaccccccaaatcaggtcacgtagaatcaagaactgtttgggatgaaatcaccatgtggggtccccagcctcgggccagttgttgcagctcaaggagaccgtccctggtgtcacctctgcctggtcaccgccgacctcatctgtgcagcgcggtgcagccagcccctggccccacgtgctgaggcacctcccgccccacagtgccctgcagttgccaggctctccagggcag

SEQ ID NO: 104397 - DNA, 477 bp, Homo sapiens
  Payload ID: 503
  Gene Symbol: ACSF3
  Gene Name: acyl-CoA synthetase family member 3
  ENST ID: ENST00000541755
  CDS Start-End: 392-477
ggaacccggcccgaccccggcgcgcgcgcggcggaggacgaggaagagttgtggcgaggcagatcctgccccgtggccgcggccgtctcgtgttggaggacataagatgaggcttcccttgctcttgctcctttggctctgaaccatctcctcaaggcagacagaaatggcggattaaactgtgggcttgggatagttgtgtcccaccggccttccgggttccagcgccaggcctggtgcctgccccaggaggatgagcatttgcattgcctgcaccttatcgtgcccttccacctgctgaagcagctgtgcctgccgctcttgtgaactgcgaacttccccttacctcctctctctggctcgggagctggctcggccgcctgtcagtgcaatgctgccccatgtggtgctcaccttccggcgcctgggctgcgccttggcgtcctgccggctggcgcctgcgagacacagaggaag

SEQ ID NO: 104398 - DNA, 3751 bp, Homo sapiens
  Payload ID: 503
  Gene Symbol: ACSF3
  Gene Name: acyl-CoA synthetase family member 3
  Uniprot ID: Q4G176
  ENST ID: ENST00000614302
  CDS Start-End: 382-2112
gggggacgcgcttgggcgacggacgcgccgcgccggggaagctgttgggcgccggaactggtccggcccgactcacgaccccgcgggacccggccggaacccggcccgaccccggcgcgcgcgcggcggaggacgaggaagagttgtggcgaggcagatcctgccccgtggccgcggccgtctcgtaggtgtcccaccggccttccgggttccagcgccaggcctggtgcctgccccaggaggatgagcatttgcattgcctgcaccttatcgtgcccttccacctgctgaagcagctgtgcctgccgctcttgtgaactgcgaacttccccttacctcctctctctggctcgggagctggctcggccgcctgtcagtgcaatgctgccccatgtggtgctcaccttccggcgcctgggctgcgccttggcgtcctgccggctggcgcctgcgagacacagaggaagtggtcttctgcacacagccccagtggcccgctcggacaggagcgccccggtgttcacccgtgccctggcctttggggacagaatcgccctggttgaccagcacggccgccacacgtacagggagctttattcccgcagccttcgcctgtcccaggagatctgcaggctctgcgggtgtgtcggcggggacctccgggaggagagggtctccttcctatgcgctaacgatgcctcctacgtcgtggcccagtgggcgtcatggatgagtggcggtgtggcagtccccctctacaggaagcatcccgcggcccagctggagtatgtcatctgcgactcccagagctctgtggtccttgccagccaggagtacctggagctcctgagcccggtggtcaggaagctgggggtcccgctgctgccgctcacaccagccatctacactggagcagtagaggaaccggcagaggtcccggtcccagagcagggatggaggaacaagggcgccatgatcatctacaccagtgggaccacggggaggcccaagggcgtgctgagcacgcaccaaaacatcagggctgtggtgaccgggctggtccacaagtgggcatggaccaaagacgacgtgatcctccacgtgctcccgctgcaccacgtccatggtgtggtcaacgcgctgctctgtcctctctgggtgggagccacctgtgtgatgatgcctgagttcagccctcagcaggtttgggaaaagttcttaagttctgaaacgccgcggatcaatgtctttatggcagtgcctacaatatacaccaagctgatggagtactacgacaggcattttacccagccgcacgcccaggatttcttgcgtgcagtttgtgaagaaaaaattaggctgatggtctcaggctcagctgccctgcccctcccagtgctggagaagtggaagaacatcacgggccacaccctgctggagcggtatggcatgaccgagatcggcatggctctgtccgggcccctgaccactgccgtgcgcctgccaggttccgtggggaccccactgcctggagtacaggtgcgcattgtctcagaaaacccacagagggaagcctgctcctacaccatccacgcagagggagacgagagggggaccaaggtgaccccagggtttgaagaaaaggagggggagctgctggtgaggggaccctccgtgtttcgagaatactggaataaaccagaagaaactaagagtgcattcaccctggatggctggtttaagacaggggacaccgtggtgtttaaggatggccagtactggatccgaggccggacctcagtggacatcatcaagactggaggctacaaggtcagcgccctggaggtggagtggcacctgctggcccaccccagcatcacagatgtggctgtgattggagttccggatatgacatggggccagcgggtcactgctgtggtgaccctccgagaaggacactcactgtcccacagggagctcaaagagtgggccagaaatgtcctggccccgtacgcggtgccctcggagctggtgctggtggaggagatcccgcggaaccagatgggcaagattgacaagaaggcgctcatcaggcacttccacccctcatgacccggcagactgggactgcgggtctggtggggagcagcagacgtccccttcacaccgagaaccacgggggcccgtccaagacctggcctcccttaaacctgaaccccccaaatcaggtcacgtagaatcaagaactgtttgggatgaaatcaccatgtggggtccccagcctcgggccagttgttgcagctcaaggagaccgtccctggtgtcacctctgcctggtcaccgccgacctcatctgtgcagcgcggtgcagccagcccctggccccacgtgctgaggcacctcccgccccacagtgccctgcagttgccaggctctccagggcaggtcccagaggtttcccacaaaaaacaaagactccactggaggaaacaagcccctgtcccacgccgtctgcacgtgcctgtgcctcacccagagccagtgtctcccggcccacataggaggtctgggcagccacccagggggccctcctgggaggagctgagggttcacaagcctcccagaaccagccctgtcccatgggttccgtgcatttcctggtgctgctcttggaggagagcagctcccactgtggggacacctgccaccctgcacactactgtgtgtccatcagcatgtgtcacagaaagtgcgtggacggatggccccggagctgctctgccgtgaccctgcctcaccccccagcgcagggactttccaggtcatctccacaccagcccctcagccggtgaaccctctctcccatcaccgtctccacccagacccccacctgccccatggcccccatttcatgtctgtggctcaccagcttttccccagacccagctccggagcccacaggcgtggccgatgcagaaacctcaggaaggtgtgttgtgaatgttgggtgcacccacgttgcatttacttagcggggccaattcagatgcacaggggccacatgcagaatccagaagtttctggacaattttcagaagaataggctgcctcctccccacagcctgggggaagtaacagtcatcgcccagcagtgtctggcctgaacttacccagaacattctgcccccggaatgcacgtctgaaagagtggccagaaacgagtgtgccgggcaggaggccagccccatctcaggctcacgtgcctctgacaggagaccagccccatctcaggctcacatgcctcgcggacagttggacgtggcctggggcccctgctcacttgagcatgtcgcccaccaagcttgtctgaggccacagagcagcgtcccagccctgttttccaggactggtgggtgccccagtccacggccctgccccacccgaactcctgcctcacggtgtggccttgtgcatccccatggcctgaccccgggaacagtcagaggaaggggtcccgccctcccgccagaggcctggacccaagggaacggcagtcagagactacagtccagacgtttgtgtctaggccttgctggtagctaaggaaatgccttctgttgggaaaaggtcaaatttaacatagcaaaatttttacttaattccactaattttacatttgcatctctctcctttaatcctgaaacttttgattcctaaaaagcttacataatcatttgctttatccgatagt

SEQ ID NO: 104399 - DNA, 3832 bp, Homo sapiens
  Payload ID: 504
  Gene Symbol: ACSL1
  Gene Name: acyl-CoA synthetase long-chain family member 1
  Uniprot ID: P33121
  ENST ID: ENST00000281455
  CDS Start-End: 212-2308
ggggccggcgcggcgagcgcaccagcagcatcctggctcagccgcggcggtggcgggggcgcaaccagcgggccgaggcggcggcgccagcggcgccttaaatagcatccagagccggcgcggggcagggagtgggctgcagtgacagccggcggcggagcggccggtccacggaggagaattcagcttagagaactatcaacacaggacaatgcaagcccatgagctgttccggtattttcgaatgccagagctggttgacttccgacagtacgtgcgtactcttccgaccaacacgcttatgggcttcggagcttttgcagcactcaccaccttctggtacgccacgagacccaaacccctgaagccgccatgcgacctctccatgcagtcagtggaagtggcgggtagtggtggtgcacgaagatccgcactacttgacagcgacgagcccttggtgtatttctatgatgatgtcacaacattatacgaaggtttccagaggggaatacaggtgtcaaataatggcccttgtttaggctctcggaaaccagaccaaccctatgaatggctttcatataaacaggttgcagaattgtcggagtgcataggctcagcactgatccagaagggcttcaagactgccccagatcagttcattggcatctttgctcaaaatagacctgagtgggtgattattgaacaaggatgctttgcttattcgatggtgatcgttccactttatgatacccttggaaatgaagccatcacgtacatagtcaacaaagctgaactctctctggtttttgttgacaagccagagaaggccaaactcttattagagggtgtagaaaataagttaataccaggccttaaaatcatagttgtcatggatgcctacggcagtgaactggtggaacgaggccagaggtgtggggtggaagtcaccagcatgaaggcgatggaggacctgggaagagccaacagacggaagcccaagcctccagcacctgaagatcttgcagtaatttgtttcacaagtggaactacaggcaaccccaaaggagcaatggtcactcaccgaaacatagtgagcgattgttcagcttttgtgaaagcaacagagaatacagtcaatccttgcccagatgatactttgatatctttcttgcctctcgcccatatgtttgagagagttgtagagtgtgtaatgctgtgtcatggagctaaaatcggatttttccaaggagatatcaggctgctcatggatgacctcaaggtgcttcaacccactgtcttccccgtggttccaagactgctgaaccggatgtttgaccgaattttcggacaagcaaacaccacgctgaagcgatggctcttggactttgcctccaagaggaaagaagcagagcttcgcagcggcatcatcagaaacaacagcctgtgggaccggctgatcttccacaaagtacagtcgagcctgggcggaagagtccggctgatggtgacaggagccgccccggtgtctgccactgtgctgacgttcctcagagcagccctgggctgtcagttttatgaaggatacggacagacagagtgcactgccgggtgctgcctgaccatgcctggagactggaccgcaggccatgttggggccccgatgccgtgcaatttgataaaacttgttgatgtggaagaaatgaattacatggctgccgagggcgagggcgaggtgtgtgtgaaagggccaaatgtatttcagggctacttgaaggacccagcgaaaacagcagaagctttggacaaagacggctggttacacacaggggacattggaaaatggttaccaaatggcaccttgaaaattatcgaccggaaaaagcacatatttaagctggcacaaggagaatacatagcccctgaaaagattgaaaatatctacatgcgaagtgagcctgttgctcaggtgtttgtccacggagaaagcctgcaggcatttctcattgcaattgtggtaccagatgttgagacattatgttcctgggcccaaaagagaggatttgaagggtcgtttgaggaactgtgcagaaataaggatgtcaaaaaagctatcctcgaagatatggtgagacttgggaaggattctggtctgaaaccatttgaacaggtcaaaggcatcacattgcaccctgaattattttctatcgacaatggccttctgactccaacaatgaaggcgaaaaggccagagctgcggaactatttcaggtcgcagatagatgacctctattccactatcaaggtttagtgtgaagaagaaagctcagaggaaatggcacagttccacaatctcttctcctgctgatggccttcatgttgttaattttgaatacagcaagtgtagggaaggaagcgttcgtgtttgacttgtccattcggggttcttctcataggaatgctagaggaaagagaacactgccttacagtcacctcatgttgcagaccatgtttatggtaatacacactttccaaaatgagccttaaaaattgtaaaggggatactataaatgtgctaagttatttgagacttcctcagtttaaaaagtgggttttaaatcttctgtctccctgtttctctaatcaaggggttaggactttgctatctctgagatgtctgctacttgctgcaaattctgcagctgtctgctgctctaaagagtacagtgcactagagggaagtgttccctttaaaaataagaacaactgtcctggctggagaatctcacaagcggaccagagatctttttaaatccctgctactgtcccttctcacaggcattcacagaacccttctgattcgtaagggttacgaaactcatgttcttctccagtcccctgtggtttctgttggagcataaggtttccagtaagcgggagggcagatccaactcagaaccatgcagataaggagcctctggcaaatgggtgctcatcagaacgcgtggattctctttcatggcagaatgctcttggactcggttctccaggcctgattccccgactccatcctttttcaggggttatttaaaaatctgccttagattctatagtgaagacaagcatttcaagaaagagttacctggatcagccatgctcagctgtgacgcctgaataactgtctactttatcttcactgaaccactcactctgtgtaaaggccaacagatttttaatgtggttttcatatcaaaagatcatgttgggattaacttgcctttttccccaaaaaataaactctcaggcaagcatttctttaaagctattaagggagtatatacttgagtacttattgaaatggacagtaataagcaaatgttcttataatgctacctgatttctatgaaatgtgtttgacaagccaaaattctaggatgtagaaatctggaaagttcatttcctgggattcacttctccagggattttttaaagttaatttgggaaattaacagcagttcactttattgtgagtctttgccacatttgactgaattgagctgtcatttgtacatttaaagcagctgttttggggtctgtgagagtacatgtattatatacaagcacaacagggcttgcactaaagaattgtcattgtaataacactacttggtagcctaacttcatatatgtattcttaattgcacaaaaagtcaataatttgtcaccttggggttttgaatgtttgctttaagtgttggctatttctatgttttataaaccaaaacaaaatttccaaaaacaatgaaggaaaccaaaataaatatttctgcatttc

SEQ ID NO: 104400 - DNA, 3636 bp, Homo sapiens
  Payload ID: 504
  Gene Symbol: ACSL1
  Gene Name: acyl-CoA synthetase long-chain family member 1
  ENST ID: ENST00000454703
  CDS Start-End: 523-2106
gggcggggcggggccgcgggagggcggggccggcgcggcgagcgcaccagcagcatcctggctcagccgcggcggtggcgggggcgcaaccagcgggccgaggcggcggcgccagcggcgccttaaatagcatccagagccggcgcggggcagggagtgggctgcagtgacagccggcggcggagcggccggtccacggaggagggtagtggtggtgcacgaagatccgcactacttgacagcgacgagcccttggtgtatttctatgatgatgtcacaacattatacgaaggtttccagaggggaatacaggtgtcaaataatggcccttgtttaggctctcggaaaccagaccaaccctatgaatggctttcatataaacaggttgcagaattgtcggagtgcataggctcagcactgatccagaagggcttcaagactgccccagatcagttcattggcatctttgctcaaaatagacctgagtgggtgattattgaacaaggatgctttgcttattcgatggtgatcgttccactttatgatacccttggaaatgaagccatcacgtacatagtcaacaaagctgaactctctctggtttttgttgacaagccagagaaggccaaactcttattagagggtgtagaaaataagttaataccaggccttaaaatcatagttgtcatggatgcctacggcagtgaactggtggaacgaggccagaggtgtggggtggaagtcaccagcatgaaggcgatggaggacctgggaagagccaacagacggaagcccaagcctccagcacctgaagatcttgcagtaatttgtttcacaagtggaactacaggcaaccccaaaggagcaatggtcactcaccgaaacatagtgagcgattgttcagcttttgtgaaagcaacagagaatacagtcaatccttgcccagatgatactttgatatctttcttgcctctcgcccatatgtttgagagagttgtagagtgtgtaatgctgtgtcatggagctaaaatcggatttttccaaggagatatcaggctgctcatggatgacctcaaggtgcttcaacccactgtcttccccgtggttccaagactgctgaaccggatgtttgaccgaattttcggacaagcaaacaccacgctgaagcgatggctcttggactttgcctccaagaggaaagaagcagagcttcgcagcggcatcatcagaaacaacagcctgtgggaccggctgatcttccacaaagtacagtcgagcctgggcggaagagtccggctgatggtgacaggagccgccccggtgtctgccactgtgctgacgttcctcagagcagccctgggctgtcagttttatgaaggatacggacagacagagtgcactgccgggtgctgcctgaccatgcctggagactggaccgcaggccatgttggggccccgatgccgtgcaatttgataaaacttgttgatgtggaagaaatgaattacatggctgccgagggcgagggcgaggtgtgtgtgaaagggccaaatgtatttcagggctacttgaaggacccagcgaaaacagcagaagctttggacaaagacggctggttacacacaggggacattggaaaatggttaccaaatggcaccttgaaaattatcgaccggaaaaagcacatatttaagctggcacaaggagaatacatagcccctgaaaagattgaaaatatctacatgcgaagtgagcctgttgctcaggtgtttgtccacggagaaagcctgcaggcatttctcattgcaattgtggtaccagatgttgagacattatgttcctgggcccaaaagagaggatttgaagggtcgtttgaggaactgtgcagaaataaggatgtcaaaaaagctatcctcgaagatatggtgagacttgggaaggattctggtctgaaaccatttgaacaggtcaaaggcatcacattgcaccctgaattattttctatcgacaatggccttctgactccaacaatgaaggcgaaaaggccagagctgcggaactatttcaggtcgcagatagatgacctctattccactatcaaggtttagtgtgaagaagaaagctcagaggaaatggcacagttccacaatctcttctcctgctgatggccttcatgttgttaattttgaatacagcaagtgtagggaaggaagcgttcgtgtttgacttgtccattcggggttcttctcataggaatgctagaggaaagagaacactgccttacagtcacctcatgttgcagaccatgtttatggtaatacacactttccaaaatgagccttaaaaattgtaaaggggatactataaatgtgctaagttatttgagacttcctcagtttaaaaagtgggttttaaatcttctgtctccctgtttctctaatcaaggggttaggactttgctatctctgagatgtctgctacttgctgcaaattctgcagctgtctgctgctctaaagagtacagtgcactagagggaagtgttccctttaaaaataagaacaactgtcctggctggagaatctcacaagcggaccagagatctttttaaatccctgctactgtcccttctcacaggcattcacagaacccttctgattcgtaagggttacgaaactcatgttcttctccagtcccctgtggtttctgttggagcataaggtttccagtaagcgggagggcagatccaactcagaaccatgcagataaggagcctctggcaaatgggtgctcatcagaacgcgtggattctctttcatggcagaatgctcttggactcggttctccaggcctgattccccgactccatcctttttcaggggttatttaaaaatctgccttagattctatagtgaagacaagcatttcaagaaagagttacctggatcagccatgctcagctgtgacgcctgaataactgtctactttatcttcactgaaccactcactctgtgtaaaggccaacagatttttaatgtggttttcatatcaaaagatcatgttgggattaacttgcctttttccccaaaaaataaactctcaggcaagcatttctttaaagctattaagggagtatatacttgagtacttattgaaatggacagtaataagcaaatgttcttataatgctacctgatttctatgaaatgtgtttgacaagccaaaattctaggatgtagaaatctggaaagttcatttcctgggattcacttctccagggattttttaaagttaatttgggaaattaacagcagttcactttattgtgagtctttgccacatttgactgaattgagctgtcatttgtacatttaaagcagctgttttggggtctgtgagagtacatgtattatatacaagcacaacagggcttgcactaaagaattgtcattgtaataacactacttggtagcctaacttcatatatgtattcttaattgcacaaaaagtcaataatttgtcaccttggggttttgaatgtttgctttaagtgttggctatttctatgttttataaaccaaaacaaaatttccaaaaacaatgaaggaaaccaaaataaatatttctgcatttcaggtga

SEQ ID NO: 104401 - DNA, 3948 bp, Homo sapiens
  Payload ID: 504
  Gene Symbol: ACSL1
  Gene Name: acyl-CoA synthetase long-chain family member 1
  Uniprot ID: P33121
  ENST ID: ENST00000515030
  CDS Start-End: 327-2423
aaactccacggtaacggggaccaatgttgttagaggttgaggttcctggtaggtcccaggtgctaaaaggaagagcagcctttgggatgtgagcccgaaaaccatcgtgttggcttctgaagccccaagatgggcatggcagggacgcggaagccctcagaaccgcggaagccctcagaaccgcacagcaggtggccgccgtggtgcagcgcgcagtcggccctcagctcccctgcaccggcgcgagctgcgggcgctgcccacgtcaggctctgcagacaccagacagaaaagaattcagcttagagaactatcaacacaggacaatgcaagcccatgagctgttccggtattttcgaatgccagagctggttgacttccgacagtacgtgcgtactcttccgaccaacacgcttatgggcttcggagcttttgcagcactcaccaccttctggtacgccacgagacccaaacccctgaagccgccatgcgacctctccatgcagtcagtggaagtggcgggtagtggtggtgcacgaagatccgcactacttgacagcgacgagcccttggtgtatttctatgatgatgtcacaacattatacgaaggtttccagaggggaatacaggtgtcaaataatggcccttgtttaggctctcggaaaccagaccaaccctatgaatggctttcatataaacaggttgcagaattgtcggagtgcataggctcagcactgatccagaagggcttcaagactgccccagatcagttcattggcatctttgctcaaaatagacctgagtgggtgattattgaacaaggatgctttgcttattcgatggtgatcgttccactttatgatacccttggaaatgaagccatcacgtacatagtcaacaaagctgaactctctctggtttttgttgacaagccagagaaggccaaactcttattagagggtgtagaaaataagttaataccaggccttaaaatcatagttgtcatggatgcctacggcagtgaactggtggaacgaggccagaggtgtggggtggaagtcaccagcatgaaggcgatggaggacctgggaagagccaacagacggaagcccaagcctccagcacctgaagatcttgcagtaatttgtttcacaagtggaactacaggcaaccccaaaggagcaatggtcactcaccgaaacatagtgagcgattgttcagcttttgtgaaagcaacagagaatacagtcaatccttgcccagatgatactttgatatctttcttgcctctcgcccatatgtttgagagagttgtagagtgtgtaatgctgtgtcatggagctaaaatcggatttttccaaggagatatcaggctgctcatggatgacctcaaggtgcttcaacccactgtcttccccgtggttccaagactgctgaaccggatgtttgaccgaattttcggacaagcaaacaccacgctgaagcgatggctcttggactttgcctccaagaggaaagaagcagagcttcgcagcggcatcatcagaaacaacagcctgtgggaccggctgatcttccacaaagtacagtcgagcctgggcggaagagtccggctgatggtgacaggagccgccccggtgtctgccactgtgctgacgttcctcagagcagccctgggctgtcagttttatgaaggatacggacagacagagtgcactgccgggtgctgcctgaccatgcctggagactggaccgcaggccatgttggggccccgatgccgtgcaatttgataaaacttgttgatgtggaagaaatgaattacatggctgccgagggcgagggcgaggtgtgtgtgaaagggccaaatgtatttcagggctacttgaaggacccagcgaaaacagcagaagctttggacaaagacggctggttacacacaggggacattggaaaatggttaccaaatggcaccttgaaaattatcgaccggaaaaagcacatatttaagctggcacaaggagaatacatagcccctgaaaagattgaaaatatctacatgcgaagtgagcctgttgctcaggtgtttgtccacggagaaagcctgcaggcatttctcattgcaattgtggtaccagatgttgagacattatgttcctgggcccaaaagagaggatttgaagggtcgtttgaggaactgtgcagaaataaggatgtcaaaaaagctatcctcgaagatatggtgagacttgggaaggattctggtctgaaaccatttgaacaggtcaaaggcatcacattgcaccctgaattattttctatcgacaatggccttctgactccaacaatgaaggcgaaaaggccagagctgcggaactatttcaggtcgcagatagatgacctctattccactatcaaggtttagtgtgaagaagaaagctcagaggaaatggcacagttccacaatctcttctcctgctgatggccttcatgttgttaattttgaatacagcaagtgtagggaaggaagcgttcgtgtttgacttgtccattcggggttcttctcataggaatgctagaggaaagagaacactgccttacagtcacctcatgttgcagaccatgtttatggtaatacacactttccaaaatgagccttaaaaattgtaaaggggatactataaatgtgctaagttatttgagacttcctcagtttaaaaagtgggttttaaatcttctgtctccctgtttctctaatcaaggggttaggactttgctatctctgagatgtctgctacttgctgcaaattctgcagctgtctgctgctctaaagagtacagtgcactagagggaagtgttccctttaaaaataagaacaactgtcctggctggagaatctcacaagcggaccagagatctttttaaatccctgctactgtcccttctcacaggcattcacagaacccttctgattcgtaagggttacgaaactcatgttcttctccagtcccctgtggtttctgttggagcataaggtttccagtaagcgggagggcagatccaactcagaaccatgcagataaggagcctctggcaaatgggtgctcatcagaacgcgtggattctctttcatggcagaatgctcttggactcggttctccaggcctgattccccgactccatcctttttcaggggttatttaaaaatctgccttagattctatagtgaagacaagcatttcaagaaagagttacctggatcagccatgctcagctgtgacgcctgaataactgtctactttatcttcactgaaccactcactctgtgtaaaggccaacagatttttaatgtggttttcatatcaaaagatcatgttgggattaacttgcctttttccccaaaaaataaactctcaggcaagcatttctttaaagctattaagggagtatatacttgagtacttattgaaatggacagtaataagcaaatgttcttataatgctacctgatttctatgaaatgtgtttgacaagccaaaattctaggatgtagaaatctggaaagttcatttcctgggattcacttctccagggattttttaaagttaatttgggaaattaacagcagttcactttattgtgagtctttgccacatttgactgaattgagctgtcatttgtacatttaaagcagctgttttggggtctgtgagagtacatgtattatatacaagcacaacagggcttgcactaaagaattgtcattgtaataacactacttggtagcctaacttcatatatgtattcttaattgcacaaaaagtcaataatttgtcaccttggggttttgaatgtttgctttaagtgttggctatttctatgttttataaaccaaaacaaaatttccaaaaacaatgaaggaaaccaaaataaatatttctgcatttca

SEQ ID NO: 104402 - DNA, 1583 bp, Homo sapiens
  Payload ID: 504
  Gene Symbol: ACSL1
  Gene Name: acyl-CoA synthetase long-chain family member 1
  ENST ID: ENST00000504900
  CDS Start-End: 170-1336
cgcggcggtggcgggggcgcaaccagcgggccgaggcggcggcgccagcggcgccttaaatagcatccagagccggcgcggggcagggagtgggctgcagtgacagccggcggcggagcggccggtccacggaggagaattcagcttagagaactatcaacacaggacaatgcaagcccatgagctgttccggtattttcgaatgccagagctggttgacttccgacagtacgtgcgtactcttccgaccaacacgcttatgggcttcggagcttttgcagcactcaccaccttctggtacgccacgagacccaaacccctgaagccgccatgcgacctctccatgcagtcagtggaagtggcgggtagtggtggtgcacgaagatccgcactacttgacagcgacgagcccttggtgtatttctatgatgatgtcacaacattatacgaaggtttccagaggggaatacaggtgtcaaataatggcccttgtttaggctctcggaaaccagaccaaccctatgaatggctttcatataaacaggttgcagaattgtcggagtgcataggctcagcactgatccagaagggcttcaagactgccccagatcagttcattggcatctttgctcaaaatagacctgagtgggtgattattgaacaaggatgctttgcttattcgatggtgatcgttccactttatgatacccttggaaatgaagccatcacgtacatagtcaacaaagctgaactctctctggtttttgttgacaagccagagaaggccaaactcttattagagggtgtagaaaataagttaataccaggccttaaaatcatagttgtcatggatgcctacggcagtgaactggtggaacgaggccagaggtgtggggtggaagtcaccagcatgaaggcgatggaggacctgggaagagccaacagacggaagcccaagcctccagcacctgaagatcttgcagtaatttgtttcacaagtggaactacaggcaaccccaaaggagcaatggtcactcaccgaaacatagtgagcgattgttcagcttttgtgaaagcaacagagaatacagtcaatccttgcccagatgatactttgatatctttcttgcctctcgcccatatgtttgagagagttgtagagtgtgtaatgctgtgtcatggagctaaaatcggatttttccaaggagatatcaggctgctcatggatgacctcaaggtgcttcaacccactgtcttccccgtggttccaagactgctgaaccggatgtttgaccgagtaagttccaagcagcgaagtcccaggactgagcactgacttggacgcaggggcttgggcttgaattgggctgtgccatgtgccatctgtatgaccctggacaatcctcccaatcttacagaacttcagtttactcatctgtaaagttagaatgcgtttacctctcagagtggctgataaggattataagagaaaatgcatgaacacactttgtaaaccatggtcacaacacaagcataatgtgggaggtcattttatttttacaataaacactttgagcctctgc

SEQ ID NO: 104403 - DNA, 2333 bp, Homo sapiens
  Payload ID: 504
  Gene Symbol: ACSL1
  Gene Name: acyl-CoA synthetase long-chain family member 1
  Uniprot ID: P33121
  ENST ID: ENST00000504342
  CDS Start-End: 133-2229
gggactgtgttaagaaccaagggcatataaagacagatgggaggagaccctggccggggagaggaagaagcatctacataggtactaagtaccattcgctaattcagcttagagaactatcaacacaggacaatgcaagcccatgagctgttccggtattttcgaatgccagagctggttgacttccgacagtacgtgcgtactcttccgaccaacacgcttatgggcttcggagcttttgcagcactcaccaccttctggtacgccacgagacccaaacccctgaagccgccatgcgacctctccatgcagtcagtggaagtggcgggtagtggtggtgcacgaagatccgcactacttgacagcgacgagcccttggtgtatttctatgatgatgtcacaacattatacgaaggtttccagaggggaatacaggtgtcaaataatggcccttgtttaggctctcggaaaccagaccaaccctatgaatggctttcatataaacaggttgcagaattgtcggagtgcataggctcagcactgatccagaagggcttcaagactgccccagatcagttcattggcatctttgctcaaaatagacctgagtgggtgattattgaacaaggatgctttgcttattcgatggtgatcgttccactttatgatacccttggaaatgaagccatcacgtacatagtcaacaaagctgaactctctctggtttttgttgacaagccagagaaggccaaactcttattagagggtgtagaaaataagttaataccaggccttaaaatcatagttgtcatggatgcctacggcagtgaactggtggaacgaggccagaggtgtggggtggaagtcaccagcatgaaggcgatggaggacctgggaagagccaacagacggaagcccaagcctccagcacctgaagatcttgcagtaatttgtttcacaagtggaactacaggcaaccccaaaggagcaatggtcactcaccgaaacatagtgagcgattgttcagcttttgtgaaagcaacagagaatacagtcaatccttgcccagatgatactttgatatctttcttgcctctcgcccatatgtttgagagagttgtagagtgtgtaatgctgtgtcatggagctaaaatcggatttttccaaggagatatcaggctgctcatggatgacctcaaggtgcttcaacccactgtcttccccgtggttccaagactgctgaaccggatgtttgaccgaattttcggacaagcaaacaccacgctgaagcgatggctcttggactttgcctccaagaggaaagaagcagagcttcgcagcggcatcatcagaaacaacagcctgtgggaccggctgatcttccacaaagtacagtcgagcctgggcggaagagtccggctgatggtgacaggagccgccccggtgtctgccactgtgctgacgttcctcagagcagccctgggctgtcagttttatgaaggatacggacagacagagtgcactgccgggtgctgcctgaccatgcctggagactggaccgcaggccatgttggggccccgatgccgtgcaatttgataaaacttgttgatgtggaagaaatgaattacatggctgccgagggcgagggcgaggtgtgtgtgaaagggccaaatgtatttcagggctacttgaaggacccagcgaaaacagcagaagctttggacaaagacggctggttacacacaggggacattggaaaatggttaccaaatggcaccttgaaaattatcgaccggaaaaagcacatatttaagctggcacaaggagaatacatagcccctgaaaagattgaaaatatctacatgcgaagtgagcctgttgctcaggtgtttgtccacggagaaagcctgcaggcatttctcattgcaattgtggtaccagatgttgagacattatgttcctgggcccaaaagagaggatttgaagggtcgtttgaggaactgtgcagaaataaggatgtcaaaaaagctatcctcgaagatatggtgagacttgggaaggattctggtctgaaaccatttgaacaggtcaaaggcatcacattgcaccctgaattattttctatcgacaatggccttctgactccaacaatgaaggcgaaaaggccagagctgcggaactatttcaggtcgcagatagatgacctctattccactatcaaggtttagtgtgaagaagaaagctcagaggaaatggcacagttccacaatctcttctcctgctgatggccttcatgttgttaattttgaatacagcaagtgtagggaaggaa

SEQ ID NO: 104404 - DNA, 2409 bp, Homo sapiens
  Payload ID: 504
  Gene Symbol: ACSL1
  Gene Name: acyl-CoA synthetase long-chain family member 1
  ENST ID: ENST00000503407
  CDS Start-End: 1-885
aagaggaaagaagcagagcttcgcagcggcatcatcagaaacaacagcctgtgggaccggctgatcttccacaaagtacagtcgagcctgggcggaagagtccggctgatggtgacaggagccgccccggtgtctgccactgtgctgacgttcctcagagcagccctgggctgtcagttttatgaaggatacggacagacagagtgcactgccgggtgctgcctgaccatgcctggagactggaccgcaggccatgttggggccccgatgccgtgcaatttgataaaacttgttgatgtggaagaaatgaattacatggctgccgagggcgagggcgagggctacttgaaggacccagcgaaaacagcagaagctttggacaaagacggctggttacacacaggggacattggaaaatggttaccaaatggcaccttgaaaattatcgaccggaaaaagcacatatttaagctggcacaaggagaatacatagcccctgaaaagattgaaaatatctacatgcgaagtgagcctgttgctcaggtgtttgtccacggagaaagcctgcaggcatttctcattgcaattgtggtaccagatgttgagacattatgttcctgggcccaaaagagaggatttgaagggtcgtttgaggaactgtgcagaaataaggatgtcaaaaaagctatcctcgaagatatggtgagacttgggaaggattctggtctgaaaccatttgaacaggtcaaaggcatcacattgcaccctgaattattttctatcgacaatggccttctgactccaacaatgaaggcgaaaaggccagagctgcggaactatttcaggtcgcagatagatgacctctattccactatcaaggtttagtgtgaagaagaaagctcagaggaaatggcacagttccacaatctcttctcctgctgatggccttcatgttgttaattttgaatacagcaagtgtagggaaggaagcgttcgtgtttgacttgtccattcggggttcttctcataggaatgctagaggaaagagaacactgccttacagtcacctcatgttgcagaccatgtttatggtaatacacactttccaaaatgagccttaaaaattgtaaaggggatactataaatgtgctaagttatttgagacttcctcagtttaaaaagtgggttttaaatcttctgtctccctgtttctctaatcaaggggttaggactttgctatctctgagatgtctgctacttgctgcaaattctgcagctgtctgctgctctaaagagtacagtgcactagagggaagtgttccctttaaaaataagaacaactgtcctggctggagaatctcacaagcggaccagagatctttttaaatccctgctactgtcccttctcacaggcattcacagaacccttctgattcgtaagggttacgaaactcatgttcttctccagtcccctgtggtttctgttggagcataaggtttccagtaagcgggagggcagatccaactcagaaccatgcagataaggagcctctggcaaatgggtgctcatcagaacgcgtggattctctttcatggcagaatgctcttggactcggttctccaggcctgattccccgactccatcctttttcaggggttatttaaaaatctgccttagattctatagtgaagacaagcatttcaagaaagagttacctggatcagccatgctcagctgtgacgcctgaataactgtctactttatcttcactgaaccactcactctgtgtaaaggccaacagatttttaatgtggttttcatatcaaaagatcatgttgggattaacttgcctttttccccaaaaaataaactctcaggcaagcatttctttaaagctattaagggagtatatacttgagtacttattgaaatggacagtaataagcaaatgttcttataatgctacctgatttctatgaaatgtgtttgacaagccaaaattctaggatgtagaaatctggaaagttcatttcctgggattcacttctccagggattttttaaagttaatttgggaaattaacagcagttcactttattgtgagtctttgccacatttgactgaattgagctgtcatttgtacatttaaagcagctgttttggggtctgtgagagtacatgtattatatacaagcacaacagggcttgcactaaagaattgtcattgtaataacactacttggtagcctaacttcatatatgtattcttaattgcacaaaaagtcaataatttgtcaccttggggttttgaatgtttgctttaagtgttggctatttctatgttttataaaccaaaacaaaatttccaaaaacaatgaaggaaaccaaaataaatatttctgcatttc

SEQ ID NO: 104405 - DNA, 280 bp, Homo sapiens
  Payload ID: 504
  Gene Symbol: ACSL1
  Gene Name: acyl-CoA synthetase long-chain family member 1
  ENST ID: ENST00000505492
  CDS Start-End: 1-280
cctgggaagagccaacagacggaagcccaagcctccagcacctgaagatcttgcagtaatttgtttcacaagtggaactacaggcaaccccaaaggagcaatggtcactcaccgaaacatagtgagcgattgttcagcttttgtgaaagcaacagagtgtgtaatgctgtgtcatggagctaaaatcggatttttccaaggagatatcaggctgctcatggatgacctcaaggtgcttcaacccactgtcttccccgtggttccaagactgctgaaccgg

SEQ ID NO: 104406 - DNA, 2469 bp, Homo sapiens
  Payload ID: 504
  Gene Symbol: ACSL1
  Gene Name: acyl-CoA synthetase long-chain family member 1
  Uniprot ID: P33121
  ENST ID: ENST00000513317
  CDS Start-End: 295-2391
gactttgctgctggctgcccattggcctatcctccaccctctgctctcctgagaagtcaagtgtggattttgtctgctagttacctttagcccagtgggcagcagcgtggggctcggcatgtgacttgtgccctgagagaccttggtaggctgggggagcgcagctgagccctgctaacccccgcccacttccaggctcattgccctcttctgtgtctgcagtggggtgtcacctagtagtcagctgttggtggcacagatgaattcagcttagagaactatcaacacaggacaatgcaagcccatgagctgttccggtattttcgaatgccagagctggttgacttccgacagtacgtgcgtactcttccgaccaacacgcttatgggcttcggagcttttgcagcactcaccaccttctggtacgccacgagacccaaacccctgaagccgccatgcgacctctccatgcagtcagtggaagtggcgggtagtggtggtgcacgaagatccgcactacttgacagcgacgagcccttggtgtatttctatgatgatgtcacaacattatacgaaggtttccagaggggaatacaggtgtcaaataatggcccttgtttaggctctcggaaaccagaccaaccctatgaatggctttcatataaacaggttgcagaattgtcggagtgcataggctcagcactgatccagaagggcttcaagactgccccagatcagttcattggcatctttgctcaaaatagacctgagtgggtgattattgaacaaggatgctttgcttattcgatggtgatcgttccactttatgatacccttggaaatgaagccatcacgtacatagtcaacaaagctgaactctctctggtttttgttgacaagccagagaaggccaaactcttattagagggtgtagaaaataagttaataccaggccttaaaatcatagttgtcatggatgcctacggcagtgaactggtggaacgaggccagaggtgtggggtggaagtcaccagcatgaaggcgatggaggacctgggaagagccaacagacggaagcccaagcctccagcacctgaagatcttgcagtaatttgtttcacaagtggaactacaggcaaccccaaaggagcaatggtcactcaccgaaacatagtgagcgattgttcagcttttgtgaaagcaacagagaaagcacttcccttgagtgccagtgacacacacatttcatatttaccacttgctcacatttatgaacagttattgaagtgtgtaatgctgtgtcatggagctaaaatcggatttttccaaggagatatcaggctgctcatggatgacctcaaggtgcttcaacccactgtcttccccgtggttccaagactgctgaaccggatgtttgaccgaattttcggacaagcaaacaccacgctgaagcgatggctcttggactttgcctccaagaggaaagaagcagagcttcgcagcggcatcatcagaaacaacagcctgtgggaccggctgatcttccacaaagtacagtcgagcctgggcggaagagtccggctgatggtgacaggagccgccccggtgtctgccactgtgctgacgttcctcagagcagccctgggctgtcagttttatgaaggatacggacagacagagtgcactgccgggtgctgcctgaccatgcctggagactggaccgcaggccatgttggggccccgatgccgtgcaatttgataaaacttgttgatgtggaagaaatgaattacatggctgccgagggcgagggcgaggtgtgtgtgaaagggccaaatgtatttcagggctacttgaaggacccagcgaaaacagcagaagctttggacaaagacggctggttacacacaggggacattggaaaatggttaccaaatggcaccttgaaaattatcgaccggaaaaagcacatatttaagctggcacaaggagaatacatagcccctgaaaagattgaaaatatctacatgcgaagtgagcctgttgctcaggtgtttgtccacggagaaagcctgcaggcatttctcattgcaattgtggtaccagatgttgagacattatgttcctgggcccaaaagagaggatttgaagggtcgtttgaggaactgtgcagaaataaggatgtcaaaaaagctatcctcgaagatatggtgagacttgggaaggattctggtctgaaaccatttgaacaggtcaaaggcatcacattgcaccctgaattattttctatcgacaatggccttctgactccaacaatgaaggcgaaaaggccagagctgcggaactatttcaggtcgcagatagatgacctctattccactatcaaggtttagtgtgaagaagaaagctcagaggaaatggcacagttccacaatctcttctcctgctgatggccttcatgttgttaattt

SEQ ID NO: 104407 - DNA, 2490 bp, Homo sapiens
  Payload ID: 504
  Gene Symbol: ACSL1
  Gene Name: acyl-CoA synthetase long-chain family member 1
  ENST ID: ENST00000507295
  CDS Start-End: 152-2146
gcaaccagcgggccgaggcggcggcgccagcggcgccttaaatagcatccagagccggcgcggggcagggagtgggctgcagtgacagccggcggcggagcggccggtccacggaggagaattcagcttagagaactatcaacacaggacaatgcaagcccatgagctgttccggtattttcgaatgccagagctggttgacttccgacagtacgtgcgtactcttccgaccaacacgcttatgggcttcggagcttttgcagcactcaccaccttctggtacgccacgagacccaaacccctgaagccgccatgcgacctctccatgcagtcagtggaagtggcgggtagtggtggtgcacgaagatccgcactacttgacagcgacgagcccttggtgtatttctatgatgatgtcacaacattatacgaaggtttccagaggggaatacaggtgtcaaataatggcccttgtttaggctctcggaaaccagaccaaccctatgaatggctttcatataaacagtgggtgattattgaacaaggatgctttgcttattcgatggtgatcgttccactttatgatacccttggaaatgaagccatcacgtacatagtcaacaaagctgaactctctctggtttttgttgacaagccagagaaggccaaactcttattagagggtgtagaaaataagttaataccaggccttaaaatcatagttgtcatggatgcctacggcagtgaactggtggaacgaggccagaggtgtggggtggaagtcaccagcatgaaggcgatggaggacctgggaagagccaacagacggaagcccaagcctccagcacctgaagatcttgcagtaatttgtttcacaagtggaactacaggcaaccccaaaggagcaatggtcactcaccgaaacatagtgagcgattgttcagcttttgtgaaagcaacagagaatacagtcaatccttgcccagatgatactttgatatctttcttgcctctcgcccatatgtttgagagagttgtagagtgtgtaatgctgtgtcatggagctaaaatcggatttttccaaggagatatcaggctgctcatggatgacctcaaggtgcttcaacccactgtcttccccgtggttccaagactgctgaaccggatgtttgaccgaattttcggacaagcaaacaccacgctgaagcgatggctcttggactttgcctccaagaggaaagaagcagagcttcgcagcggcatcatcagaaacaacagcctgtgggaccggctgatcttccacaaagtacagtcgagcctgggcggaagagtccggctgatggtgacaggagccgccccggtgtctgccactgtgctgacgttcctcagagcagccctgggctgtcagttttatgaaggatacggacagacagagtgcactgccgggtgctgcctgaccatgcctggagactggaccgcaggccatgttggggccccgatgccgtgcaatttgataaaacttgttgatgtggaagaaatgaattacatggctgccgagggcgagggcgaggtgtgtgtgaaagggccaaatgtatttcagggctacttgaaggacccagcgaaaacagcagaagctttggacaaagacggctggttacacacaggggacattggaaaatggttaccaaatggcaccttgaaaattatcgaccggaaaaagcacatatttaagctggcacaaggagaatacatagcccctgaaaagattgaaaatatctacatgcgaagtgagcctgttgctcaggtgtttgtccacggagaaagcctgcaggcatttctcattgcaattgtggtaccagatgttgagacattatgttcctgggcccaaaagagaggatttgaagggtcgtttgaggaactgtgcagaaataaggatgtcaaaaaagctatcctcgaagatatggtgagacttgggaaggattctggtctgaaaccatttgaacaggtcaaaggcatcacattgcaccctgaattattttctatcgacaatggccttctgactccaacaatgaaggcgaaaaggccagagctgcggaactatttcaggtcgcagatagatgacctctattccactatcaaggtttagtgtgaagaagaaagctcagaggaaatggcacagttccacaatctcttctcctgctgatggccttcatgttgttaattttgaatacagcaagtgtagggaaggaagcgttcgtgtttgacttgtccattcggggttcttctcataggaatgctagaggaaagagaacactgccttacagtcacctcatgttgcagaccatgtttatggtaatacacactttccaaaatgagccttaaaaattgtaaaggggatactataaatgtgctaagttatttgagacttcctcagtttaaaaagtgggttttaaatcttctgtctccctgtttctctaatcaaggggttag

SEQ ID NO: 104408 - DNA, 2646 bp, Homo sapiens
  Payload ID: 504
  Gene Symbol: ACSL1
  Gene Name: acyl-CoA synthetase long-chain family member 1
  ENST ID: ENST00000506733
  CDS Start-End: 193-573
atttatgtgggtttgtttgagggctgcattcctagtgaagtattccatcaaactgccattattcatcttgatgaaagcttgaggaactttagaaggagagaaacatccagaccacccggtttttggtttctaaatgacatgaagagaatacaatgttaataattcagcttagagaactatcaacacaggacaatgcaagcccatgagctgttccggtattttcgaatgccagagctggttgacttccgacagtacgtgcgtactcttccgaccaacacgcttatgggcttcggagcttttgcagcactcaccaccttctggtacgccacgagacccaaacccctgaagccgccatgcgacctctccatgcagtcagtggaagtggcgggtagtggtggtgcacgaagatccgcactacttgacagcgacgagcccttggtgtatttctatgatgatgtcacaacattatacgaaggtttccagaggggaatacaggtgtcaagatcgctcaggcccctctgtgtccactgtaactttcccagagtcggtcccaaagctcactggaccctctagatgttccctgtggccctgggggctccatggtcaaatatgtgagtgtcacatcctgtattttatgataatggcccttgtttaggctctcggaaaccagaccaaccctatgaatggctttcatataaacaggttgcagaattgtcggagtgcataggctcagcactgatccagaagggcttcaagactgccccagatcagttcattggcatctttgctcaaaatagacctgagtgggtgattattgaacaaggatgctttgcttattcgatggtgatcgttccactttatgatacccttggaaatgaagccatcacgtacatagtcaacaaagctgaactctctctggtttttgttgacaagccagagaaggccaaactcttattagagggtgtagaaaataagttaataccaggccttaaaatcatagttgtcatggatgcctacggcagtgaactggtggaacgaggccagaggtgtggggtggaagtcaccagcatgaaggcgatggaggacctgggaagagccaacagacggaagcccaagcctccagcacctgaagatcttgcagtaatttgtttcacaagtggaactacaggcaaccccaaaggagcaatggtcactcaccgaaacatagtgagcgattgttcagcttttgtgaaagcaacagagaatacagtcaatccttgcccagatgatactttgatatctttcttgcctctcgcccatatgtttgagagagttgtagagtgtgtaatgctgtgtcatggagctaaaatcggatttttccaaggagatatcaggctgctcatggatgacctcaaggtgcttcaacccactgtcttccccgtggttccaagactgctgaaccggatgtttgaccgaattttcggacaagcaaacaccacgctgaagcgatggctcttggactttgcctccaagaggaaagaagcagagcttcgcagcggcatcatcagaaacaacagcctgtgggaccggctgatcttccacaaagtacagtcgagcctgggcggaagagtccggctgatggtgacaggagccgccccggtgtctgccactgtgctgacgttcctcagagcagccctgggctgtcagttttatgaaggatacggacagacagagtgcactgccgggtgctgcctgaccatgcctggagactggaccgcaggccatgttggggccccgatgccgtgcaatttgataaaacttgttgatgtggaagaaatgaattacatggctgccgagggcgagggcgaggtgtgtgtgaaagggccaaatgtatttcagggctacttgaaggacccagcgaaaacagcagaagctttggacaaagacggctggttacacacaggggacattggaaaatggttaccaaatggcaccttgaaaattatcgaccggaaaaagcacatatttaagctggcacaaggagaatacatagcccctgaaaagattgaaaatatctacatgcgaagtgagcctgttgctcaggtgtttgtccacggagaaagcctgcaggcatttctcattgcaattgtggtaccagatgttgagacattatgttcctgggcccaaaagagaggatttgaagggtcgtttgaggaactgtgcagaaataaggatgtcaaaaaagctatcctcgaagatatggtgagacttgggaaggattctggtctgaaaccatttgaacaggtcaaaggcatcacattgcaccctgaattattttctatcgacaatggccttctgactccaacaatgaaggcgaaaaggccagagctgcggaactatttcaggtcgcagatagatgacctctattccactatcaaggtttagtgtgaagaagaaagctcagaggaaatggcacagttccacaatctcttctcctgctgatggccttcatgttgttaattttgaatacagcaagtgtagggaaggaagcgttcgtgtttgacttgtccattcggggttcttctcataggaatgctagaggaaagagaacactgccttacagtcacctcatgttgcagaccatgtttatggtaatacacactttcc

SEQ ID NO: 104409 - DNA, 4103 bp, Homo sapiens
  Payload ID: 504
  Gene Symbol: ACSL1
  Gene Name: acyl-CoA synthetase long-chain family member 1
  ENST ID: ENST00000622937
  CDS Start-End: 991-2574
acaaagggggcgctttcagcctctgtaaatagcctattgtacaaggggaggaggcggggcacggaatggcagcatcttgccagcttgggttgctgcgttaaggaaagatgtcaggctttcttaatttgccactgcaggggcaagggtgtcatttatgtgggtttgtttgagggctgcattcctagtgaagtattccatcaaactgccattattcatcttgatgaaagcttgaggaactttagaaggagagaaacatccagaccacccggtttttggtttctaaatgacatgaagagaatacaatgttaataattcagcttagagaactatcaacacaggacaatgcaagcccatgagctgttccggtattttcgaatgccagagctggttgacttccgacagtacgtgcgtactcttccgaccaacacgcttatgggcttcggagcttttgcagcactcaccaccttctggtacgccacgagacccaaacccctgaagccgccatgcgacctctccatgcagtcagtggaagtggcgggtagtggtggtgcacgaagatccgcactacttgacagcgacgagcccttggtgtatttctatgatgatgtcacaacattatacgaaggtttccagaggggaatacaggtgtcaagatcgctcaggcccctctgtgtccactgtaactttcccagagtcggtcccaaagctcactggaccctctagatgttccctgtggccctgggggctccatggtcaaatatgtgagtgtcacatcctgtattttatgataatggcccttgtttaggctctcggaaaccagaccaaccctatgaatggctttcatataaacaggttgcagaattgtcggagtgcataggctcagcactgatccagaagggcttcaagactgccccagatcagttcattggcatctttgctcaaaatagacctgagtgggtgattattgaacaaggatgctttgcttattcgatggtgatcgttccactttatgatacccttggaaatgaagccatcacgtacatagtcaacaaagctgaactctctctggtttttgttgacaagccagagaaggccaaactcttattagagggtgtagaaaataagttaataccaggccttaaaatcatagttgtcatggatgcctacggcagtgaactggtggaacgaggccagaggtgtggggtggaagtcaccagcatgaaggcgatggaggacctgggaagagccaacagacggaagcccaagcctccagcacctgaagatcttgcagtaatttgtttcacaagtggaactacaggcaaccccaaaggagcaatggtcactcaccgaaacatagtgagcgattgttcagcttttgtgaaagcaacagagaatacagtcaatccttgcccagatgatactttgatatctttcttgcctctcgcccatatgtttgagagagttgtagagtgtgtaatgctgtgtcatggagctaaaatcggatttttccaaggagatatcaggctgctcatggatgacctcaaggtgcttcaacccactgtcttccccgtggttccaagactgctgaaccggatgtttgaccgaattttcggacaagcaaacaccacgctgaagcgatggctcttggactttgcctccaagaggaaagaagcagagcttcgcagcggcatcatcagaaacaacagcctgtgggaccggctgatcttccacaaagtacagtcgagcctgggcggaagagtccggctgatggtgacaggagccgccccggtgtctgccactgtgctgacgttcctcagagcagccctgggctgtcagttttatgaaggatacggacagacagagtgcactgccgggtgctgcctgaccatgcctggagactggaccgcaggccatgttggggccccgatgccgtgcaatttgataaaacttgttgatgtggaagaaatgaattacatggctgccgagggcgagggcgaggtgtgtgtgaaagggccaaatgtatttcagggctacttgaaggacccagcgaaaacagcagaagctttggacaaagacggctggttacacacaggggacattggaaaatggttaccaaatggcaccttgaaaattatcgaccggaaaaagcacatatttaagctggcacaaggagaatacatagcccctgaaaagattgaaaatatctacatgcgaagtgagcctgttgctcaggtgtttgtccacggagaaagcctgcaggcatttctcattgcaattgtggtaccagatgttgagacattatgttcctgggcccaaaagagaggatttgaagggtcgtttgaggaactgtgcagaaataaggatgtcaaaaaagctatcctcgaagatatggtgagacttgggaaggattctggtctgaaaccatttgaacaggtcaaaggcatcacattgcaccctgaattattttctatcgacaatggccttctgactccaacaatgaaggcgaaaaggccagagctgcggaactatttcaggtcgcagatagatgacctctattccactatcaaggtttagtgtgaagaagaaagctcagaggaaatggcacagttccacaatctcttctcctgctgatggccttcatgttgttaattttgaatacagcaagtgtagggaaggaagcgttcgtgtttgacttgtccattcggggttcttctcataggaatgctagaggaaagagaacactgccttacagtcacctcatgttgcagaccatgtttatggtaatacacactttccaaaatgagccttaaaaattgtaaaggggatactataaatgtgctaagttatttgagacttcctcagtttaaaaagtgggttttaaatcttctgtctccctgtttctctaatcaaggggttaggactttgctatctctgagatgtctgctacttgctgcaaattctgcagctgtctgctgctctaaagagtacagtgcactagagggaagtgttccctttaaaaataagaacaactgtcctggctggagaatctcacaagcggaccagagatctttttaaatccctgctactgtcccttctcacaggcattcacagaacccttctgattcgtaagggttacgaaactcatgttcttctccagtcccctgtggtttctgttggagcataaggtttccagtaagcgggagggcagatccaactcagaaccatgcagataaggagcctctggcaaatgggtgctcatcagaacgcgtggattctctttcatggcagaatgctcttggactcggttctccaggcctgattccccgactccatcctttttcaggggttatttaaaaatctgccttagattctatagtgaagacaagcatttcaagaaagagttacctggatcagccatgctcagctgtgacgcctgaataactgtctactttatcttcactgaaccactcactctgtgtaaaggccaacagatttttaatgtggttttcatatcaaaagatcatgttgggattaacttgcctttttccccaaaaaataaactctcaggcaagcatttctttaaagctattaagggagtatatacttgagtacttattgaaatggacagtaataagcaaatgttcttataatgctacctgatttctatgaaatgtgtttgacaagccaaaattctaggatgtagaaatctggaaagttcatttcctgggattcacttctccagggattttttaaagttaatttgggaaattaacagcagttcactttattgtgagtctttgccacatttgactgaattgagctgtcatttgtacatttaaagcagctgttttggggtctgtgagagtacatgtattatatacaagcacaacagggcttgcactaaagaattgtcattgtaataacactacttggtagcctaacttcatatatgtattcttaattgcacaaaaagtcaataatttgtcaccttggggttttgaatgtttgctttaagtgttggctatttctatgttttataaaccaaaacaaaatttccaaaaacaatgaaggaaaccaaaataaatatttctgcatttcaggtg

SEQ ID NO: 104410 - DNA, 5679 bp, Homo sapiens
  Payload ID: 505
  Gene Symbol: ACSL3
  Gene Name: acyl-CoA synthetase long-chain family member 3
  Uniprot ID: O95573
  ENST ID: ENST00000357430
  CDS Start-End: 532-2694
agccccgcacgcgccaccgctcgcgggccaatgggtggcagcctctctgcataggcaacgagtgccggccgggggtgagcgtcccaggcggttccgctcaacagacgctgctgtggctgcgccgggctgcgacactgcagttgtctacgcggccggggccgggacgaggaggcgttggacggggtcgcatacgttcgtcccctcgcattgcggccccgacagctgcgccaggatccccgggcggcggcgcggggcgtgaacgctctggggctcagccaggcctgcgcgggcccgaggccggaggaacccggactccggcgtagcggttttgacacaagggcgcatatcttcaaagcacctagtacctcctaccattgtcaactgatacagaattcgttgttgggaaggactggggaaacagctgtaacatttgccaccctcagaagctgctggtcctgtgtcacaccaccttagcctcttgatcgaggaagattctcgctgaagtctgttaattctactttttgagtacttatgaataaccacgtgtcttcaaaaccatctaccatgaagctaaaacataccatcaaccctattcttttatattttatacattttctaatatcactttatactattttaacatacattccgttttattttttctccgagtcaagacaagaaaaatcaaaccgaattaaagcaaagcctgtaaattcaaaacctgattctgcatacagatctgttaatagtttggatggtttggcttcagtattataccctggatgtgatactttagataaagtttttacatatgcaaaaaacaaatttaagaacaaaagactcttgggaacacgtgaagttttaaatgaggaagatgaagtacaaccaaatggaaaaatttttaaaaaggttattcttggacagtataattggctttcctatgaagatgtctttgttcgagcctttaattttggaaatggattacagatgttgggtcagaaaccaaagaccaacatcgccatcttctgtgagaccagggccgagtggatgatagctgcacaggcgtgttttatgtataattttcagcttgttacattatatgccactctaggaggtccagccattgttcatgcattaaatgaaacagaggtgaccaacatcattactagtaaagaactcttacaaacaaagttgaaggatatagtttctttggtcccacgcctgcggcacatcatcactgttgatggaaagccaccgacctggtccgagttccccaagggcatcattgtgcataccatggctgcagtggaggccctgggagccaaggccagcatggaaaaccaacctcatagcaaaccattgccctcagatattgcagtaatcatgtacacaagtggatccacaggacttccaaagggagtcatgatctcacatagtaacattattgctggtataactgggatggcagaaaggattccagaactaggagaggaagatgtctacattggatatttgcctctggcccatgttctagaattaagtgctgagcttgtctgtctttctcacggatgccgcattggttactcttcaccacagactttagcagatcagtcttcaaaaattaaaaaaggaagcaaaggggatacatccatgttgaaaccaacactgatggcagcagttccggaaatcatggatcggatctacaaaaatgtcatgaataaagtcagtgaaatgagtagttttcaacgtaatctgtttattctggcctataattacaaaatggaacagatttcaaaaggacgtaatactccactgtgcgacagctttgttttccggaaagttcgaagcttgctagggggaaatattcgtctcctgttgtgtggtggcgctccactttctgcaaccacgcagcgattcatgaacatctgtttctgctgtcctgttggtcagggatacgggctcactgaatctgctggggctggaacaatttccgaagtgtgggactacaatactggcagagtgggagcaccattagtttgctgtgaaatcaaattaaaaaactgggaggaaggtggatactttaatactgataagccacaccccaggggtgaaattcttattgggggccaaagtgtgacaatggggtactacaaaaatgaagcaaaaacaaaagctgatttctttgaagatgaaaatggacaaaggtggctctgtactggggatattggagagtttgaacccgatggatgcttaaagattattgatcgtaaaaaggaccttgtaaaactacaggcaggggaatatgtttctcttgggaaagtagaggcagctttgaagaatcttccactagtagataacatttgtgcatatgcaaacagttatcattcttatgtcattggatttgttgtgccaaatcaaaaggaactaactgaactagctcgaaagaaaggacttaaagggacttgggaggagctgtgtaacagttgtgaaatggaaaatgaggtacttaaagtgctttccgaagctgctatttcagcaagtctggaaaagtttgaaattccagtaaaaattcgtttgagtcctgaaccgtggacccctgaaactggtctggtgacagatgccttcaagctgaaacgcaaagagcttaaaacacattaccaggcggacattgagcgaatgtatggaagaaaataattattctcttctggcatcagtttgctacagtgagctcagatcaaataggaaaatacttgaaatgcatgtctcaagctgcaaggcaaactccattcctcatattaaactattacttctcatgacgtcaccatttttaactgacaggattagtaaaacattaagacagcaaacttgtgtctgtctcttctttcattttccccgccaccaacttactttaccacctatgactgtacttgtcagtatgagaatttttctgaatcatattggggaagcagtgattttaaaacctcaagtttttaaacatgatttatatgttctgtataatgttcagtttgtaactttttaaaagtttggatgtatagagggataaataggaaatataagaattggttatttgggggcttttttacttactgtatttaaaaatacaagggtattgatatgaaattatgtaaatttcaaatgcttatgaatcaaatcattgttgaacaaaagatttgttgctgtgtaattattgtcttgtatgcatttgagagaaataaatatacccatacttatgttttaagaagttgagatcttgtgaatatatgcctgtcagtgtcttctttatatatttattttttattagaaaaaatgaagtttggttggtgatgcatgaaacaaaatagcaagagagggttatagtttaatagtaagggagataacacagcatgtgtagcaccagttgataattggtctctagtagcttactgtcaaaatgttcaatgaagtcttctgttcatctgttgaaactaggaaaatacccaaacttaaatggaagaattctgaaagagaggatagaatttaaagaacaagagtatataaagttattctttgaatatttcgttgactatatgtacattgagttatctatatttgtaaacaaattagtcatggaaaattattctatctcaaagtctccttttagtctagataatcattatttcattttaaaattagtgtttttcctagtttgcactgatgcgtgtatggatgtgtgtgagtcagtggtagcttatttaaaaagcaccttatcctttctcccataacctttgtacactaaaaaatgaaagaatttagaatgtatttgatgatagcattctcactaagacacatgagaatttaactttataaccgcgtgagttaagatttaattcataggttttgatgtcattgttgaagttatttgtaattcagaaaccttgcttgtgtgatacatagtctcttcatttattactgcttgtctgttgttatatctggattatcaaaagcaatagtgcaccaattaagatgtgctcaaatcaggacttaaatcataggcaccacatttttcatgtcagactagttactttgttgattctcagttactgtaggcatcaaaaggcaaaaatcaaaaaaaaaaaaaacaaaaacaaaaaaaaagatgaacctaggtctgtgtaaagtaaggggagtgttaggagcagccaggactgtgtagtgtgtgtttggttgcatcacaaacatcgtatgtggagacattgcaatacagtgttttttgttttcaacttttcttgtattgtatatttgtattatgttttgaatgcttttctcttttcataattaaatattaatgtttgggataactgccaagaagaagtaaaaatattgaatggaacttctatatgaggatgctgtgatctaaaaattaaatctcagtgggcggagagaatttgtttctgatgccttgtctttagaataattgtttgctttcagatgattaaaaaaaggagattgtatctaggaaaaaagtgtgaatgcttcaaaggagagatactgataattgtgacttgaaatagtgtcagatgaattatgtagctgatcactgatggaaccatctaatgaggcaggcttaaactctatttagtttcgtttgttttctcatatgaagtttataattcctttcagtcctaaaatgtcagatgccaggtgtcaaatgccacagtagaaagtgaaattaagtagagtccccttttaaacaaatttgtctgtaagcaaaactatctttagtgacttaaaaaataatatcctctaaaattaccctttcaagaggaaaaaactgttcaatgaaaaaaccactcaattatgactcatataagaaatactggtttaaccaggagatatttggggagcaaaattttaaggaatttcaaattgctaaatctaatacaaatatctgacaataagatacagatctaaaagaatggttcttaagaactattgtttactgggaataaactaagctctatgaagaattcgtaagcattacatgttccagtaagtttagcaacttagagccaagactggtggccacctccatttatttccccactgctcctccactgacatccttcttagcagaaacttcatgaaaaagtttttgctgacacagaacaaacctgaaagtagtatctactttctaaatactactttgcttttcagtagtggatttgatatttataatgttctctaaagcttgcaactttttcagcaacgtttaaaaatagattaacctggaataacttacttgtttgctgctaaaatactcaagattttgccatttttaaacaaccagtccctgtgatacaactttgaaaaaacttttaaaaatctctgatgtgtgggctctttttttcccataagaattatgtacatctgtgatgttttacagggggatccgcttttaaacagtgtacatattggaccacactgaaatgtcatatatcctttctctacttaaaattggttatttactgtgagttcatttccgatgtgttcttggttgttgctgttttctgcctgaagacgtgtatcataaagagctacatggtatggactatttatttgtaatttgacataaagtttgaagaataaagatctataaaagttgaagtttctgatattaaa

SEQ ID NO: 104411 - DNA, 3147 bp, Homo sapiens
  Payload ID: 505
  Gene Symbol: ACSL3
  Gene Name: acyl-CoA synthetase long-chain family member 3
  Uniprot ID: O95573
  ENST ID: ENST00000392066
  CDS Start-End: 417-2579
acgcgccaccgctcgcgggccaatgggtggcagcctctctgcataggcaacgagtgccggccgggggtgagcgtcccaggcggttccgctcaacagacgctgctgtggctgcgccgggctgcgacactgcagttgtctacgcggccggggccgggacgaggaggcgttggacggggtcgcatacgttcgtcccctcgcattgcggccccgacagctgcgccaggatccccgggcggcggcgcggggcgtgaacgctctggggctcagccaggcctgcgcgggcccgaggccggaggaacccggactccggcgtagcggttttgacacaagggcgcatatcttcaaagcacctagtacctcctaccattgtcaactgattctcgctgaagtctgttaattctactttttgagtacttatgaataaccacgtgtcttcaaaaccatctaccatgaagctaaaacataccatcaaccctattcttttatattttatacattttctaatatcactttatactattttaacatacattccgttttattttttctccgagtcaagacaagaaaaatcaaaccgaattaaagcaaagcctgtaaattcaaaacctgattctgcatacagatctgttaatagtttggatggtttggcttcagtattataccctggatgtgatactttagataaagtttttacatatgcaaaaaacaaatttaagaacaaaagactcttgggaacacgtgaagttttaaatgaggaagatgaagtacaaccaaatggaaaaatttttaaaaaggttattcttggacagtataattggctttcctatgaagatgtctttgttcgagcctttaattttggaaatggattacagatgttgggtcagaaaccaaagaccaacatcgccatcttctgtgagaccagggccgagtggatgatagctgcacaggcgtgttttatgtataattttcagcttgttacattatatgccactctaggaggtccagccattgttcatgcattaaatgaaacagaggtgaccaacatcattactagtaaagaactcttacaaacaaagttgaaggatatagtttctttggtcccacgcctgcggcacatcatcactgttgatggaaagccaccgacctggtccgagttccccaagggcatcattgtgcataccatggctgcagtggaggccctgggagccaaggccagcatggaaaaccaacctcatagcaaaccattgccctcagatattgcagtaatcatgtacacaagtggatccacaggacttccaaagggagtcatgatctcacatagtaacattattgctggtataactgggatggcagaaaggattccagaactaggagaggaagatgtctacattggatatttgcctctggcccatgttctagaattaagtgctgagcttgtctgtctttctcacggatgccgcattggttactcttcaccacagactttagcagatcagtcttcaaaaattaaaaaaggaagcaaaggggatacatccatgttgaaaccaacactgatggcagcagttccggaaatcatggatcggatctacaaaaatgtcatgaataaagtcagtgaaatgagtagttttcaacgtaatctgtttattctggcctataattacaaaatggaacagatttcaaaaggacgtaatactccactgtgcgacagctttgttttccggaaagttcgaagcttgctagggggaaatattcgtctcctgttgtgtggtggcgctccactttctgcaaccacgcagcgattcatgaacatctgtttctgctgtcctgttggtcagggatacgggctcactgaatctgctggggctggaacaatttccgaagtgtgggactacaatactggcagagtgggagcaccattagtttgctgtgaaatcaaattaaaaaactgggaggaaggtggatactttaatactgataagccacaccccaggggtgaaattcttattgggggccaaagtgtgacaatggggtactacaaaaatgaagcaaaaacaaaagctgatttctttgaagatgaaaatggacaaaggtggctctgtactggggatattggagagtttgaacccgatggatgcttaaagattattgatcgtaaaaaggaccttgtaaaactacaggcaggggaatatgtttctcttgggaaagtagaggcagctttgaagaatcttccactagtagataacatttgtgcatatgcaaacagttatcattcttatgtcattggatttgttgtgccaaatcaaaaggaactaactgaactagctcgaaagaaaggacttaaagggacttgggaggagctgtgtaacagttgtgaaatggaaaatgaggtacttaaagtgctttccgaagctgctatttcagcaagtctggaaaagtttgaaattccagtaaaaattcgtttgagtcctgaaccgtggacccctgaaactggtctggtgacagatgccttcaagctgaaacgcaaagagcttaaaacacattaccaggcggacattgagcgaatgtatggaagaaaataattattctcttctggcatcagtttgctacagtgagctcagatcaaataggaaaatacttgaaatgcatgtctcaagctgcaaggcaaactccattcctcatattaaactattacttctcatgacgtcaccatttttaactgacaggattagtaaaacattaagacagcaaacttgtgtctgtctcttctttcattttccccgccaccaacttactttaccacctatgactgtacttgtcagtatgagaatttttctgaatcatattggggaagcagtgattttaaaacctcaagtttttaaacatgatttatatgttctgtataatgttcagtttgtaactttttaaaagtttggatgtatagagggataaataggaaatataagaattggttatttgggggcttttttacttactgtatttaaaaatacaagggtattgatatgaaattatgtaaatttcaaatgcttatgaatcaaatcattgttgaacaaaagatttgttgctgtgtaattattgtcttgtatgcatttgagagaaataaatatacccatacttatgttttaagaa

SEQ ID NO: 104412 - DNA, 538 bp, Homo sapiens
  Payload ID: 505
  Gene Symbol: ACSL3
  Gene Name: acyl-CoA synthetase long-chain family member 3
  ENST ID: ENST00000407441
  CDS Start-End: 1-55
ggaacagatttcaaaaggacgtaatactccactgtgcgacaggtggatactttaatactgataagccacaccccaggggtgaaattcttattgggggccaaagtgtgacaatggggtactacaaaaatgaagcaaaaacaaaagctgatttctttgaagatgaaaatggacaaaggtggctctgtactggggatattggagagtttgaacccgatggatgcttaaagattattgatcgtaaaaaggaccttgtaaaactacaggcaggggaatatgtttctcttgggaaagtagaggcagctttgaagaatcttccactagtagataacatttgtgcatatgcaaacagttatcattcttatgtcattggatttgttgtgccaaatcaaaaggaactaactgaactagctcgaaagaaaggacttaaagggacttgggaggagctgtgtaacagttgtgaaatggaaaatgaggtacttaaagtgctttccgaagctgctatttcagcaagtctggaaaagtttgaaattccagtaaa

SEQ ID NO: 104413 - DNA, 650 bp, Homo sapiens
  Payload ID: 505
  Gene Symbol: ACSL3
  Gene Name: acyl-CoA synthetase long-chain family member 3
  ENST ID: ENST00000413316
  CDS Start-End: 387-650
actgcgtgcctcccggcgctgtggggcggggtggggaggccacccccttgaattaagagggctctgccgcggccccagcagtgcggtgtccgtggaaggagactcagccctgcgatttcggaaaacccttgtttggcggggcgggaggggctgttgctgcgtggggtgagaagaaactaggttttgacacaagggcgcatatcttcaaagcacctagtacctcctaccattgtcaactgatacagaattcgttgttgggaaggactggggaaacagctgtaacatttgccaccctcagaagctgctggtcctgtgtcacaccaccttagcctcttgatcgaggaagattctcgctgaagtctgttaattctactttttgagtacttatgaataaccacgtgtcttcaaaaccatctaccatgaagctaaaacataccatcaaccctattcttttatattttatacattttctaatatcactttatactattttaacatacattccgttttattttttctccgagtcaagacaagaaaaatcaaaccgaattaaagcaaagcctgtaaattcaaaacctgattctgcatacagatctgttaatagtttggatggtttggcttcagtattataccctggatgtgatacttta

SEQ ID NO: 104414 - DNA, 560 bp, Homo sapiens
  Payload ID: 505
  Gene Symbol: ACSL3
  Gene Name: acyl-CoA synthetase long-chain family member 3
  ENST ID: ENST00000535678
  CDS Start-End: 274-560
tccgctcaacagacgctgctgtggctgcgccgggctgcgacactgcagttgtctacgcggccggggccgggacgaggaggcgttggacggggtcgcatacgttcgtcccctcgcattgcggccccgacagctgcgccaggatccccgggcggcggcgcggggcgtgaacgctctggggctcagccaggcctgcgcgggcccgaggccggaggaacccggactccggcgtagcgattctcgctgaagtctgttaattctactttttgagtacttatgaataaccacgtgtcttcaaaaccatctaccatgaagctaaaacataccatcaaccctattcttttatattttatacattttctaatatcactttatactattttaacatacattccgttttattttttctccgagtcaagacaagaaaaatcaaaccgaattaaagcaaagcctgtaaattcaaaacctgattctgcatacagatctgttaatagtttggatggtttggcttcagtattataccctggatgtgatactttagataaagtttttacatatgcaaa

SEQ ID NO: 104415 - DNA, 624 bp, Homo sapiens
  Payload ID: 505
  Gene Symbol: ACSL3
  Gene Name: acyl-CoA synthetase long-chain family member 3
  ENST ID: ENST00000540115
  CDS Start-End: 202-624
tgaaacaacgggcaagatgttctcagaggcagtgtaacagcgattaagagcctggactccagacccagactataggtctgaatcttggctttgccacttaactggctttctgaccctggaaaagttattcttggacagtataattggctttcctatgaagatgtctttgttcgagcctttaattttggaaatggattacagatgttgggtcagaaaccaaagaccaacatcgccatcttctgtgagaccagggccgagtggatgatagctgcacaggcgtgttttatgtataattttcagcttgttacattatatgccactctaggaggtccagccattgttcatgcattaaatgaaacagaggtgaccaacatcattactagtaaagaactcttacaaacaaagttgaaggatatagtttctttggtcccacgcctgcggcacatcatcactgttgatggaaagccaccgacctggtccgagttccccaagggcatcattgtgcataccatggctgcagtggaggccctgggagccaaggccagcatggaaaaccaacctcatagcaaaccattgccctcagatattgcagtaatcatgtacacaagtggatccacaggactt

SEQ ID NO: 104416 - DNA, 5032 bp, Homo sapiens
  Payload ID: 506
  Gene Symbol: ACSL4
  Gene Name: acyl-CoA synthetase long-chain family member 4
  Uniprot ID: O60488
  ENST ID: ENST00000348502
  CDS Start-End: 328-2340
gtctgcagccagcgattcggctggctctgccacaccaccgcgcgcccccgctccgcccgcccctccgggcgcgtcttttccgggctcgcgctgagtcccgcctccgccggctgtccgggtgcgcgcgcgccgctgcggctttttctctggcctccgccgcgcgctcctcctcgtcccagcgctagcgggcacgcggttcctttttgcgagctttccgagtgccaggcgccggccggctgcgaagacgcggtgggccgcccctccgattgaaatcacagaagatattcgtgttcttcttaagagaaaaagaggacatttaaaaacgctatggcaaagagaataaaagctaagcccacttcagacaaacctggaagtccatatcgctctgtcacacacttcgactcactagctgtaatagacatccctggagcagatactctggataaattatttgaccatgctgtatccaagtttgggaagaaggacagccttgggaccagggaaatcctaagtgaagaaaatgaaatgcagccaaatggaaaagtttttaagaagttaattcttgggaattataaatggatgaactatcttgaagtgaatcgcagagtgaataactttggtagtggactcactgcactgggactaaaaccaaagaacaccattgccatcttctgtgagaccagggccgaatggatgattgcagcacagacctgctttaagtacaactttcctcttgtgactttatatgccacacttggcaaagaagcagtagttcatgggctaaatgaatctgaggcttcctatctgattaccagtgttgaacttctggaaagtaaacttaagactgcattgttagatatcagttgtgttaaacatatcatttatgtggacaataaggctatcaataaagcagagtaccctgaaggatttgagattcacagcatgcaatcagtagaagagttgggatctaacccagaaaacttgggcattcctccaagtagaccaacgccttcagacatggccattgttatgtatactagtggttctactggccgacctaagggagtgatgatgcatcatagcaatttgatagctggaatgacaggccagtgtgaaagaatacctggactgggaccgaaggacacatatattggctacttgcctttggctcatgtgctagaactgacagcagagatatcttgctttacctatggctgcaggattggatattcttctccgcttacactctctgaccagtccagcaaaattaaaaaaggaagcaaaggagactgtactgtactgaagcccacacttatggctgctgttccggaaatcatggatagaatttataagaatgttatgagcaaagtccaagagatgaattatattcagaaaactctgttcaagatagggtatgattacaaattggaacagatcaaaaagggatatgatgcacctctttgcaatctgttactgtttaaaaaggtcaaggccctgctgggagggaatgtccgcatgatgctgtctggaggggccccgctatctcctcagacacaccgattcatgaatgtctgcttctgctgcccaattggccagggttatggactgacagaatcatgtggtgctgggacagttactgaagtaactgactatactactggcagagttggagcacctcttatttgctgtgaaattaagctaaaagactggcaagaaggcggttatacaattaatgacaagccaaaccccagaggtgaaatcgtaattggtggacagaacatctccatgggatattttaaaaatgaagagaaaacagcagaagattattctgtggatgaaaatggacaaaggtggttttgcactggtgatattggagaattccatcccgatggatgtttacagattatagatcgtaagaaagatctagtgaagttacaagcaggagagtatgtatctcttgggaaagtagaagctgcactgaagaattgtccacttattgacaacatctgtgcttttgccaaaagtgatcagtcctatgtgatcagttttgtggttcctaaccagaaaaggttgacacttttggcacaacagaaaggggtagaaggaacttgggttgatatctgcaataatcctgctatggaagctgaaatactgaaagaaattcgagaagctgcaaatgccatgaaattggagcgatttgaaattccaatcaaggttcgattaagcccagagccatggacccctgaaactggtttggtaactgatgctttcaaactgaaaaggaaggagctgaggaaccattacctcaaagacattgaacgaatgtatgggggcaaataaaatgttgttgtcttattgacagttgtgcaggaggtagcctggtggttttcaacctctagaattttaagcctttgttgaactgttagaatgtaaggtatatcattctaaagatagagtaaaaagaaaacaaaaccaaaagttattaaaattgttgtccggtttactttaacttagttttgcatagttctagtgcagctgaaattgaaaagttatttccctttagctgtgttattatagagcagaaattctgtttttaaaaattagcctaagatatacttgtttttgtaaagaaaaatatttaatgttgaacaaaataaattggagttggagtagaatgtagtttgaggaaatttgcagcttccaatgcctcttgtcttcctatttcagaagtttaaatattaagcatgacagaaaatatgtattaacactactcaaagcaaaagtgctgcagggctttaaaattctcttccaaccatttatcttgaaggaaaaattcaatagtaatataatacacaaaatcaaataataccttagaaggtattaagattataattgttgcataggttagatatagagtcattgtaatgttgtgaataattacagtgcctaaaataagaatagaacaacatatacaacaccaaaaaatatctagtaatatatttaaagggaaattgagctgctttttttgaaactttgagatctaaaaataactgtaattatttgaatgactaagaggaaagtacattttttgaaatgctgaaaattgcctttctgtgtttattcaaactgaaaagctgagaccaagagcaaggaaggtaaaaagttaacaggcaaacattttctcttagaaaaggtgataaaatcataagtatttggaattagaacccttgcacagcactgaacctgggaaagagatttaaactctgaatttatctttgataacagggattgattttaaaatgtacatgtattaaattacatttgtaatttaaggtctgtttgctgttgctgattttattcttgatcagtagtttgcatttcagaaagcctttcattttgctttaattttagcaaagcgggttataatgaatgacttccccaatatcttgcttgaacttacaggtgattaacttggatgagttttgggaagttaaagggaagaaaacactgttatcattttttcctgtttgggaagagcttagaaactggaaatactagatttgggagaagggcagagttacttgataagggactgatgtttgtgcagtaacttgggagtgtggtttctttttgaatctttaattaaaacctgggattatatatccctgataaatattcacacttgaaccatagttactgtaaaatgcaaaaaatcttaatactgttattctttgcactttttcttaatcattttttatatatatgcatatatatatgtgtgtgtgtgtgttgcttatgttgttttgtacagatgtgggccaccattgcaacaaaatacattctttttgctctaaaatatttatgaagaaaatacttaaatgttatgtatatggtggtaataagggaaaaatcaagtattataaacaagaatgaaggtttttgtaaagatttctgttcagcgttttgcaaggtaaaattttaggcaagttttccctgaagttatgtgtatgtgagtattctcattcttcccaacttgcctttgaagagtgaaataccattattatcaagtagactactgttcagcttttattcctgccctgctgtttatcccttaagaatgagtttcttagacttttccaatatgtgattttttttcccatttagaatggtgattttaaatgtgtgagtgcatgtactatcttatctcagatatttgcacccccaatctgcccccaactcccaaaagctagaacactgccaactgatctgttataggtcctttagaaacacataattaacacttaaggttgggtgctgctaattctttgcaaaaatccaaatattgttaagggaccagggagatgccactaccccttgattttccatctaaaaatatacatgtttatgtaaacaaatctttccatatccatagtgacttttcaagtatttaagcctaaagattttgatctcacatttttatacctgtttaaattgctcacagttattacatacacatcagccatcaactaaagttgtactttaaaaatttactacaatatgtacatttctaagtcaaacacttgtgacttttgctttaattccatgaatgttcctgcctccttgatatttgtatttattctttttttctctagagtagaggtataattgtgtgatatttcagaaatacagataaatgattcaaaaagtcacagttaaggagaatcatgtttctttgatcatgaataactgattagtaagtcttgcctatattttcctgatagcatatgacaaatgtttctaaggtaacaagatgagaacagataaagattgtgtggtgttttggatttggagagaaatattttaatttttaaatgcagttacaaattataatgtattcatatttgtactttctgttaaaatgcatgattgcagaattgtttagattttgtgtttattcttgatgaaaagctttgtttgttcttgtttttaagtttgcactcaaatcttaagaaataaatccacccatgttatc

SEQ ID NO: 104417 - DNA, 5333 bp, Homo sapiens
  Payload ID: 506
  Gene Symbol: ACSL4
  Gene Name: acyl-CoA synthetase long-chain family member 4
  Uniprot ID: O60488
  ENST ID: ENST00000340800
  CDS Start-End: 506-2641
gcgattcggctggctctgccacaccaccgcgcgcccccgctccgcccgcccctccgggcgcgtcttttccgggctcgcgctgagtcccgcctccgccggctgtccgggtgcgcgcgcgccgctgcggctttttctctggcctccgccgcgcgctcctcctcgtcccagcgctagcgggcacgcggttcctttttgcgagctttccgagtgccaggcgccggccggctgcgaagacgcggtgggccgcccctccgattgaaatcacagaagatattcgtgttcttcttaagagaaaaagaggacattttagctttctcagttgaaggcgtactttattgtcggcttccaaagattactaacttttatctgtatcactaagattgaactgccttggctgtactgctattcttactgctgcttctattattgccttcttcagcacaataaggctttcaaaagccaaagaataacaagaaataagcaccattttagaagcctttccactatgaaacttaagctaaatgtgctcaccattattttgctgcctgtccacttgttaataacaatatacagtgcccttatatttattccatggtattttcttaccaatgccaagaagaaaaacgctatggcaaagagaataaaagctaagcccacttcagacaaacctggaagtccatatcgctctgtcacacacttcgactcactagctgtaatagacatccctggagcagatactctggataaattatttgaccatgctgtatccaagtttgggaagaaggacagccttgggaccagggaaatcctaagtgaagaaaatgaaatgcagccaaatggaaaagtttttaagaagttaattcttgggaattataaatggatgaactatcttgaagtgaatcgcagagtgaataactttggtagtggactcactgcactgggactaaaaccaaagaacaccattgccatcttctgtgagaccagggccgaatggatgattgcagcacagacctgctttaagtacaactttcctcttgtgactttatatgccacacttggcaaagaagcagtagttcatgggctaaatgaatctgaggcttcctatctgattaccagtgttgaacttctggaaagtaaacttaagactgcattgttagatatcagttgtgttaaacatatcatttatgtggacaataaggctatcaataaagcagagtaccctgaaggatttgagattcacagcatgcaatcagtagaagagttgggatctaacccagaaaacttgggcattcctccaagtagaccaacgccttcagacatggccattgttatgtatactagtggttctactggccgacctaagggagtgatgatgcatcatagcaatttgatagctggaatgacaggccagtgtgaaagaatacctggactgggaccgaaggacacatatattggctacttgcctttggctcatgtgctagaactgacagcagagatatcttgctttacctatggctgcaggattggatattcttctccgcttacactctctgaccagtccagcaaaattaaaaaaggaagcaaaggagactgtactgtactgaagcccacacttatggctgctgttccggaaatcatggatagaatttataagaatgttatgagcaaagtccaagagatgaattatattcagaaaactctgttcaagatagggtatgattacaaattggaacagatcaaaaagggatatgatgcacctctttgcaatctgttactgtttaaaaaggtcaaggccctgctgggagggaatgtccgcatgatgctgtctggaggggccccgctatctcctcagacacaccgattcatgaatgtctgcttctgctgcccaattggccagggttatggactgacagaatcatgtggtgctgggacagttactgaagtaactgactatactactggcagagttggagcacctcttatttgctgtgaaattaagctaaaagactggcaagaaggcggttatacaattaatgacaagccaaaccccagaggtgaaatcgtaattggtggacagaacatctccatgggatattttaaaaatgaagagaaaacagcagaagattattctgtggatgaaaatggacaaaggtggttttgcactggtgatattggagaattccatcccgatggatgtttacagattatagatcgtaagaaagatctagtgaagttacaagcaggagagtatgtatctcttgggaaagtagaagctgcactgaagaattgtccacttattgacaacatctgtgcttttgccaaaagtgatcagtcctatgtgatcagttttgtggttcctaaccagaaaaggttgacacttttggcacaacagaaaggggtagaaggaacttgggttgatatctgcaataatcctgctatggaagctgaaatactgaaagaaattcgagaagctgcaaatgccatgaaattggagcgatttgaaattccaatcaaggttcgattaagcccagagccatggacccctgaaactggtttggtaactgatgctttcaaactgaaaaggaaggagctgaggaaccattacctcaaagacattgaacgaatgtatgggggcaaataaaatgttgttgtcttattgacagttgtgcaggaggtagcctggtggttttcaacctctagaattttaagcctttgttgaactgttagaatgtaaggtatatcattctaaagatagagtaaaaagaaaacaaaaccaaaagttattaaaattgttgtccggtttactttaacttagttttgcatagttctagtgcagctgaaattgaaaagttatttccctttagctgtgttattatagagcagaaattctgtttttaaaaattagcctaagatatacttgtttttgtaaagaaaaatatttaatgttgaacaaaataaattggagttggagtagaatgtagtttgaggaaatttgcagcttccaatgcctcttgtcttcctatttcagaagtttaaatattaagcatgacagaaaatatgtattaacactactcaaagcaaaagtgctgcagggctttaaaattctcttccaaccatttatcttgaaggaaaaattcaatagtaatataatacacaaaatcaaataataccttagaaggtattaagattataattgttgcataggttagatatagagtcattgtaatgttgtgaataattacagtgcctaaaataagaatagaacaacatatacaacaccaaaaaatatctagtaatatatttaaagggaaattgagctgctttttttgaaactttgagatctaaaaataactgtaattatttgaatgactaagaggaaagtacattttttgaaatgctgaaaattgcctttctgtgtttattcaaactgaaaagctgagaccaagagcaaggaaggtaaaaagttaacaggcaaacattttctcttagaaaaggtgataaaatcataagtatttggaattagaacccttgcacagcactgaacctgggaaagagatttaaactctgaatttatctttgataacagggattgattttaaaatgtacatgtattaaattacatttgtaatttaaggtctgtttgctgttgctgattttattcttgatcagtagtttgcatttcagaaagcctttcattttgctttaattttagcaaagcgggttataatgaatgacttccccaatatcttgcttgaacttacaggtgattaacttggatgagttttgggaagttaaagggaagaaaacactgttatcattttttcctgtttgggaagagcttagaaactggaaatactagatttgggagaagggcagagttacttgataagggactgatgtttgtgcagtaacttgggagtgtggtttctttttgaatctttaattaaaacctgggattatatatccctgataaatattcacacttgaaccatagttactgtaaaatgcaaaaaatcttaatactgttattctttgcactttttcttaatcattttttatatatatgcatatatatatgtgtgtgtgtgtgttgcttatgttgttttgtacagatgtgggccaccattgcaacaaaatacattctttttgctctaaaatatttatgaagaaaatacttaaatgttatgtatatggtggtaataagggaaaaatcaagtattataaacaagaatgaaggtttttgtaaagatttctgttcagcgttttgcaaggtaaaattttaggcaagttttccctgaagttatgtgtatgtgagtattctcattcttcccaacttgcctttgaagagtgaaataccattattatcaagtagactactgttcagcttttattcctgccctgctgtttatcccttaagaatgagtttcttagacttttccaatatgtgattttttttcccatttagaatggtgattttaaatgtgtgagtgcatgtactatcttatctcagatatttgcacccccaatctgcccccaactcccaaaagctagaacactgccaactgatctgttataggtcctttagaaacacataattaacacttaaggttgggtgctgctaattctttgcaaaaatccaaatattgttaagggaccagggagatgccactaccccttgattttccatctaaaaatatacatgtttatgtaaacaaatctttccatatccatagtgacttttcaagtatttaagcctaaagattttgatctcacatttttatacctgtttaaattgctcacagttattacatacacatcagccatcaactaaagttgtactttaaaaatttactacaatatgtacatttctaagtcaaacacttgtgacttttgctttaattccatgaatgttcctgcctccttgatatttgtatttattctttttttctctagagtagaggtataattgtgtgatatttcagaaatacagataaatgattcaaaaagtcacagttaaggagaatcatgtttctttgatcatgaataactgattagtaagtcttgcctatattttcctgatagcatatgacaaatgtttctaaggtaacaagatgagaacagataaagattgtgtggtgttttggatttggagagaaatattttaatttttaaatgcagttacaaattataatgtattcatatttgtactttctgttaaaatgcatgattgcagaattgtttagattttgtgtttattcttgatgaaaagctttgtttgttcttgtttttaagtttgcactcaaatcttaagaaataaatccacccatgttatc

SEQ ID NO: 104418 - DNA, 5225 bp, Homo sapiens
  Payload ID: 506
  Gene Symbol: ACSL4
  Gene Name: acyl-CoA synthetase long-chain family member 4
  Uniprot ID: O60488
  ENST ID: ENST00000469796
  CDS Start-End: 398-2533
ctccgccggctgtccgggtgcgcgcgcgccgctgcggctttttctctggcctccgccgcgcgctcctcctcgtcccagcgctagcgggcacgcggttcctttttgcgagctttccgagtgccaggcgccggccggctgcgaagacgcggtgggccgcccctccgattgaaatcacagaagatattcgtgttcttcttaagagaaaaagaggacatttgcgtactttattgtcggcttccaaagattactaacttttatctgtatcactaagattgaactgccttggctgtactgctattcttactgctgcttctattattgccttcttcagcacaataaggctttcaaaagccaaagaataacaagaaataagcaccattttagaagcctttccactatgaaacttaagctaaatgtgctcaccattattttgctgcctgtccacttgttaataacaatatacagtgcccttatatttattccatggtattttcttaccaatgccaagaagaaaaacgctatggcaaagagaataaaagctaagcccacttcagacaaacctggaagtccatatcgctctgtcacacacttcgactcactagctgtaatagacatccctggagcagatactctggataaattatttgaccatgctgtatccaagtttgggaagaaggacagccttgggaccagggaaatcctaagtgaagaaaatgaaatgcagccaaatggaaaagtttttaagaagttaattcttgggaattataaatggatgaactatcttgaagtgaatcgcagagtgaataactttggtagtggactcactgcactgggactaaaaccaaagaacaccattgccatcttctgtgagaccagggccgaatggatgattgcagcacagacctgctttaagtacaactttcctcttgtgactttatatgccacacttggcaaagaagcagtagttcatgggctaaatgaatctgaggcttcctatctgattaccagtgttgaacttctggaaagtaaacttaagactgcattgttagatatcagttgtgttaaacatatcatttatgtggacaataaggctatcaataaagcagagtaccctgaaggatttgagattcacagcatgcaatcagtagaagagttgggatctaacccagaaaacttgggcattcctccaagtagaccaacgccttcagacatggccattgttatgtatactagtggttctactggccgacctaagggagtgatgatgcatcatagcaatttgatagctggaatgacaggccagtgtgaaagaatacctggactgggaccgaaggacacatatattggctacttgcctttggctcatgtgctagaactgacagcagagatatcttgctttacctatggctgcaggattggatattcttctccgcttacactctctgaccagtccagcaaaattaaaaaaggaagcaaaggagactgtactgtactgaagcccacacttatggctgctgttccggaaatcatggatagaatttataagaatgttatgagcaaagtccaagagatgaattatattcagaaaactctgttcaagatagggtatgattacaaattggaacagatcaaaaagggatatgatgcacctctttgcaatctgttactgtttaaaaaggtcaaggccctgctgggagggaatgtccgcatgatgctgtctggaggggccccgctatctcctcagacacaccgattcatgaatgtctgcttctgctgcccaattggccagggttatggactgacagaatcatgtggtgctgggacagttactgaagtaactgactatactactggcagagttggagcacctcttatttgctgtgaaattaagctaaaagactggcaagaaggcggttatacaattaatgacaagccaaaccccagaggtgaaatcgtaattggtggacagaacatctccatgggatattttaaaaatgaagagaaaacagcagaagattattctgtggatgaaaatggacaaaggtggttttgcactggtgatattggagaattccatcccgatggatgtttacagattatagatcgtaagaaagatctagtgaagttacaagcaggagagtatgtatctcttgggaaagtagaagctgcactgaagaattgtccacttattgacaacatctgtgcttttgccaaaagtgatcagtcctatgtgatcagttttgtggttcctaaccagaaaaggttgacacttttggcacaacagaaaggggtagaaggaacttgggttgatatctgcaataatcctgctatggaagctgaaatactgaaagaaattcgagaagctgcaaatgccatgaaattggagcgatttgaaattccaatcaaggttcgattaagcccagagccatggacccctgaaactggtttggtaactgatgctttcaaactgaaaaggaaggagctgaggaaccattacctcaaagacattgaacgaatgtatgggggcaaataaaatgttgttgtcttattgacagttgtgcaggaggtagcctggtggttttcaacctctagaattttaagcctttgttgaactgttagaatgtaaggtatatcattctaaagatagagtaaaaagaaaacaaaaccaaaagttattaaaattgttgtccggtttactttaacttagttttgcatagttctagtgcagctgaaattgaaaagttatttccctttagctgtgttattatagagcagaaattctgtttttaaaaattagcctaagatatacttgtttttgtaaagaaaaatatttaatgttgaacaaaataaattggagttggagtagaatgtagtttgaggaaatttgcagcttccaatgcctcttgtcttcctatttcagaagtttaaatattaagcatgacagaaaatatgtattaacactactcaaagcaaaagtgctgcagggctttaaaattctcttccaaccatttatcttgaaggaaaaattcaatagtaatataatacacaaaatcaaataataccttagaaggtattaagattataattgttgcataggttagatatagagtcattgtaatgttgtgaataattacagtgcctaaaataagaatagaacaacatatacaacaccaaaaaatatctagtaatatatttaaagggaaattgagctgctttttttgaaactttgagatctaaaaataactgtaattatttgaatgactaagaggaaagtacattttttgaaatgctgaaaattgcctttctgtgtttattcaaactgaaaagctgagaccaagagcaaggaaggtaaaaagttaacaggcaaacattttctcttagaaaaggtgataaaatcataagtatttggaattagaacccttgcacagcactgaacctgggaaagagatttaaactctgaatttatctttgataacagggattgattttaaaatgtacatgtattaaattacatttgtaatttaaggtctgtttgctgttgctgattttattcttgatcagtagtttgcatttcagaaagcctttcattttgctttaattttagcaaagcgggttataatgaatgacttccccaatatcttgcttgaacttacaggtgattaacttggatgagttttgggaagttaaagggaagaaaacactgttatcattttttcctgtttgggaagagcttagaaactggaaatactagatttgggagaagggcagagttacttgataagggactgatgtttgtgcagtaacttgggagtgtggtttctttttgaatctttaattaaaacctgggattatatatccctgataaatattcacacttgaaccatagttactgtaaaatgcaaaaaatcttaatactgttattctttgcactttttcttaatcattttttatatatatgcatatatatatgtgtgtgtgtgtgttgcttatgttgttttgtacagatgtgggccaccattgcaacaaaatacattctttttgctctaaaatatttatgaagaaaatacttaaatgttatgtatatggtggtaataagggaaaaatcaagtattataaacaagaatgaaggtttttgtaaagatttctgttcagcgttttgcaaggtaaaattttaggcaagttttccctgaagttatgtgtatgtgagtattctcattcttcccaacttgcctttgaagagtgaaataccattattatcaagtagactactgttcagcttttattcctgccctgctgtttatcccttaagaatgagtttcttagacttttccaatatgtgattttttttcccatttagaatggtgattttaaatgtgtgagtgcatgtactatcttatctcagatatttgcacccccaatctgcccccaactcccaaaagctagaacactgccaactgatctgttataggtcctttagaaacacataattaacacttaaggttgggtgctgctaattctttgcaaaaatccaaatattgttaagggaccagggagatgccactaccccttgattttccatctaaaaatatacatgtttatgtaaacaaatctttccatatccatagtgacttttcaagtatttaagcctaaagattttgatctcacatttttatacctgtttaaattgctcacagttattacatacacatcagccatcaactaaagttgtactttaaaaatttactacaatatgtacatttctaagtcaaacacttgtgacttttgctttaattccatgaatgttcctgcctccttgatatttgtatttattctttttttctctagagtagaggtataattgtgtgatatttcagaaatacagataaatgattcaaaaagtcacagttaaggagaatcatgtttctttgatcatgaataactgattagtaagtcttgcctatattttcctgatagcatatgacaaatgtttctaaggtaacaagatgagaacagataaagattgtgtggtgttttggatttggagagaaatattttaatttttaaatgcagttacaaattataatgtattcatatttgtactttctgttaaaatgcatgattgcagaattgtttagattttgtgtttattcttgatgaaaagctttgtttgttcttgtttttaagtttgcactcaaatcttaagaaataaatccacccatgttatc

SEQ ID NO: 104419 - DNA, 573 bp, Homo sapiens
  Payload ID: 506
  Gene Symbol: ACSL4
  Gene Name: acyl-CoA synthetase long-chain family member 4
  ENST ID: ENST00000504980
  CDS Start-End: 195-573
acgcggttcctttttgcgagctttccgagtgccaggcgccggccggctgcgaagacgcggtgggccgcccctccgattgaaatcacagaagatattcgtgttcttcttaagagaaaaagaggacatttcacaataaggctttcaaaagccaaagaataacaagaaataagcaccattttagaagcctttccactatgaaacttaagctaaatgtgctcaccattattttgctgcctgtccacttgttaataacaatatacagtgcccttatatttattccatggtattttcttaccaatgccaagaagaaaaacgctatggcaaagagaataaaagctaagcccacttcagacaaacctggaagtccatatcgctctgtcacacacttcgactcactagctgtaatagacatccctggagcagatactctggataaattatttgaccatgctgtatccaagtttgggaagaaggacagccttgggaccagggaaatcctaagtgaagaaaatgaaatgcagccaaatggaaaagtttttaagaagttaattcttgggaattataaatggatga

SEQ ID NO: 104420 - DNA, 506 bp, Homo sapiens
  Payload ID: 506
  Gene Symbol: ACSL4
  Gene Name: acyl-CoA synthetase long-chain family member 4
  ENST ID: ENST00000469857
  CDS Start-End: 345-506
gtcccagcgctagcgggcacgcggttcctttttgcgagctttccgagtgccaggcgccggccggctgcgaagacgcggtgggccgcccctccgattgaaatcacagaagatattcgtgttcttcttaagagaaaaagaggacattttagctttctcagttgaaggcgtactttattgtcggcttccaaagattactaacttttatctgtatcactaagattgaactgccttggctgtactgctattcttactgctgcttctattattgccttcttcagcacaataaggctttcaaaagccaaagaataacaagaaataagcaccattttagaagcctttccactatgaaacttaagctaaatgtgctcaccattattttgctgcctgtccacttgttaataacaatatacagtgcccttatatttattccatggtattttcttaccaatgccaagaagaaaaacgctatggcaaagagaataaaagctaagcccacttcagacaaa

SEQ ID NO: 104421 - DNA, 696 bp, Homo sapiens
  Payload ID: 506
  Gene Symbol: ACSL4
  Gene Name: acyl-CoA synthetase long-chain family member 4
  ENST ID: ENST00000514500
  CDS Start-End: 1-470
aaactctgttcaagatagggtatgattacaaattggaacagatcaaaaagggatatgatgcacctctttgcaatctgttactgtttaaaaaggtcaaggccctgctgggagggaatgtccgcatgatgctgtctggaggggccccgctatctcctcagacacaccgattcatgaatgtctgcttctgctgcccaattggccagggttatggactgacagaatcatgtggtgctgggacagttactgaagtaactgactatactactggcagagttggagcacctcttatttgctgtgaaattaagctaaaagactggcaagaaggcggttatacaattaatgacaagccaaaccccagaggtgaaatcgtaattggtggacagaacatctccatgggatattttaaaaatgaagagaaaacagcagaagattattctgtggatgaaaatggacaaaggaacttgggttgatatctgcaataatcctgctatggaagctgaaatactgaaagaaattcgagaagctgcaaatgccatgaaattggagcgatttgaaattccaatcaaggttcgattaagcccagagccatggacccctgaaactggtttggtaactgatgctttcaaactgaaaaggaaggagctgaggaaccattacctcaaagacattgaacgaatgtatgggggcaaataaaat

SEQ ID NO: 104422 - DNA, 587 bp, Homo sapiens
  Payload ID: 506
  Gene Symbol: ACSL4
  Gene Name: acyl-CoA synthetase long-chain family member 4
  ENST ID: ENST00000505855
  CDS Start-End: 125-587
actctagagcattaaaagtgtcttcaacatggcagctgaggtgctttctttgctgggaaaagctgcaaagagactggcagaatggcgacttcaggagttaatacctctccagaagaaaaacgctatggcaaagagaataaaagctaagcccacttcagacaaacctggaagtccatatcgctctgtcacacacttcgactcactagctgtaatagacatccctggagcagatactctggataaattatttgaccatgctgtatccaagtttgggaagaaggacagccttgggaccagggaaatcctaagtgaagaaaatgaaatgcagccaaatggaaaagtttttaagaagttaattcttgggaattataaatggatgaactatcttgaagtgaatcgcagagtgaataactttggtagtggactcactgcactgggactaaaaccaaagaacaccattgccatcttctgtgagaccagggccgaatggatgattgcagcacagacctgctttaagtacaactttcctcttgtgactttatatgccacacttggcaaagaagcagtagttcatgggctaaatgaat

SEQ ID NO: 104423 - DNA, 637 bp, Homo sapiens
  Payload ID: 506
  Gene Symbol: ACSL4
  Gene Name: acyl-CoA synthetase long-chain family member 4
  ENST ID: ENST00000508092
  CDS Start-End: 254-637
tccgggctcgcgctgagtcccgcctccgccggctgtccgggtgcgcgcgcgccgctgcggctttttctctggcctccgccgcgcgctcctcctcgtcccagcgctagcgggcacgcggttcctttttgcgagctttccgagtgccaggcgccggccggctgcgaagacgcggtgggccgcccctccgcacaataaggctttcaaaagccaaagaataacaagaaataagcaccattttagaagcctttccactatgaaacttaagctaaatgtgctcaccattattttgctgcctgtccacttgttaataacaatatacagtgcccttatatttattccatggtattttcttaccaatgccaagaagaaaaacgctatggcaaagagaataaaagctaagcccacttcagacaaacctggaagtccatatcgctctgtcacacacttcgactcactagctgtaatagacatccctggagcagatactctggataaattatttgaccatgctgtatccaagtttgggaagaaggacagccttgggaccagggaaatcctaagtgaagaaaatgaaatgcagccaaatggaaaagtttttaagaagttaattcttgggaattataaatggatgaactat

SEQ ID NO: 104424 - DNA, 802 bp, Homo sapiens
  Payload ID: 506
  Gene Symbol: ACSL4
  Gene Name: acyl-CoA synthetase long-chain family member 4
  ENST ID: ENST00000502391
  CDS Start-End: 368-802
tccgggctcgcgctgagtcccgcctccgccggctgtccgggtgcgcgcgcgccgctgcggctttttctctggcctccgccgcgcgctcctcctcgtcccagcgctagcgggcacgcggttcctttttgcgagctttccgagtgccaggcgccggccggctgcgaagacgcggtgggccgcccctccggcgtactttattgtcggcttccaaagattactaacttttatctgtatcactaagattgaactgccttggctgtactgctattcttactgctgcttctattattgccttcttcagcacaataaggctttcaaaagccaaagaataacaagaaataagcaccattttagaagcctttccactatgaaacttaagctaaatgtgctcaccattattttgctgcctgtccacttgttaataacaatatacagtgcccttatatttattccatggtattttcttaccaatgccaagaagaaaaacgctatggcaaagagaataaaagctaagcccacttcagacaaacctggaagtccatatcgctctgtcacacacttcgactcactagctgtaatagacatccctggagcagatactctggataaattatttgaccatgctgtatccaagtttgggaagaaggacagccttgggaccagggaaatcctaagtgaagaaaatgaaatgcagccaaatggaaaagtttttaagaagttaattcttgggaattataaatggatgaactatcttgaagtgaatcgcagagtgaataactttggtagtggactcactgcactg

SEQ ID NO: 104425 - DNA, 3353 bp, Homo sapiens
  Payload ID: 507
  Gene Symbol: ACSL5
  Gene Name: acyl-CoA synthetase long-chain family member 5
  Uniprot ID: Q9ULC5
  ENST ID: ENST00000354273
  CDS Start-End: 280-2331
aaaaccaggaagtgaagtccccgagcacgttagaaagcctgacatggcctgactcgggacagctcagagcagggcagaactggggacactctgggccggccttctgcctgcatggacgctctgaagccaccctgtctctggaggaaccacgagcgagggaagaaggacagggactcgtgtggcaggaagaactcagagccgggaagcccccattcactagaagcactgagagatgcggccccctcgcagggtctgaatttcctgctgctgttcacaaagatgctttttatctttaactttttgttttccccacttccgaccccggcgttgatctgcatcctgacatttggagctgccatcttcttgtggctgatcaccagacctcaacccgtcttacctcttcttgacctgaacaatcagtctgtgggaattgagggaggagcacggaagggggtttcccagaagaacaatgacctaacaagttgctgcttctcagatgccaagactatgtatgaggttttccaaagaggactcgctgtgtctgacaatgggccctgcttgggatatagaaaaccaaaccagccctacagatggctatcttacaaacaggtgtctgatagagcagagtacctgggttcctgtctcttgcataaaggttataaatcatcaccagaccagtttgtcggcatctttgctcagaataggccagagtggatcatctccgaattggcttgttacacgtactctatggtagctgtacctctgtatgacaccttgggaccagaagccatcgtacatattgtcaacaaggctgatatcgccatggtgatctgtgacacaccccaaaaggcattggtgctgatagggaatgtagagaaaggcttcaccccgagcctgaaggtgatcatccttatggacccctttgatgatgacctgaagcaaagaggggagaagagtggaattgagatcttatccctatatgatgctgagaacctaggcaaagagcacttcagaaaacctgtgcctcctagcccagaagacctgagcgtcatctgcttcaccagtgggaccacaggtgaccccaaaggagccatgataacccatcaaaatattgtttcaaatgctgctgcctttctcaaatgtgtggagcatgcttatgagcccactcctgatgatgtggccatatcctacctccctctggctcatatgtttgagaggattgtacaggctgttgtgtacagctgtggagccagagttggattcttccaaggggatattcggttgctggctgacgacatgaagactttgaagcccacattgtttcccgcggtgcctcgactccttaacaggatctacgataaggtacaaaatgaggccaagacacccttgaagaagttcttgttgaagctggctgtttccagtaaattcaaagagcttcaaaagggtatcatcaggcatgatagtttctgggacaagctcatctttgcaaagatccaggacagcctgggcggaagggttcgtgtaattgtcactggagctgcccccatgtccacttcagtcatgacattcttccgggcagcaatgggatgtcaggtgtatgaagcttatggtcaaacagaatgcacaggtggctgtacatttacattacctggggactggacatcaggtcacgttggggtgcccctggcttgcaattacgtgaagctggaagatgtggctgacatgaactactttacagtgaataatgaaggagaggtctgcatcaagggtacaaacgtgttcaaaggatacctgaaggaccctgagaagacacaggaagccctggacagtgatggctggcttcacacaggagacattggtcgctggctcccgaatggaactctgaagatcatcgaccgtaaaaagaacattttcaagctggcccaaggagaatacattgcaccagagaagatagaaaatatctacaacaggagtcaaccagtgttacaaatttttgtacacggggagagcttacggtcatccttagtaggagtggtggttcctgacacagatgtacttccctcatttgcagccaagcttggggtgaagggctcctttgaggaactgtgccaaaaccaagttgtaagggaagccattttagaagacttgcagaaaattgggaaagaaagtggccttaaaacttttgaacaggtcaaagccatttttcttcatccagagccattttccattgaaaatgggctcttgacaccaacattgaaagcaaagcgaggagagctttccaaatactttcggacccaaattgacagcctgtatgagcacatccaggattaggataaggtacttaagtacctgccggcccactgtgcactgcttgtgagaaaatggattaaaaactattcttacatttgttttgcctttcctcctatttttttttaacctgttaaactctaaagccatagcttttgttttatattgagacatataatgtgtaaacttagttcccaaataaatcaatcctgtctttcccatcttcgatgttgctaatattaaggcttcagggctacttttatcaacatgcctgtcttcaagatcccagtttatgttctgtgtccttcctcatgatttccaaccttaatactattagtaaccacaagttcaagggtcaaagggaccctctgtgccttcttctttgttttgtgataaacataacttgccaacagtctctatgcttatttacatcttctactgttcaaactaagagatttttaaattctgaaaaactgcttacaattcatgttttctagccactccacaaaccactaaaattttagttttagcctatcactcatgtcaatcatatctatgagacaaatgtctccgatgctcttctgcgtaaattaaattgtgtactgaagggaaaagtttgatcataccaaacatttcctaaactctctagttagatatctgacttgggagtattaaaaattgggtctatgacatattgtccaaaaggaatgctgttcttaaagcattatttacagtaggaactggggagtaaatctgttccctacagtttgctgctgagctggaagctgtgggggaaggagttgacaggtgggcccagtgaacttttccagtaaatgaagcaagcactgaataaaaacctcctgaactgggaacaaagatctacaggcaagcaagatgcccacacaacaggcttattttctgtgaaggaaccaactgatctcccccacccttggattagagttcctgctctaccttacccacagataacacatgttgtttctacttgtaaatgtaaagtctttaaaataaactattacagatactta

SEQ ID NO: 104426 - DNA, 3351 bp, Homo sapiens
  Payload ID: 507
  Gene Symbol: ACSL5
  Gene Name: acyl-CoA synthetase long-chain family member 5
  Uniprot ID: Q9ULC5
  ENST ID: ENST00000354655
  CDS Start-End: 282-2333
cttactgtcagaggttactacaagtgtttgaacaggtaacttctacctttgaacttctgttgtgacagattcaaaggttccaggggagtgtgttggccactctcaggacagtacacagtagcttcgggtgtgtcccagtcagtcctaggagctgtggaaagagtagaagtgcctgaatgtggtgctgaatcaatacagccagctgtgaggggagcacttcctggacccaggaagggagagtcttcttccaaggtctgaatttcctgctgctgttcacaaagatgctttttatctttaactttttgttttccccacttccgaccccggcgttgatctgcatcctgacatttggagctgccatcttcttgtggctgatcaccagacctcaacccgtcttacctcttcttgacctgaacaatcagtctgtgggaattgagggaggagcacggaagggggtttcccagaagaacaatgacctaacaagttgctgcttctcagatgccaagactatgtatgaggttttccaaagaggactcgctgtgtctgacaatgggccctgcttgggatatagaaaaccaaaccagccctacagatggctatcttacaaacaggtgtctgatagagcagagtacctgggttcctgtctcttgcataaaggttataaatcatcaccagaccagtttgtcggcatctttgctcagaataggccagagtggatcatctccgaattggcttgttacacgtactctatggtagctgtacctctgtatgacaccttgggaccagaagccatcgtacatattgtcaacaaggctgatatcgccatggtgatctgtgacacaccccaaaaggcattggtgctgatagggaatgtagagaaaggcttcaccccgagcctgaaggtgatcatccttatggacccctttgatgatgacctgaagcaaagaggggagaagagtggaattgagatcttatccctatatgatgctgagaacctaggcaaagagcacttcagaaaacctgtgcctcctagcccagaagacctgagcgtcatctgcttcaccagtgggaccacaggtgaccccaaaggagccatgataacccatcaaaatattgtttcaaatgctgctgcctttctcaaatgtgtggagcatgcttatgagcccactcctgatgatgtggccatatcctacctccctctggctcatatgtttgagaggattgtacaggctgttgtgtacagctgtggagccagagttggattcttccaaggggatattcggttgctggctgacgacatgaagactttgaagcccacattgtttcccgcggtgcctcgactccttaacaggatctacgataaggtacaaaatgaggccaagacacccttgaagaagttcttgttgaagctggctgtttccagtaaattcaaagagcttcaaaagggtatcatcaggcatgatagtttctgggacaagctcatctttgcaaagatccaggacagcctgggcggaagggttcgtgtaattgtcactggagctgcccccatgtccacttcagtcatgacattcttccgggcagcaatgggatgtcaggtgtatgaagcttatggtcaaacagaatgcacaggtggctgtacatttacattacctggggactggacatcaggtcacgttggggtgcccctggcttgcaattacgtgaagctggaagatgtggctgacatgaactactttacagtgaataatgaaggagaggtctgcatcaagggtacaaacgtgttcaaaggatacctgaaggaccctgagaagacacaggaagccctggacagtgatggctggcttcacacaggagacattggtcgctggctcccgaatggaactctgaagatcatcgaccgtaaaaagaacattttcaagctggcccaaggagaatacattgcaccagagaagatagaaaatatctacaacaggagtcaaccagtgttacaaatttttgtacacggggagagcttacggtcatccttagtaggagtggtggttcctgacacagatgtacttccctcatttgcagccaagcttggggtgaagggctcctttgaggaactgtgccaaaaccaagttgtaagggaagccattttagaagacttgcagaaaattgggaaagaaagtggccttaaaacttttgaacaggtcaaagccatttttcttcatccagagccattttccattgaaaatgggctcttgacaccaacattgaaagcaaagcgaggagagctttccaaatactttcggacccaaattgacagcctgtatgagcacatccaggattaggataaggtacttaagtacctgccggcccactgtgcactgcttgtgagaaaatggattaaaaactattcttacatttgttttgcctttcctcctatttttttttaacctgttaaactctaaagccatagcttttgttttatattgagacatataatgtgtaaacttagttcccaaataaatcaatcctgtctttcccatcttcgatgttgctaatattaaggcttcagggctacttttatcaacatgcctgtcttcaagatcccagtttatgttctgtgtccttcctcatgatttccaaccttaatactattagtaaccacaagttcaagggtcaaagggaccctctgtgccttcttctttgttttgtgataaacataacttgccaacagtctctatgcttatttacatcttctactgttcaaactaagagatttttaaattctgaaaaactgcttacaattcatgttttctagccactccacaaaccactaaaattttagttttagcctatcactcatgtcaatcatatctatgagacaaatgtctccgatgctcttctgcgtaaattaaattgtgtactgaagggaaaagtttgatcataccaaacatttcctaaactctctagttagatatctgacttgggagtattaaaaattgggtctatgacatattgtccaaaaggaatgctgttcttaaagcattatttacagtaggaactggggagtaaatctgttccctacagtttgctgctgagctggaagctgtgggggaaggagttgacaggtgggcccagtgaacttttccagtaaatgaagcaagcactgaataaaaacctcctgaactgggaacaaagatctacaggcaagcaagatgcccacacaacaggcttattttctgtgaaggaaccaactgatctcccccacccttggattagagttcctgctctaccttacccacagataacacatgttgtttctacttgtaaatgtaaagtctttaaaataaactattacagata

SEQ ID NO: 104427 - DNA, 3353 bp, Homo sapiens
  Payload ID: 507
  Gene Symbol: ACSL5
  Gene Name: acyl-CoA synthetase long-chain family member 5
  Uniprot ID: Q9ULC5
  ENST ID: ENST00000356116
  CDS Start-End: 113-2332
taaaaccaggaagtgaagtccccgagcacgttagaaagcctgacatggcctgactcgggacagctcagagcagggcagaactggggacactctgggccggccttctgcctgcatggacgctctgaagccaccctgtctctggaggaaccacgagcgagggaagaaggacagggactcgtgtggcaggaagaactcagagccgggaagcccccattcactagaagcactgagagatgcggccccctcgcagggtctgaatttcctgctgctgttcacaaagatgctttttatctttaactttttgttttccccacttccgaccccggcgttgatctgcatcctgacatttggagctgccatcttcttgtggctgatcaccagacctcaacccgtcttacctcttcttgacctgaacaatcagtctgtgggaattgagggaggagcacggaagggggtttcccagaagaacaatgacctaacaagttgctgcttctcagatgccaagactatgtatgaggttttccaaagaggactcgctgtgtctgacaatgggccctgcttgggatatagaaaaccaaaccagccctacagatggctatcttacaaacaggtgtctgatagagcagagtacctgggttcctgtctcttgcataaaggttataaatcatcaccagaccagtttgtcggcatctttgctcagaataggccagagtggatcatctccgaattggcttgttacacgtactctatggtagctgtacctctgtatgacaccttgggaccagaagccatcgtacatattgtcaacaaggctgatatcgccatggtgatctgtgacacaccccaaaaggcattggtgctgatagggaatgtagagaaaggcttcaccccgagcctgaaggtgatcatccttatggacccctttgatgatgacctgaagcaaagaggggagaagagtggaattgagatcttatccctatatgatgctgagaacctaggcaaagagcacttcagaaaacctgtgcctcctagcccagaagacctgagcgtcatctgcttcaccagtgggaccacaggtgaccccaaaggagccatgataacccatcaaaatattgtttcaaatgctgctgcctttctcaaatgtgtggagcatgcttatgagcccactcctgatgatgtggccatatcctacctccctctggctcatatgtttgagaggattgtacaggctgttgtgtacagctgtggagccagagttggattcttccaaggggatattcggttgctggctgacgacatgaagactttgaagcccacattgtttcccgcggtgcctcgactccttaacaggatctacgataaggtacaaaatgaggccaagacacccttgaagaagttcttgttgaagctggctgtttccagtaaattcaaagagcttcaaaagggtatcatcaggcatgatagtttctgggacaagctcatctttgcaaagatccaggacagcctgggcggaagggttcgtgtaattgtcactggagctgcccccatgtccacttcagtcatgacattcttccgggcagcaatgggatgtcaggtgtatgaagcttatggtcaaacagaatgcacaggtggctgtacatttacattacctggggactggacatcaggtcacgttggggtgcccctggcttgcaattacgtgaagctggaagatgtggctgacatgaactactttacagtgaataatgaaggagaggtctgcatcaagggtacaaacgtgttcaaaggatacctgaaggaccctgagaagacacaggaagccctggacagtgatggctggcttcacacaggagacattggtcgctggctcccgaatggaactctgaagatcatcgaccgtaaaaagaacattttcaagctggcccaaggagaatacattgcaccagagaagatagaaaatatctacaacaggagtcaaccagtgttacaaatttttgtacacggggagagcttacggtcatccttagtaggagtggtggttcctgacacagatgtacttccctcatttgcagccaagcttggggtgaagggctcctttgaggaactgtgccaaaaccaagttgtaagggaagccattttagaagacttgcagaaaattgggaaagaaagtggccttaaaacttttgaacaggtcaaagccatttttcttcatccagagccattttccattgaaaatgggctcttgacaccaacattgaaagcaaagcgaggagagctttccaaatactttcggacccaaattgacagcctgtatgagcacatccaggattaggataaggtacttaagtacctgccggcccactgtgcactgcttgtgagaaaatggattaaaaactattcttacatttgttttgcctttcctcctatttttttttaacctgttaaactctaaagccatagcttttgttttatattgagacatataatgtgtaaacttagttcccaaataaatcaatcctgtctttcccatcttcgatgttgctaatattaaggcttcagggctacttttatcaacatgcctgtcttcaagatcccagtttatgttctgtgtccttcctcatgatttccaaccttaatactattagtaaccacaagttcaagggtcaaagggaccctctgtgccttcttctttgttttgtgataaacataacttgccaacagtctctatgcttatttacatcttctactgttcaaactaagagatttttaaattctgaaaaactgcttacaattcatgttttctagccactccacaaaccactaaaattttagttttagcctatcactcatgtcaatcatatctatgagacaaatgtctccgatgctcttctgcgtaaattaaattgtgtactgaagggaaaagtttgatcataccaaacatttcctaaactctctagttagatatctgacttgggagtattaaaaattgggtctatgacatattgtccaaaaggaatgctgttcttaaagcattatttacagtaggaactggggagtaaatctgttccctacagtttgctgctgagctggaagctgtgggggaaggagttgacaggtgggcccagtgaacttttccagtaaatgaagcaagcactgaataaaaacctcctgaactgggaacaaagatctacaggcaagcaagatgcccacacaacaggcttattttctgtgaaggaaccaactgatctcccccacccttggattagagttcctgctctaccttacccacagataacacatgttgtttctacttgtaaatgtaaagtctttaaaataaactattacagatactt

SEQ ID NO: 104428 - DNA, 3380 bp, Homo sapiens
  Payload ID: 507
  Gene Symbol: ACSL5
  Gene Name: acyl-CoA synthetase long-chain family member 5
  Uniprot ID: Q9ULC5
  ENST ID: ENST00000393081
  CDS Start-End: 308-2359
gccagaggatggaatgccacaggccccacttcgtctcccagcccttcatctttcttccatgtccaaaggcggctccccagaggccaagggctcagctcttgtgttctctgagactgtggcacagctcaccctggcttccttagtaggaagcttttaagaactgctctgtagaaagaacaaaccctaatctagctccagcaaagagccaggatcatgctgaacttcctgtgagccttcgtgggggatcgaggctggagaaagtgctgcttcattctgaggtctgaatttcctgctgctgttcacaaagatgctttttatctttaactttttgttttccccacttccgaccccggcgttgatctgcatcctgacatttggagctgccatcttcttgtggctgatcaccagacctcaacccgtcttacctcttcttgacctgaacaatcagtctgtgggaattgagggaggagcacggaagggggtttcccagaagaacaatgacctaacaagttgctgcttctcagatgccaagactatgtatgaggttttccaaagaggactcgctgtgtctgacaatgggccctgcttgggatatagaaaaccaaaccagccctacagatggctatcttacaaacaggtgtctgatagagcagagtacctgggttcctgtctcttgcataaaggttataaatcatcaccagaccagtttgtcggcatctttgctcagaataggccagagtggatcatctccgaattggcttgttacacgtactctatggtagctgtacctctgtatgacaccttgggaccagaagccatcgtacatattgtcaacaaggctgatatcgccatggtgatctgtgacacaccccaaaaggcattggtgctgatagggaatgtagagaaaggcttcaccccgagcctgaaggtgatcatccttatggacccctttgatgatgacctgaagcaaagaggggagaagagtggaattgagatcttatccctatatgatgctgagaacctaggcaaagagcacttcagaaaacctgtgcctcctagcccagaagacctgagcgtcatctgcttcaccagtgggaccacaggtgaccccaaaggagccatgataacccatcaaaatattgtttcaaatgctgctgcctttctcaaatgtgtggagcatgcttatgagcccactcctgatgatgtggccatatcctacctccctctggctcatatgtttgagaggattgtacaggctgttgtgtacagctgtggagccagagttggattcttccaaggggatattcggttgctggctgacgacatgaagactttgaagcccacattgtttcccgcggtgcctcgactccttaacaggatctacgataaggtacaaaatgaggccaagacacccttgaagaagttcttgttgaagctggctgtttccagtaaattcaaagagcttcaaaagggtatcatcaggcatgatagtttctgggacaagctcatctttgcaaagatccaggacagcctgggcggaagggttcgtgtaattgtcactggagctgcccccatgtccacttcagtcatgacattcttccgggcagcaatgggatgtcaggtgtatgaagcttatggtcaaacagaatgcacaggtggctgtacatttacattacctggggactggacatcaggtcacgttggggtgcccctggcttgcaattacgtgaagctggaagatgtggctgacatgaactactttacagtgaataatgaaggagaggtctgcatcaagggtacaaacgtgttcaaaggatacctgaaggaccctgagaagacacaggaagccctggacagtgatggctggcttcacacaggagacattggtcgctggctcccgaatggaactctgaagatcatcgaccgtaaaaagaacattttcaagctggcccaaggagaatacattgcaccagagaagatagaaaatatctacaacaggagtcaaccagtgttacaaatttttgtacacggggagagcttacggtcatccttagtaggagtggtggttcctgacacagatgtacttccctcatttgcagccaagcttggggtgaagggctcctttgaggaactgtgccaaaaccaagttgtaagggaagccattttagaagacttgcagaaaattgggaaagaaagtggccttaaaacttttgaacaggtcaaagccatttttcttcatccagagccattttccattgaaaatgggctcttgacaccaacattgaaagcaaagcgaggagagctttccaaatactttcggacccaaattgacagcctgtatgagcacatccaggattaggataaggtacttaagtacctgccggcccactgtgcactgcttgtgagaaaatggattaaaaactattcttacatttgttttgcctttcctcctatttttttttaacctgttaaactctaaagccatagcttttgttttatattgagacatataatgtgtaaacttagttcccaaataaatcaatcctgtctttcccatcttcgatgttgctaatattaaggcttcagggctacttttatcaacatgcctgtcttcaagatcccagtttatgttctgtgtccttcctcatgatttccaaccttaatactattagtaaccacaagttcaagggtcaaagggaccctctgtgccttcttctttgttttgtgataaacataacttgccaacagtctctatgcttatttacatcttctactgttcaaactaagagatttttaaattctgaaaaactgcttacaattcatgttttctagccactccacaaaccactaaaattttagttttagcctatcactcatgtcaatcatatctatgagacaaatgtctccgatgctcttctgcgtaaattaaattgtgtactgaagggaaaagtttgatcataccaaacatttcctaaactctctagttagatatctgacttgggagtattaaaaattgggtctatgacatattgtccaaaaggaatgctgttcttaaagcattatttacagtaggaactggggagtaaatctgttccctacagtttgctgctgagctggaagctgtgggggaaggagttgacaggtgggcccagtgaacttttccagtaaatgaagcaagcactgaataaaaacctcctgaactgggaacaaagatctacaggcaagcaagatgcccacacaacaggcttattttctgtgaaggaaccaactgatctcccccacccttggattagagttcctgctctaccttacccacagataacacatgttgtttctacttgtaaatgtaaagtctttaaaataaactattacagatactt

SEQ ID NO: 104429 - DNA, 3281 bp, Homo sapiens
  Payload ID: 507
  Gene Symbol: ACSL5
  Gene Name: acyl-CoA synthetase long-chain family member 5
  Uniprot ID: Q9ULC5
  ENST ID: ENST00000433418
  CDS Start-End: 281-2260
taaaaccaggaagtgaagtccccgagcacgttagaaagcctgacatggcctgactcgggacagctcagagcagggcagaactggggacactctgggccggccttctgcctgcatggacgctctgaagccaccctgtctctggaggaaccacgagcgagggaagaaggacagggactcgtgtggcaggaagaactcagagccgggaagcccccattcactagaagcactgagagatgcggccccctcgcagggtctgaatttcctgctgctgttcacaaagatgctttttatctttaactttttgttttccccacttccgaccccggcgttgatctgcatcctgacatttggagctgccatcttcttgtggctgatcaccagacctcaacccgtcttacctcttcttgacctgaacaatcagtctgtgggaattgagggaggagcacggaagggggtttcccagaagaacaatgacctaacaagttgctgcttctcagatgccaagactatgtatgaggttttccaaagaggactcgctgtgtctgacaatgggccctgcttgggatatagaaaaccaaaccagccctacagatggctatcttacaaacaggtgtctgatagagcagagtacctgggttcctgtctcttgcataaaggttataaatcatcaccagaccagtttgtcggcatctttgctcagaataggccagagtggatcatctccgaattggcttgttacacgtactctatggtagctgtacctctgtatgacaccttgggaccagaagccatcgtacatattgtcaacaaggctgatatcgccatggtgatctgtgacacaccccaaaaggcattggtgctgatagggaatgtagagaaaggcttcaccccgagcctgaaggtgatcatccttatggacccctttgatgatgacctgaagcaaagaggggagaagagtggaattgagatcttatccctatatgatgctgagaacctaggcaaagagcacttcagaaaacctgtgcctcctagcccagaagacctgagcgtcatctgcttcaccagtgggaccacaggtgaccccaaaggagccatgataacccatcaaaatattgtttcaaatgctgctgcctttctcaaatgtgtggagcatgcttatgagcccactcctgatgatgtggccatatcctacctccctctggctcatatgtttgagaggattgtacaggctgttgtgtacagctgtggagccagagttggattcttccaaggggatattcggttgctggctgacgacatgaagactttgaagcccacattgtttcccgcggtgcctcgactccttaacaggatctacgataaggtacaaaatgaggccaagacacccttgaagaagttcttgttgaagctggctgtttccagtaaattcaaagagcttcaaaagggtatcatcaggcatgatagtttctgggacaagctcatctttgcaaagatccaggacagcctgggcggaagggttcgtgtaattgtcactggagctgcccccatgtccacttcagtcatgacattcttccgggcagcaatgggatgtcaggtgtatgaagcttatggtcaaacagaatgcacaggtggctgtacatttacattacctggggactggacatcaggtcacgttggggtgcccctggcttgcaattacgtgaagctggaagatgtggctgacatgaactactttacagtgaataatgaaggagaggtctgcatcaagggtacaaacgtgttcaaaggatacctgaaggaccctgagaagacacaggaagccctggacagtgatggctggcttcacacaggagacattggtcgctggctcccgaatggaactctgaagatcatcgaccgtaaaaagaacattttcaagctggcccaaggagaatacattgcaccagagaagatagaaaatatctacaacaggagtcaaccagtgttacaaatttttgtacacggggagagcttacggtcatccttagtaggagtggtggttcctgacacagatgtacttccctcatttgcagccaagcttggggtgaagggctcctttgaggaactgtgccaaaaccaagtcaaagccatttttcttcatccagagccattttccattgaaaatgggctcttgacaccaacattgaaagcaaagcgaggagagctttccaaatactttcggacccaaattgacagcctgtatgagcacatccaggattaggataaggtacttaagtacctgccggcccactgtgcactgcttgtgagaaaatggattaaaaactattcttacatttgttttgcctttcctcctatttttttttaacctgttaaactctaaagccatagcttttgttttatattgagacatataatgtgtaaacttagttcccaaataaatcaatcctgtctttcccatcttcgatgttgctaatattaaggcttcagggctacttttatcaacatgcctgtcttcaagatcccagtttatgttctgtgtccttcctcatgatttccaaccttaatactattagtaaccacaagttcaagggtcaaagggaccctctgtgccttcttctttgttttgtgataaacataacttgccaacagtctctatgcttatttacatcttctactgttcaaactaagagatttttaaattctgaaaaactgcttacaattcatgttttctagccactccacaaaccactaaaattttagttttagcctatcactcatgtcaatcatatctatgagacaaatgtctccgatgctcttctgcgtaaattaaattgtgtactgaagggaaaagtttgatcataccaaacatttcctaaactctctagttagatatctgacttgggagtattaaaaattgggtctatgacatattgtccaaaaggaatgctgttcttaaagcattatttacagtaggaactggggagtaaatctgttccctacagtttgctgctgagctggaagctgtgggggaaggagttgacaggtgggcccagtgaacttttccagtaaatgaagcaagcactgaataaaaacctcctgaactgggaacaaagatctacaggcaagcaagatgcccacacaacaggcttattttctgtgaaggaaccaactgatctcccccacccttggattagagttcctgctctaccttacccacagataacacatgttgtttctacttgtaaatgtaaagtctttaaaataaactattacagatactt

SEQ ID NO: 104430 - DNA, 2561 bp, Homo sapiens
  Payload ID: 508
  Gene Symbol: ACSL6
  Gene Name: acyl-CoA synthetase long-chain family member 6
  Uniprot ID: Q9UKU0
  ENST ID: ENST00000296869
  CDS Start-End: 61-2229
ggctgcggggctgcgggtcggggaggccgggccgggccgggccgggccccgctgaccgccatgctgaccttcttcctcgtgtcggggggctccctctggctattcgtagagtttgtcctctcacttctggagaagatgcagacacaggagatcctgaggatactgcgactgcctgagctaggtgacttgggacagtttttccgcagcctctcggccaccaccctcgtgagtatgggtgccctggctgccatccttgcctactggttcactcaccggccaaaggccttgcagccgccatgcaacctcctgatgcagtcagaagaagtagaggacagtggcggggcacggcgatctgtgattgggtctggccctcagctacttacccactactatgatgatgcccggaccatgtaccaggtgttccgccgtgggcttagcatctcagggaatgggccctgtcttggtttcaggaagcctaagcagccttaccagtggctgtcctaccaggaggtggccgacagggctgaatttctggggtccggacttctccagcacaattgtaaagcatgcactgatcagtttattggtgtttttgcacaaaatcggccagagtggatcattgtggagctggcctgctacacatattccatggtggtggtcccgctctatgacaccctgggccctggggctatccgctacatcatcaatacagcggacatcagcaccgtgattgtggacaaacctcagaaggctgtgcttctgctagagcatgtggagaggaaggagactccaggcctcaagctgatcatcctcatggacccattcgaagaagccctgaaagagagagggcagaagtgcggggtggtcattaagtccatgcaggccgtggaggactgtggccaagagaatcaccaggctcctgtgcccccgcagcctgatgacctctccattgtgtgtttcacaagcggcacgacagggaacccaaaaggtgcgatgctcacccatgggaacgtggtggctgatttctcaggctttctgaaagtgacagagagtcagtgggctcccacttgtgcggatgtgcacatttcctatttgcctttagcacacatgtttgagcgaatggtgcagtctgtcgtctattgccacggagggcgtgttggcttcttccagggagatatccgccttctctcagatgacatgaaggctctatgccccaccatcttccctgtggtcccacgactgctgaaccggatgtacgacaagatcttcagccaggcaaacacaccattaaagcgctggctcctggagtttgcagcaaagcgtaagcaagccgaggtccggagtggaatcatcaggaatgatagtatctgggatgaactcttctttaataagattcaggccagtcttggtgggtgtgtgcggatgattgttactggagcagccccagcatcaccaacagttctgggatttctccgggcagctctagggtgccaggtttatgaaggttatggccaaactgagtgcacagctggatgtaccttcaccactcctggcgactggacctcagggcacgtaggggcgccacttccctgcaatcatatcaagctcgttgatgttgaggaactgaactactgggcctgcaaaggagagggagagatatgtgtgagaggaccaaatgtgttcaaaggctacttgaaagatccagacaggacgaaggaggccctggacagcgatggctggcttcacactggagacatcggaaaatggctgccggcaggaactcttaaaattattgatcggaaaaagcatatatttaaacttgctcagggagaatatgttgcacccgagaagattgagaacatctacatccggagccaacctgtggcgcaaatctatgtccatggggacagcttaaaggcctttttggtaggcattgttgtgcctgaccctgaagttatgccctcctgggcccagaagagaggaattgaaggaacatatgcagatctctgcacaaataaggatctgaagaaagccattttggaagatatggtgaggttaggaaaagaaagtggactccattcttttgagcaggttaaagccattcacatccattctgacatgttctcagttcaaaatggcttgctgacaccaacactaaaagctaagagacctgagctgagagagtacttcaaaaaacaaatagaagagctttactcaatctccatgtgaagttcaaggaaagttcttctcagtgtaatgaactgtctagcaatattatagttattcttgaaagtaatgagtcaaaatgacacagctgaaaatgaataagcatctgattttatgactgagccttttcctgtcccaagaggtctttaacaatattttctctatcatcaatgagtatattttatttttattataaaaatgatattgtggtggactgctaaaaatatcacaaatggcaatgtaaaaatcaagacattttctcaagaactgtgtaccactaaaagtaatatattgtcaatgttcacagaactattaaacataaaggaaaaacataa

SEQ ID NO: 104431 - DNA, 6298 bp, Homo sapiens
  Payload ID: 508
  Gene Symbol: ACSL6
  Gene Name: acyl-CoA synthetase long-chain family member 6
  Uniprot ID: Q9UKU0
  ENST ID: ENST00000357096
  CDS Start-End: 172-2040
ggtactgacgttggagagcggggccggagagggctggttcgctctgcggccgggcccctcccccgcccgggagcttggcggttccgacaccgcggtcagtgcggggcaagccccagacccggccggccaggctgcagggcagggaagtttgtcctctcacttctggagaagatgcagacacaggagatcctgaggatactgcgactgcctgagctaggtgacttgggacagtttttccgcagcctctcggccaccaccctcgacagtggcggggcacggcgatctgtgattgggtctggccctcagctacttacccactactatgatgatgcccggaccatgtaccaggtgttccgccgtgggcttagcatctcagggaatgggccctgtcttggtttcaggaagcctaagcagccttaccagtggctgtcctaccaggaggtggccgacagggctgaatttctggggtccggacttctccagcacaattgtaaagcatgcactgatcagtttattggtgtttttgcacaaaatcggccagagtggatcattgtggagctggcctgctacacatattccatggtggtggtcccgctctatgacaccctgggccctggggctatccgctacatcatcaatacagcggacatcagcaccgtgattgtggacaaacctcagaaggctgtgcttctgctagagcatgtggagaggaaggagactccaggcctcaagctgatcatcctcatggacccattcgaagaagccctgaaagagagagggcagaagtgcggggtggtcattaagtccatgcaggccgtggaggactgtggccaagagaatcaccaggctcctgtgcccccgcagcctgatgacctctccattgtgtgtttcacaagcggcacgacagggaacccaaaaggtgcgatgctcacccatgggaacgtggtggctgatttctcaggctttctgaaagtgacagagggagatatccgccttctctcagatgacatgaaggctctatgccccaccatcttccctgtggtcccacgactgctgaaccggatgtacgacaagatcttcagccaggcaaacacaccattaaagcgctggctcctggagtttgcagcaaagcgtaagcaagccgaggtccggagtggaatcatcaggaatgatagtatctgggatgaactcttctttaataagattcaggccagtcttggtgggtgtgtgcggatgattgttactggagcagccccagcatcaccaacagttctgggatttctccgggcagctctagggtgccaggtttatgaaggttatggccaaactgagtgcacagctggatgtaccttcaccactcctggcgactggacctcagggcacgtaggggcgccacttccctgcaatcatatcaagctcgttgatgttgaggaactgaactactgggcctgcaaaggagagggagagatatgtgtgagaggaccaaatgtgttcaaaggctacttgaaagatccagacaggacgaaggaggccctggacagcgatggctggcttcacactggagacatcggaaaatggctgccggcaggaactcttaaaattattgatcggaaaaagcatatatttaaacttgctcagggagaatatgttgcacccgagaagattgagaacatctacatccggagccaacctgtggcgcaaatctatgtccatggggacagcttaaaggcctttttggtaggcattgttgtgcctgaccctgaagttatgccctcctgggcccagaagagaggaattgaaggaacatatgcagatctctgcacaaataaggatctgaagaaagccattttggaagatatggtgaggttaggaaaagaaagtggactccattcttttgagcaggttaaagccattcacatccattctgacatgttctcagttcaaaatggcttgctgacaccaacactaaaagctaagagacctgagctgagagagtacttcaaaaaacaaatagaagagctttactcaatctccatgtgaagttcaaggaaagttcttctcagtgtaatgaactgtctagcaatattatagttattcttgaaagtaatgagtcaaaatgacacagctgaaaatgaataagcatctgattttatgactgagccttttcctgtcccaagaggtctttaacaatattttctctatcatcaatgagtatattttatttttattataaaaatgatattgtggtggactgctaaaaatatcacaaatggcaatgtaaaaatcaagacattttctcaagaactgtgtaccactaaaagtaatatattgtcaatgttcacagaactattaaacataaaggaaaaacataagtgatatattctacttaattatttgtgaatcagtaaccagatgcagcaaatatctaggcaatgtggactacctcattcagtaactgattgtcaaaatcacaattaaatcagacttcaaaaattaaagctaggtgtatagaatcatgctaaaagaaaacatgataactcatagtctacgtaacttcagagtctttaaacatgacaatccacattgtcatatgtgaaaattttctctctgatttttactttcattcatgaaaaatgaaaattcagaaattctttttttcctttttgttttgagacagggtctgctctgtcacctaggctggagtgcagtggcttaatcatggctcattgcagtctccatctcctgggctcgagtgatcctcctgtctcacctcccaagtagctgagactacagtacaggcacatgccaccacacctggctaatagaaattttttttttagagattttgctcaggctggtctcaaactcctgagctcaagggatcctcccgccttggcctccctaagtgctaggattacaggcatgagccattgttcccagccaaattcagatattattaaaacacatgtcatatttatatagtaacttacaaagacctttcaatacattttctcatttattaagctcattaaagtattcaggaactacctagaaaaaatataatgtaaaactattcaaggatagtgtgtgtatgttcatggacttcttattataatgaattctaaaagacatctgttgactctacaatgaatggatccttgaggaatacttgggagaagaaactcagagttatttctcagggtaggcagcaattaatgtacctacattccttgctggggtcttctagtcttccattcccaatgtgcccatgctatgcctggaaaccctatatggttgtaattctgaacaatttcactttttttccagtaagaatatcaaggcagaaggtgggaaggaggggacattatttccagggaaaatagtttttcaacaatataactttgataaacctctttaaaatgccccaagaaaactttttaagtccatagacaaagaaatactgcctaatggcataattacattcctaaaatctttaagcgtgccgaagtttaaccactaaaacctcctttcttgcattatgtatttagatgcaccctgtattggggtgtcaacaatttcttataattaaaggccagataccatggacagcaattaagttccaagctatagattgtgcctctgaaaaaggcatggaccccaggaacgtgtttttcttctgtagagacaagactctaaaagcatatcaacaatccatatgcaattcatgtgttaatttaaaatgtatgtgctcagtgtttgtagtctagaagctcctttcccttggaggaatgccaagcagtttgcaaaaataaatgctgttagttaaaaaccacataatcacatgggcctactgaataaatatgcatcagtgattatatacttatatttcagtcttgtcaaaagtgaatcactgtttcatttgatgtatttacccagtctttttatccagtttttcttgggcatattctctctgaagacccactgttgcacttctaaatttgacagttaagaaatgagctagttctatacacactgatttttaaaggcgtttctgaataaactaatacttaaaatgtccaaagtcacatctgtacagcattagatttttatatttaatatatatttgactaattaaaagtgaaagttgttacctgaactggatattcatactattttaagggcaagttgcttacatttcaataacaacaaaaaaagaatctgtttcccattgtcctcctactcaactaaaattcatagttggctttaagcccaaaagaattttgaacaatgtgacagaaacaagtaatgtaaaacttattttgttttatttatactttataatagttagatataacagattatggacaacttaatatttcttctttttggctgggcgcggtggctcatgcctgtaatcccagcactttgggaggccgaggcgggcagatcacgaagtcaggagatcgagaccatcctggctaacacagtgaaaccccgtctctactaaaaaaatacaaaaaattagccgggcgttgtggcgggcgcctgtagtcccagctactcgggaggctgaggcaggagaatggcatgaacctgggaggcggagcttgcagtgagccgagatcccgccactgtactccagcctgggcaacagaacgagactccgtctcaaaaagaaagaaaaaaaaaaaacaaaaacaaggtttcttctttttgccacttaaaatatcttatatttctagatttccaggtctatgtggaaatcatcacacttgggccaataaatgggttagttcagatgtgctgagaaaagtaaatagtgtaccctaaatatcttgcatgtacatttatctatttctctgtttaatgccacttaattttgtaagaaatgagaaatgaaaccctatgtatcagtggaaaaatccttcttgcttcagatttcccaactttattctggaggagaaaaaaatctgtatttctcattaacagagatagaaaaaggtgatgtacttacgatggtcacattcatattgggcattggatctatttaagcctagaagtataacagataatcagttccttaagtgtaaatatgttcttaaatgtttggcctttttatctgttattcaaatgtattagtaattctcatattttgcaaacagatccttttgtgtatattataaaatatataccaaatctgtttttccttttgctgtggaagatgtctttatataatattgagacttcccttgcaaatgagagacgggactctggtcaggtatagtgtgtaggcctagccccatgtattaggaactcataaactcagaaatccaaggattaaacattttatgtctccttcatttatgcaagtcatgctttcattctacatgtagttaaaactacaagtatgagaaaaaatagaactttccattggaattttttccaatcaggtaatgttttagcaacttgaaatcagcacttaatttgattgtattacctatcaaagaaccaataacctttcctttttctgcagtaaagaaaatgaaatatcctttattttccaaatgtatgaagcacaaatgcaatatagttatttaaaatataaaatactttaaaatgaatgtgaagaatgggaaaatatatttttgcatgaaaacagactacttacaaatgtgcttaatatctcaggaaaaaaagaatgaataaccgtatataaaattggtaaactataaattggctgtatttccttgccggttttaattttaaggaagcatttacatgaaaagaaaaaaggatcctagtagtctgaatttcctctcaagtatgctagaaaatactttctatgaatttacaattaactgcaataagaagtgggttagcattcaagtaaggtcaataccccaaatgagaaactcttcagttagaacacattagtggttgtaacacagaggcagtagataaatatttgaaatgtgagcatttctaaacttggtaccaaatggaaagggtttcatgaggtgacagtggcttttaaacattcatttgaccgattattctaattttccttgttaaatcattgcaacagttgcatgggggagaatggatattttttgaagaattgcttattccactttcaatttttaaaaatcgaggggattaaaatattactttttaaatatgcataaaagtatcttaactgtaattacattttcagttgctttgttatagtagcatgcatattaaatataaaatgcatttatgaaaatttttgtaaaaaataaaagatttttcatttctc

SEQ ID NO: 104432 - DNA, 2548 bp, Homo sapiens
  Payload ID: 508
  Gene Symbol: ACSL6
  Gene Name: acyl-CoA synthetase long-chain family member 6
  Uniprot ID: Q9UKU0
  ENST ID: ENST00000379240
  CDS Start-End: 155-2248
tccaggaagcatcattcccagagctgccagagcagtggccctggaaaatatggaagcagctgtcagccatggcccagggcctgagcgtatgattctcaggaaaagtgggcaggacatctgactgtcagagtttgtcctctcacttctggagaagatgcagacacaggagatcctgaggatactgcgactgcctgagctaggtgacttgggacagtttttccgcagcctctcggccaccaccctcgtgagtatgggtgccctggctgccatccttgcctactggttcactcaccggccaaaggccttgcagccgccatgcaacctcctgatgcagtcagaagaagtagaggacagtggcggggcacggcgatctgtgattgggtctggccctcagctacttacccactactatgatgatgcccggaccatgtaccaggtgttccgccgtgggcttagcatctcagggaatgggccctgtcttggtttcaggaagcctaagcagccttaccagtggctgtcctaccaggaggtggccgacagggctgaatttctggggtccggacttctccagcacaattgtaaagcatgcactgatcagtttattggtgtttttgcacaaaatcggccagagtggatcattgtggagctggcctgctacacatattccatggtggtggtcccgctctatgacaccctgggccctggggctatccgctacatcatcaatacagcggacatcagcaccgtgattgtggacaaacctcagaaggctgtgcttctgctagagcatgtggagaggaaggagactccaggcctcaagctgatcatcctcatggacccattcgaagaagccctgaaagagagagggcagaagtgcggggtggtcattaagtccatgcaggccgtggaggactgtggccaagagaatcaccaggctcctgtgcccccgcagcctgatgacctctccattgtgtgtttcacaagcggcacgacagggaacccaaaaggtgcgatgctcacccatgggaacgtggtggctgatttctcaggctttctgaaagtgacagagaaagtgatctttccgagacaggacgatgtgctcatctccttcctgcctctggctcacatgtttgagagagtaatccagtctgtcgtctattgccacggagggcgtgttggcttcttccagggagatatccgccttctctcagatgacatgaaggctctatgccccaccatcttccctgtggtcccacgactgctgaaccggatgtacgacaagatcttcagccaggcaaacacaccattaaagcgctggctcctggagtttgcagcaaagcgtaagcaagccgaggtccggagtggaatcatcaggaatgatagtatctgggatgaactcttctttaataagattcaggccagtcttggtgggtgtgtgcggatgattgttactggagcagccccagcatcaccaacagttctgggatttctccgggcagctctagggtgccaggtttatgaaggttatggccaaactgagtgcacagctggatgtaccttcaccactcctggcgactggacctcagggcacgtaggggcgccacttccctgcaatcatatcaagctcgttgatgttgaggaactgaactactgggcctgcaaaggagagggagagatatgtgtgagaggaccaaatgtgttcaaaggctacttgaaagatccagacaggacgaaggaggccctggacagcgatggctggcttcacactggagacatcggaaaatggctgccggcaggaactcttaaaattattgatcggaaaaagcatatatttaaacttgctcagggagaatatgttgcacccgagaagattgagaacatctacatccggagccaacctgtggcgcaaatctatgtccatggggacagcttaaaggcctttttggtaggcattgttgtgcctgaccctgaagttatgccctcctgggcccagaagagaggaattgaaggaacatatgcagatctctgcacaaataaggatctgaagaaagccattttggaagatatggtgaggttaggaaaagaaagtggactccattcttttgagcaggttaaagccattcacatccattctgacatgttctcagttcaaaatggcttgctgacaccaacactaaaagctaagagacctgagctgagagagtacttcaaaaaacaaatagaagagctttactcaatctccatgtgaagttcaaggaaagttcttctcagtgtaatgaactgtctagcaatattatagttattcttgaaagtaatgagtcaaaatgacacagctgaaaatgaataagcatctgattttatgactgagccttttcctgtcccaagaggtctttaacaatattttctctatcatcaatgagtatattttatttttattataaaaatgatattgtggtggactgctaaaaatatcacaaatggcaatgtaaaaatcaagacattttctcaagaactgtgtaccactaaaagtaatatattgtcaatgttc

SEQ ID NO: 104433 - DNA, 2658 bp, Homo sapiens
  Payload ID: 508
  Gene Symbol: ACSL6
  Gene Name: acyl-CoA synthetase long-chain family member 6
  Uniprot ID: Q9UKU0
  ENST ID: ENST00000379244
  CDS Start-End: 238-2331
ggctctaccaccacccggcttctcagagcaggcggctgttgccatcgactgtccccaggagggcagactcggggcagggccttcgccacttttgtgctttgatcaagatgtggtaacttctttccctgggccccacaggccctataaagggaggctggttctagtgggacgagctcagccgcctcctcagtgccaggagcctgctggaaagagtttgtcctctcacttctggagaagatgcagacacaggagatcctgaggatactgcgactgcctgagctaggtgacttgggacagtttttccgcagcctctcggccaccaccctcgtgagtatgggtgccctggctgccatccttgcctactggttcactcaccggccaaaggccttgcagccgccatgcaacctcctgatgcagtcagaagaagtagaggacagtggcggggcacggcgatctgtgattgggtctggccctcagctacttacccactactatgatgatgcccggaccatgtaccaggtgttccgccgtgggcttagcatctcagggaatgggccctgtcttggtttcaggaagcctaagcagccttaccagtggctgtcctaccaggaggtggccgacagggctgaatttctggggtccggacttctccagcacaattgtaaagcatgcactgatcagtttattggtgtttttgcacaaaatcggccagagtggatcattgtggagctggcctgctacacatattccatggtggtggtcccgctctatgacaccctgggccctggggctatccgctacatcatcaatacagcggacatcagcaccgtgattgtggacaaacctcagaaggctgtgcttctgctagagcatgtggagaggaaggagactccaggcctcaagctgatcatcctcatggacccattcgaagaagccctgaaagagagagggcagaagtgcggggtggtcattaagtccatgcaggccgtggaggactgtggccaagagaatcaccaggctcctgtgcccccgcagcctgatgacctctccattgtgtgtttcacaagcggcacgacagggaacccaaaaggtgcgatgctcacccatgggaacgtggtggctgatttctcaggctttctgaaagtgacagagagtcagtgggctcccacttgtgcggatgtgcacatttcctatttgcctttagcacacatgtttgagcgaatggtgcagtctgtcgtctattgccacggagggcgtgttggcttcttccagggagatatccgccttctctcagatgacatgaaggctctatgccccaccatcttccctgtggtcccacgactgctgaaccggatgtacgacaagatcttcagccaggcaaacacaccattaaagcgctggctcctggagtttgcagcaaagcgtaagcaagccgaggtccggagtggaatcatcaggaatgatagtatctgggatgaactcttctttaataagattcaggccagtcttggtgggtgtgtgcggatgattgttactggagcagccccagcatcaccaacagttctgggatttctccgggcagctctagggtgccaggtttatgaaggttatggccaaactgagtgcacagctggatgtaccttcaccactcctggcgactggacctcagggcacgtaggggcgccacttccctgcaatcatatcaagctcgttgatgttgaggaactgaactactgggcctgcaaaggagagggagagatatgtgtgagaggaccaaatgtgttcaaaggctacttgaaagatccagacaggacgaaggaggccctggacagcgatggctggcttcacactggagacatcggaaaatggctgccggcaggaactcttaaaattattgatcggaaaaagcatatatttaaacttgctcagggagaatatgttgcacccgagaagattgagaacatctacatccggagccaacctgtggcgcaaatctatgtccatggggacagcttaaaggcctttttggtaggcattgttgtgcctgaccctgaagttatgccctcctgggcccagaagagaggaattgaaggaacatatgcagatctctgcacaaataaggatctgaagaaagccattttggaagatatggtgaggttaggaaaagaaagtggactccattcttttgagcaggttaaagccattcacatccattctgacatgttctcagttcaaaatggcttgctgacaccaacactaaaagctaagagacctgagctgagagagtacttcaaaaaacaaatagaagagctttactcaatctccatgtgaagttcaaggaaagttcttctcagtgtaatgaactgtctagcaatattatagttattcttgaaagtaatgagtcaaaatgacacagctgaaaatgaataagcatctgattttatgactgagccttttcctgtcccaagaggtctttaacaatattttctctatcatcaatgagtatattttatttttattataaaaatgatattgtggtggactgctaaaaatatcacaaatggcaatgtaaaaatcaagacattttctcaagaactgtgtaccactaaaagtaatatattgtcaatgttcacagaactattaaacataaaggaaaaa

SEQ ID NO: 104434 - DNA, 2622 bp, Homo sapiens
  Payload ID: 508
  Gene Symbol: ACSL6
  Gene Name: acyl-CoA synthetase long-chain family member 6
  Uniprot ID: Q9UKU0
  ENST ID: ENST00000379246
  CDS Start-End: 167-2293
aaccgcgacccggctgccattcgagcctgcccagccataaaacccaggctgcgagtcgcgcgggggcagggtcgcgtgttgatggggtgggtggcggcggggtgggctcaatgtcacgctctggcgctcgtcgcccgtgctcccccttccagccggtttccgcagaatgccagagtttgtcctctcacttctggagaagatgcagacacaggagatcctgaggatactgcgactgcctgagctaggtgacttgggacagtttttccgcagcctctcggccaccaccctcgtgagtatgggtgccctggctgccatccttgcctactggttcactcaccggccaaaggccttgcagccgccatgcaacctcctgatgcagtcagaagaagtagaggacagtggcggggcacggcgatctgtgattgggtctggccctcagctacttacccactactatgatgatgcccggaccatgtaccaggtgttccgccgtgggcttagcatctcagggaatgggccctgtcttggtttcaggaagcctaagcagccttaccagtggctgtcctaccaggaggtggccgacagggctgaatttctggggtccggacttctccagcacaattgtaaagcatgcactgatcagtttattggtgtttttgcacaaaatcggccagagtggatcattgtggagctggcctgctacacatattccatggtggtggtcccgctctatgacaccctgggccctggggctatccgctacatcatcaatacagcggacatcagcaccgtgattgtggacaaacctcagaaggctgtgcttctgctagagcatgtggagaggaaggagactccaggcctcaagctgatcatcctcatggacccattcgaagaagccctgaaagagagagggcagaagtgcggggtggtcattaagtccatgcaggccgtggaggactgtggccaagagaatcaccaggctcctgtgcccccgcagcctgatgacctctccattgtgtgtttcacaagcggcacgacagggaacccaaaaggtgcgatgctcacccatgggaacgtggtggctgatttctcaggctttctgaaagtgacagagaaagtgatctttccgagacaggacgatgtgctcatctccttcctgcctctggctcacatgtttgagagagtaatccagtctgtcgtctattgccacggagggcgtgttggcttcttccagggagatatccgccttctctcagatgacatgaaggctctatgccccaccatcttccctgtggtcccacgactgctgaaccggatgtacgacaagatcttcagccaggcaaacacaccattaaagcgctggctcctggagtttgcagcaaagcgtaagcaagccgaggtccggagtggaatcatcaggaatgatagtatctgggatgaactcttctttaataagattcaggccagtcttggtgggtgtgtgcggatgattgttactggagcagccccagcatcaccaacagttctgggatttctccgggcagctctagggtgccaggtttatgaaggttatggccaaactgagtgcacagctggatgtaccttcaccactcctggcgactggacctcagggcacgtaggggcgccacttccctgcaatcatatcaagctcgttgatgttgaggaactgaactactgggcctgcaaaggagagggagagatatgtgtgagaggaccaaatgtgttcaaaggctacttgaaagatccagacaggacgaaggaggccctggacagcgatggctggcttcacactggagacatcggaaaatggctgccggcaggaactcttaaaattattgatcggaaaaagcatatatttaaacttgctcagggagaatatgttgcacccgagaagattgagaacatctacatccggagccaacctgtggcgcaaatctatgtccatggggacagcttaaaggcctttttggtaggcattgttgtgcctgaccctgaagttatgccctcctgggcccagaagagaggaattgaaggaacatatgcagatctctgcacaaataaggatctgaagaaagccattttggaagatatggtgaggttaggaaaagaaagtggactccattcttttgagcaggttaaagccattcacatccattctgacatgttctcagttcaaaatggcttgctgacaccaacactaaaagctaagagacctgagctgagagagtacttcaaaaaacaaatagaagagctttactcaatctccatgtgaagttcaaggaaagttcttctcagtgtaatgaactgtctagcaatattatagttattcttgaaagtaatgagtcaaaatgacacagctgaaaatgaataagcatctgattttatgactgagccttttcctgtcccaagaggtctttaacaatattttctctatcatcaatgagtatattttatttttattataaaaatgatattgtggtggactgctaaaaatatcacaaatggcaatgtaaaaatcaagacattttctcaagaactgtgtaccactaaaagtaatatattgtcaatgttcacagaactattaaacataaaggaaaaaca

SEQ ID NO: 104435 - DNA, 2301 bp, Homo sapiens
  Payload ID: 508
  Gene Symbol: ACSL6
  Gene Name: acyl-CoA synthetase long-chain family member 6
  Uniprot ID: Q9UKU0
  ENST ID: ENST00000379255
  CDS Start-End: 97-1965
cggagagggctggttcgctctgcggccgggcccctcccccgcccgggagcttggcggttccgacaccgcgagtttgtcctctcacttctggagaagatgcagacacaggagatcctgaggatactgcgactgcctgagctaggtgacttgggacagtttttccgcagcctctcggccaccaccctcgacagtggcggggcacggcgatctgtgattgggtctggccctcagctacttacccactactatgatgatgcccggaccatgtaccaggtgttccgccgtgggcttagcatctcagggaatgggccctgtcttggtttcaggaagcctaagcagccttaccagtggctgtcctaccaggaggtggccgacagggctgaatttctggggtccggacttctccagcacaattgtaaagcatgcactgatcagtttattggtgtttttgcacaaaatcggccagagtggatcattgtggagctggcctgctacacatattccatggtggtggtcccgctctatgacaccctgggccctggggctatccgctacatcatcaatacagcggacatcagcaccgtgattgtggacaaacctcagaaggctgtgcttctgctagagcatgtggagaggaaggagactccaggcctcaagctgatcatcctcatggacccattcgaagaagccctgaaagagagagggcagaagtgcggggtggtcattaagtccatgcaggccgtggaggactgtggccaagagaatcaccaggctcctgtgcccccgcagcctgatgacctctccattgtgtgtttcacaagcggcacgacagggaacccaaaaggtgcgatgctcacccatgggaacgtggtggctgatttctcaggctttctgaaagtgacagagggagatatccgccttctctcagatgacatgaaggctctatgccccaccatcttccctgtggtcccacgactgctgaaccggatgtacgacaagatcttcagccaggcaaacacaccattaaagcgctggctcctggagtttgcagcaaagcgtaagcaagccgaggtccggagtggaatcatcaggaatgatagtatctgggatgaactcttctttaataagattcaggccagtcttggtgggtgtgtgcggatgattgttactggagcagccccagcatcaccaacagttctgggatttctccgggcagctctagggtgccaggtttatgaaggttatggccaaactgagtgcacagctggatgtaccttcaccactcctggcgactggacctcagggcacgtaggggcgccacttccctgcaatcatatcaagctcgttgatgttgaggaactgaactactgggcctgcaaaggagagggagagatatgtgtgagaggaccaaatgtgttcaaaggctacttgaaagatccagacaggacgaaggaggccctggacagcgatggctggcttcacactggagacatcggaaaatggctgccggcaggaactcttaaaattattgatcggaaaaagcatatatttaaacttgctcagggagaatatgttgcacccgagaagattgagaacatctacatccggagccaacctgtggcgcaaatctatgtccatggggacagcttaaaggcctttttggtaggcattgttgtgcctgaccctgaagttatgccctcctgggcccagaagagaggaattgaaggaacatatgcagatctctgcacaaataaggatctgaagaaagccattttggaagatatggtgaggttaggaaaagaaagtggactccattcttttgagcaggttaaagccattcacatccattctgacatgttctcagttcaaaatggcttgctgacaccaacactaaaagctaagagacctgagctgagagagtacttcaaaaaacaaatagaagagctttactcaatctccatgtgaagttcaaggaaagttcttctcagtgtaatgaactgtctagcaatattatagttattcttgaaagtaatgagtcaaaatgacacagctgaaaatgaataagcatctgattttatgactgagccttttcctgtcccaagaggtctttaacaatattttctctatcatcaatgagtatattttatttttattataaaaatgatattgtggtggactgctaaaaatatcacaaatggcaatgtaaaaatcaagacattttctcaagaactgtgtaccactaaaagtaatatattgtcaatgttcacagaactattaaacataaaggaaaaacataagtga

SEQ ID NO: 104436 - DNA, 6539 bp, Homo sapiens
  Payload ID: 508
  Gene Symbol: ACSL6
  Gene Name: acyl-CoA synthetase long-chain family member 6
  Uniprot ID: Q9UKU0
  ENST ID: ENST00000379264
  CDS Start-End: 110-2278
cggcagcggcggcggcggcgcggctactgctggggctgctgggctgcggggctgcggggctgcgggtcggggaggccgggccgggccgggccgggccccgctgaccgccatgctgaccttcttcctcgtgtcggggggctccctctggctattcgtagagtttgtcctctcacttctggagaagatgcagacacaggagatcctgaggatactgcgactgcctgagctaggtgacttgggacagtttttccgcagcctctcggccaccaccctcgtgagtatgggtgccctggctgccatccttgcctactggttcactcaccggccaaaggccttgcagccgccatgcaacctcctgatgcagtcagaagaagtagaggacagtggcggggcacggcgatctgtgattgggtctggccctcagctacttacccactactatgatgatgcccggaccatgtaccaggtgttccgccgtgggcttagcatctcagggaatgggccctgtcttggtttcaggaagcctaagcagccttaccagtggctgtcctaccaggaggtggccgacagggctgaatttctggggtccggacttctccagcacaattgtaaagcatgcactgatcagtttattggtgtttttgcacaaaatcggccagagtggatcattgtggagctggcctgctacacatattccatggtggtggtcccgctctatgacaccctgggccctggggctatccgctacatcatcaatacagcggacatcagcaccgtgattgtggacaaacctcagaaggctgtgcttctgctagagcatgtggagaggaaggagactccaggcctcaagctgatcatcctcatggacccattcgaagaagccctgaaagagagagggcagaagtgcggggtggtcattaagtccatgcaggccgtggaggactgtggccaagagaatcaccaggctcctgtgcccccgcagcctgatgacctctccattgtgtgtttcacaagcggcacgacagggaacccaaaaggtgcgatgctcacccatgggaacgtggtggctgatttctcaggctttctgaaagtgacagagaaagtgatctttccgagacaggacgatgtgctcatctccttcctgcctctggctcacatgtttgagagagtaatccagtctgtcgtctattgccacggagggcgtgttggcttcttccagggagatatccgccttctctcagatgacatgaaggctctatgccccaccatcttccctgtggtcccacgactgctgaaccggatgtacgacaagatcttcagccaggcaaacacaccattaaagcgctggctcctggagtttgcagcaaagcgtaagcaagccgaggtccggagtggaatcatcaggaatgatagtatctgggatgaactcttctttaataagattcaggccagtcttggtgggtgtgtgcggatgattgttactggagcagccccagcatcaccaacagttctgggatttctccgggcagctctagggtgccaggtttatgaaggttatggccaaactgagtgcacagctggatgtaccttcaccactcctggcgactggacctcagggcacgtaggggcgccacttccctgcaatcatatcaagctcgttgatgttgaggaactgaactactgggcctgcaaaggagagggagagatatgtgtgagaggaccaaatgtgttcaaaggctacttgaaagatccagacaggacgaaggaggccctggacagcgatggctggcttcacactggagacatcggaaaatggctgccggcaggaactcttaaaattattgatcggaaaaagcatatatttaaacttgctcagggagaatatgttgcacccgagaagattgagaacatctacatccggagccaacctgtggcgcaaatctatgtccatggggacagcttaaaggcctttttggtaggcattgttgtgcctgaccctgaagttatgccctcctgggcccagaagagaggaattgaaggaacatatgcagatctctgcacaaataaggatctgaagaaagccattttggaagatatggtgaggttaggaaaagaaagtggactccattcttttgagcaggttaaagccattcacatccattctgacatgttctcagttcaaaatggcttgctgacaccaacactaaaagctaagagacctgagctgagagagtacttcaaaaaacaaatagaagagctttactcaatctccatgtgaagttcaaggaaagttcttctcagtgtaatgaactgtctagcaatattatagttattcttgaaagtaatgagtcaaaatgacacagctgaaaatgaataagcatctgattttatgactgagccttttcctgtcccaagaggtctttaacaatattttctctatcatcaatgagtatattttatttttattataaaaatgatattgtggtggactgctaaaaatatcacaaatggcaatgtaaaaatcaagacattttctcaagaactgtgtaccactaaaagtaatatattgtcaatgttcacagaactattaaacataaaggaaaaacataagtgatatattctacttaattatttgtgaatcagtaaccagatgcagcaaatatctaggcaatgtggactacctcattcagtaactgattgtcaaaatcacaattaaatcagacttcaaaaattaaagctaggtgtatagaatcatgctaaaagaaaacatgataactcatagtctacgtaacttcagagtctttaaacatgacaatccacattgtcatatgtgaaaattttctctctgatttttactttcattcatgaaaaatgaaaattcagaaattctttttttcctttttgttttgagacagggtctgctctgtcacctaggctggagtgcagtggcttaatcatggctcattgcagtctccatctcctgggctcgagtgatcctcctgtctcacctcccaagtagctgagactacagtacaggcacatgccaccacacctggctaatagaaattttttttttagagattttgctcaggctggtctcaaactcctgagctcaagggatcctcccgccttggcctccctaagtgctaggattacaggcatgagccattgttcccagccaaattcagatattattaaaacacatgtcatatttatatagtaacttacaaagacctttcaatacattttctcatttattaagctcattaaagtattcaggaactacctagaaaaaatataatgtaaaactattcaaggatagtgtgtgtatgttcatggacttcttattataatgaattctaaaagacatctgttgactctacaatgaatggatccttgaggaatacttgggagaagaaactcagagttatttctcagggtaggcagcaattaatgtacctacattccttgctggggtcttctagtcttccattcccaatgtgcccatgctatgcctggaaaccctatatggttgtaattctgaacaatttcactttttttccagtaagaatatcaaggcagaaggtgggaaggaggggacattatttccagggaaaatagtttttcaacaatataactttgataaacctctttaaaatgccccaagaaaactttttaagtccatagacaaagaaatactgcctaatggcataattacattcctaaaatctttaagcgtgccgaagtttaaccactaaaacctcctttcttgcattatgtatttagatgcaccctgtattggggtgtcaacaatttcttataattaaaggccagataccatggacagcaattaagttccaagctatagattgtgcctctgaaaaaggcatggaccccaggaacgtgtttttcttctgtagagacaagactctaaaagcatatcaacaatccatatgcaattcatgtgttaatttaaaatgtatgtgctcagtgtttgtagtctagaagctcctttcccttggaggaatgccaagcagtttgcaaaaataaatgctgttagttaaaaaccacataatcacatgggcctactgaataaatatgcatcagtgattatatacttatatttcagtcttgtcaaaagtgaatcactgtttcatttgatgtatttacccagtctttttatccagtttttcttgggcatattctctctgaagacccactgttgcacttctaaatttgacagttaagaaatgagctagttctatacacactgatttttaaaggcgtttctgaataaactaatacttaaaatgtccaaagtcacatctgtacagcattagatttttatatttaatatatatttgactaattaaaagtgaaagttgttacctgaactggatattcatactattttaagggcaagttgcttacatttcaataacaacaaaaaaagaatctgtttcccattgtcctcctactcaactaaaattcatagttggctttaagcccaaaagaattttgaacaatgtgacagaaacaagtaatgtaaaacttattttgttttatttatactttataatagttagatataacagattatggacaacttaatatttcttctttttggctgggcgcggtggctcatgcctgtaatcccagcactttgggaggccgaggcgggcagatcacgaagtcaggagatcgagaccatcctggctaacacagtgaaaccccgtctctactaaaaaaatacaaaaaattagccgggcgttgtggcgggcgcctgtagtcccagctactcgggaggctgaggcaggagaatggcatgaacctgggaggcggagcttgcagtgagccgagatcccgccactgtactccagcctgggcaacagaacgagactccgtctcaaaaagaaagaaaaaaaaaaaacaaaaacaaggtttcttctttttgccacttaaaatatcttatatttctagatttccaggtctatgtggaaatcatcacacttgggccaataaatgggttagttcagatgtgctgagaaaagtaaatagtgtaccctaaatatcttgcatgtacatttatctatttctctgtttaatgccacttaattttgtaagaaatgagaaatgaaaccctatgtatcagtggaaaaatccttcttgcttcagatttcccaactttattctggaggagaaaaaaatctgtatttctcattaacagagatagaaaaaggtgatgtacttacgatggtcacattcatattgggcattggatctatttaagcctagaagtataacagataatcagttccttaagtgtaaatatgttcttaaatgtttggcctttttatctgttattcaaatgtattagtaattctcatattttgcaaacagatccttttgtgtatattataaaatatataccaaatctgtttttccttttgctgtggaagatgtctttatataatattgagacttcccttgcaaatgagagacgggactctggtcaggtatagtgtgtaggcctagccccatgtattaggaactcataaactcagaaatccaaggattaaacattttatgtctccttcatttatgcaagtcatgctttcattctacatgtagttaaaactacaagtatgagaaaaaatagaactttccattggaattttttccaatcaggtaatgttttagcaacttgaaatcagcacttaatttgattgtattacctatcaaagaaccaataacctttcctttttctgcagtaaagaaaatgaaatatcctttattttccaaatgtatgaagcacaaatgcaatatagttatttaaaatataaaatactttaaaatgaatgtgaagaatgggaaaatatatttttgcatgaaaacagactacttacaaatgtgcttaatatctcaggaaaaaaagaatgaataaccgtatataaaattggtaaactataaattggctgtatttccttgccggttttaattttaaggaagcatttacatgaaaagaaaaaaggatcctagtagtctgaatttcctctcaagtatgctagaaaatactttctatgaatttacaattaactgcaataagaagtgggttagcattcaagtaaggtcaataccccaaatgagaaactcttcagttagaacacattagtggttgtaacacagaggcagtagataaatatttgaaatgtgagcatttctaaacttggtaccaaatggaaagggtttcatgaggtgacagtggcttttaaacattcatttgaccgattattctaattttccttgttaaatcattgcaacagttgcatgggggagaatggatattttttgaagaattgcttattccactttcaatttttaaaaatcgaggggattaaaatattactttttaaatatgcataaaagtatcttaactgtaattacattttcagttgctttgttatagtagcatgcatattaaatataaaatgcatttatgaaaatttttgtaaaaaataaaagatttttcatttctcaaa

SEQ ID NO: 104437 - DNA, 934 bp, Homo sapiens
  Payload ID: 508
  Gene Symbol: ACSL6
  Gene Name: acyl-CoA synthetase long-chain family member 6
  ENST ID: ENST00000419502
  CDS Start-End: 477-934
cccctgggcactgtgctgagcacttctgctgcccttccctcttctccacaccccaggagcaaagataagtaaaatgctatgacagctgtcacacaggagaacagagcacccaggccttgaggtccaggaagcatcattcccagagctgccagagcagtggccctggaaaatatggaagcagctgtcagccatggcccagggcctgagcgtatgattctcaggaaaagtgggcaggacatctgactgtcaggtgtgacggcagaaggttctggcctcttcctgggaaaagcccttctaggtagccagcttctggggtgcactctgtacatcccaactccccgagggcctgccctacagtgtttcagaccagatatcaggtcctgtgacccaggacccctccctaacctgcccgtcaggtctcttgccttatctgactcttgttttcaacagagtttgtcctctcacttctggagaagatgcagacacaggagatcctgaggatactgcgactgcctgagctaggtgacttgggacagtttttccgcagcctctcggccaccaccctcgtgagtatgggtgccctggctgccatccttgcctactggttcactcaccggccaaaggccttgcagccgccatgcaacctcctgatgcagtcagaagaagtagaggacagtggcggggcacggcgatctgtgattgggtctggccctcagctacttacccactactatgatgatgcccggaccatgtaccaggtgttccgccgtgggcttagcatctcagggaatgggccctgtcttggtttcaggaagcctaagcagccttaccagtggctgtcctaccaggaggtggccgacagggctgaatttctggggtccggacttctccagcacaattgtaaagcatgcactgatcagtttattggtgtttt

SEQ ID NO: 104438 - DNA, 414 bp, Homo sapiens
  Payload ID: 508
  Gene Symbol: ACSL6
  Gene Name: acyl-CoA synthetase long-chain family member 6
  ENST ID: ENST00000441995
  CDS Start-End: 116-414
ggaggctccccatgtctgcaaactcgggtcctagggggcgttggtgtcagcgggcaacagcccacaggagtgtgcacctcctaggacagagtttgtcctctcacttctggagaagatgcagacacaggagatcctgaggatactgcgactgcctgagctaggtgacttgggacagtttttccgcagcctctcggccaccaccctcgacagtggcggggcacggcgatctgtgattgggtctggccctcagctacttacccactactatgatgatgcccggaccatgtaccaggtgttccgccgtgggcttagcatctcagggaatgggccctgtcttggtttcaggaagcctaagcagccttaccagtggctgtcctaccaggaggtggccgacagggctgaatttctggggtc

SEQ ID NO: 104439 - DNA, 519 bp, Homo sapiens
  Payload ID: 508
  Gene Symbol: ACSL6
  Gene Name: acyl-CoA synthetase long-chain family member 6
  ENST ID: ENST00000414078
  CDS Start-End: 116-519
ggaggctccccatgtctgcaaactcgggtcctagggggcgttggtgtcagcgggcaacagcccacaggagtgtgcacctcctaggacagagtttgtcctctcacttctggagaagatgcagacacaggagatcctgaggatactgcgactgcctgagctaggtgacttgggacagtttttccgcagcctctcggccaccaccctcgtgagtatgggtgccctggctgccatccttgcctactggttcactcaccggccaaaggccttgcagccgccatgcaacctcctgatgcagtcagaagaagtagaggacagtggcggggcacggcgatctgtgattgggtctggccctcagctacttacccactactatgatgatgcccggaccatgtaccaggtgttccgccgtgggcttagcatctcagggaatgggccctgtcttggtttcaggaagcctaagcagccttaccagtggctgtcctaccaggaggtggccgacagggctgaatttctggggtc

SEQ ID NO: 104440 - DNA, 1123 bp, Homo sapiens
  Payload ID: 508
  Gene Symbol: ACSL6
  Gene Name: acyl-CoA synthetase long-chain family member 6
  ENST ID: ENST00000434099
  CDS Start-End: 29-1123
agagtttgtcctctcacttctggagaagatgcagacacaggagatcctgaggatactgcgactgcctgagctaggtgacttgggacagtttttccgcagcctctcggccaccaccctcgacagtggcggggcacggcgatctgtgattgggtctggccctcagctacttacccactactatgatgatgcccggaccatgtaccaggtgttccgccgtgggcttagcatctcagggaatgggccctgtcttggtttcaggaagcctaagcagccttaccagtggctgtcctaccaggaggtggccgacagggctgaatttctggggtccggacttctccagcacaattgtaaagcatgcactgatcagtttattggtgtttttgcacaaaatcggccagagtggatcattgtggagctggcctgctacacatattccatggtggtggtcccgctctatgacaccctgggccctggggctatccgctacatcatcaatacagcggacatcagcaccgtgattgtggacaaacctcagaaggctgtgcttctgctagagcatgtggagaggaaggagactccaggcctcaagctgatcatcctcatggacccattcgaagaagccctgaaagagagagggcagaagtgcggggtggtcattaagtccatgcaggccgtggaggactgtggccaagagaatcaccaggctcctgtgcccccgcagcctgatgacctctccattgtgtgtttcacaagcggcacgacagggaacccaaaaggtgcgatgctcacccatgggaacgtggtggctgatttctcaggctttctgaaagtgacagagagtcagtgggctcccacttgtgcggatgtgcacatttcctatttgcctttagcacacatgtttgagcgaatggtgcagtctgtcgtctattgccacggagggcgtgttggcttcttccagggagatatccgccttctctcagatgacatgaaggctctatgccccaccatcttccctgtggtcccacgactgctgaaccggatgtacgacaagatcttcagccaggcaaacacaccattaaagcgctggctcctggagtttgcagcaaagcgtaagcaagccgag

SEQ ID NO: 104441 - DNA, 530 bp, Homo sapiens
  Payload ID: 508
  Gene Symbol: ACSL6
  Gene Name: acyl-CoA synthetase long-chain family member 6
  ENST ID: ENST00000416557
  CDS Start-End: 97-530
attgtttgtgcctggcttcctggtgctagcatcaggaatgtggacccacattccctgagcagggcttaggagtttgtcctctcacttctggagaagatgcagacacaggagatcctgaggatactgcgactgcctgagctaggtgacttgggacagtttttccgcagcctctcggccaccaccctcgtgagtatgggtgccctggctgccatccttgcctactggttcactcaccggccaaaggccttgcagccgccatgcaacctcctgatgcagtcagaagaagtagaggacagtggcggggcacggcgatctgtgattgggtctggccctcagctacttacccactactatgatgatgcccggaccatgtaccaggtgttccgccgtgggcttagcatctcagggaatgggccctgtcttggtttcaggaagcctaagcagccttaccagtggctgtcctaccaggaggtggccgacagggctgaatttctggggtccggacttctccagcacaattgtaaagcatg

SEQ ID NO: 104442 - DNA, 799 bp, Homo sapiens
  Payload ID: 508
  Gene Symbol: ACSL6
  Gene Name: acyl-CoA synthetase long-chain family member 6
  ENST ID: ENST00000430403
  CDS Start-End: 161-799
tggagagcggggccggagagggctggttcgctctgcggccgggcccctcccccgcccgggagcttggcggttccgacaccgcggtcagtgcggggcaagccccagacccggccggccaggctgcagggcagggaagtttgtcctctcacttctggagaagatgcagacacaggagatcctgaggatactgcgactgcctgagctaggtgacttgggacagtttttccgcagcctctcggccaccaccctcgtgagtatgggtgccctggctgccatccttgcctactggttcactcaccggccaaaggccttgcagccgccatgcaacctcctgatgcagtcagaagaagtagaggacagtggcggggcacggcgatctgtgattgggtctggccctcagctacttacccactactatgatgatgcccggaccatgtaccaggtgttccgccgtgggcttagcatctcagggaatgggccctgtcttggtttcaggaagcctaagcagccttaccagtggctgtcctaccaggaggtggccgacagggctgaatttctggggtccggacttctccagcacaattgtaaagcatgcactgatcagtttattggtgtttttgcacaaaatcggccagagtggatcattgtggagctggcctgctacacatattccatggtggtggtcccgctctatgacaccctgggccctggggctatccgctacatcatcaatacagcggacatcagcaccgtgattgtggacaaacctcagaaggctgtgcttctgctagagcatgtg

SEQ ID NO: 104443 - DNA, 2060 bp, Homo sapiens
  Payload ID: 508
  Gene Symbol: ACSL6
  Gene Name: acyl-CoA synthetase long-chain family member 6
  ENST ID: ENST00000431707
  CDS Start-End: 27-2060
agtttgtcctctcacttctggagaagatgcagacacaggagatcctgaggatactgcgactgcctgagctaggtgacttgggacagtttttccgcagcctctcggccaccaccctcgacagtggcggggcacggcgatctgtgattgggtctggccctcagctacttacccactactatgatgatgcccggaccatgtaccaggtgttccgccgtgggcttagcatctcagggaatgggccctgtcttggtttcaggaagcctaagcagccttaccagtggctgtcctaccaggaggtggccgacagggctgaatttctggggtccggacttctccagcacaattgtaaagcatgcactgatcagtttattggtgtttttgcacaaaatcggccagagtggatcattgtggagctggcctgctacacatattccatggtggtggtcccgctctatgacaccctgggccctggggctatccgctacatcatcaatacagggctcagctgccaagaaggagcctctgcaacagcctccacacaggcggacatcagcaccgtgattgtggacaaacctcagaaggctgtgcttctgctagagcatgtggagaggaaggagactccaggcctcaagctgatcatcctcatggacccattcgaagaagccctgaaagagagagggcagaagtgcggggtggtcattaagtccatgcaggccgtggaggactgtggccaagagaatcaccaggctcctgtgcccccgcagcctgatgacctctccattgtgtgtttcacaagcggcacgacagggaacccaaaaggtgcgatgctcacccatgggaacgtggtggctgatttctcaggctttctgaaagtgacagagaaagtgatctttccgagacaggacgatgtgctcatctccttcctgcctctggctcacatgtttgagagagtaatccagtctgtcgtctattgccacggagggcgtgttggcttcttccagggagatatccgccttctctcagatgacatgaaggctctatgccccaccatcttccctgtggtcccacgactgctgaaccggatgtacgacaagatcttcagccaggcaaacacaccattaaagcgctggctcctggagtttgcagcaaagcgtaagcaagccgaggtccggagtggaatcatcaggaatgatagtatctgggatgaactcttctttaataagattcaggccagtcttggtgggtgtgtgcggatgattgttactggagcagccccagcatcaccaacagttctgggatttctccgggcagctctagggtgccaggtttatgaaggttatggccaaactgagtgcacagctggatgtaccttcaccactcctggcgactggacctcagggcacgtaggggcgccacttccctgcaatcatatcaagctcgttgatgttgaggaactgaactactgggcctgcaaaggagagggagagatatgtgtgagaggaccaaatgtgttcaaaggctacttgaaagatccagacaggacgaaggaggccctggacagcgatggctggcttcacactggagacatcggaaaatggctgccggcaggaactcttaaaattattgatcggaaaaagcatatatttaaacttgctcagggagaatatgttgcacccgagaagattgagaacatctacatccggagccaacctgtggcgcaaatctatgtccatggggacagcttaaaggcctttttggtaggcattgttgtgcctgaccctgaagttatgccctcctgggcccagaagagaggaattgaaggaacatatgcagatctctgcacaaataaggatctgaagaaagccattttggaagatatggtgaggttaggaaaagaaagtggactccattcttttgagcaggttaaagccattcacatccattctgacatgttctcagttcaaaatggcttgctgacaccaacactaaaagctaagagacctgagctgagagagtacttcaaaaaacaaatagaagagctttactcaatctccatgtga

SEQ ID NO: 104444 - DNA, 2139 bp, Homo sapiens
  Payload ID: 508
  Gene Symbol: ACSL6
  Gene Name: acyl-CoA synthetase long-chain family member 6
  Uniprot ID: Q9UKU0
  ENST ID: ENST00000543479
  CDS Start-End: 1-2139
atgcagacacaggagatcctgaggatactgcgactgcctgagctaggtgacttgggacagtttttccgcagcctctcggccaccaccctcgtgagtatgggtgccctggctgccatccttgcctactggttcactcaccggccaaaggccttgcagccgccatgcaacctcctgatgcagtcagaagaagtagaggacagtggcggggcacggcgatctgtgattgggtctggccctcagctacttacccactactatgatgatgcccggaccatgtaccaggtgttccgccgtgggcttagcatctcagggaatgggccctgtcttggtttcaggaagcctaagcagccttaccagtggctgtcctaccaggaggtggccgacagggctgaatttctggggtccggacttctccagcacaattgtaaagcatgcactgatcagtttattggtgtttttgcacaaaatcggccagagtggatcattgtggagctggcctgctacacatattccatggtggtggtcccgctctatgacaccctgggccctggggctatccgctacatcatcaatacagggctcagctgccaagaaggagcctctgcaacagcctccacacaggcggacatcagcaccgtgattgtggacaaacctcagaaggctgtgcttctgctagagcatgtggagaggaaggagactccaggcctcaagctgatcatcctcatggacccattcgaagaagccctgaaagagagagggcagaagtgcggggtggtcattaagtccatgcaggccgtggaggactgtggccaagagaatcaccaggctcctgtgcccccgcagcctgatgacctctccattgtgtgtttcacaagcggcacgacagggaacccaaaaggtgcgatgctcacccatgggaacgtggtggctgatttctcaggctttctgaaagtgacagagaaagtgatctttccgagacaggacgatgtgctcatctccttcctgcctctggctcacatgtttgagagagtaatccagtctgtcgtctattgccacggagggcgtgttggcttcttccagggagatatccgccttctctcagatgacatgaaggctctatgccccaccatcttccctgtggtcccacgactgctgaaccggatgtacgacaagatcttcagccaggcaaacacaccattaaagcgctggctcctggagtttgcagcaaagcgtaagcaagccgaggtccggagtggaatcatcaggaatgatagtatctgggatgaactcttctttaataagattcaggccagtcttggtgggtgtgtgcggatgattgttactggagcagccccagcatcaccaacagttctgggatttctccgggcagctctagggtgccaggtttatgaaggttatggccaaactgagtgcacagctggatgtaccttcaccactcctggcgactggacctcagggcacgtaggggcgccacttccctgcaatcatatcaagctcgttgatgttgaggaactgaactactgggcctgcaaaggagagggagagatatgtgtgagaggaccaaatgtgttcaaaggctacttgaaagatccagacaggacgaaggaggccctggacagcgatggctggcttcacactggagacatcggaaaatggctgccggcaggaactcttaaaattattgatcggaaaaagcatatatttaaacttgctcagggagaatatgttgcacccgagaagattgagaacatctacatccggagccaacctgtggcgcaaatctatgtccatggggacagcttaaaggcctttttggtaggcattgttgtgcctgaccctgaagttatgccctcctgggcccagaagagaggaattgaaggaacatatgcagatctctgcacaaataaggatctgaagaaagccattttggaagatatggtgaggttaggaaaagaaagtggactccattcttttgagcaggttaaagccattcacatccattctgacatgttctcagttcaaaatggcttgctgacaccaacactaaaagctaagagacctgagctgagagagtacttcaaaaaacaaatagaagagctttactcaatctccatgtga

SEQ ID NO: 104445 - DNA, 2051 bp, Homo sapiens
  Payload ID: 509
  Gene Symbol: ACSM1
  Gene Name: acyl-CoA synthetase medium-chain family member 1
  Uniprot ID: Q08AH1
  ENST ID: ENST00000307493
  CDS Start-End: 69-1802
agccatctcttcccaaggcaggtggtgacttgagaactctgtgcctggtttctgaggactgtttcaccatgcagtggctaatgaggttccggaccctctggggcatccacaaatccttccacaacatccaccctgccccttcacagctgcgctgccggtctttatcagaatttggagccccaagatggaatgactatgaagtaccggaggaatttaactttgcaagttatgtactggactactgggctcaaaaggagaaggagggcaagagaggtccaaatccagctttttggtgggtgaatggccaaggggatgaagtaaagtggagcttcagagagatgggagacctaacccgccgtgtagccaacgtcttcacacagacctgtggcctacaacagggagaccatctggccttgatgctgcctcgagttcctgagtggtggctggtggctgtgggctgcatgcgaacagggatcatcttcattcctgcgaccatcctgttgaaggccaaagacattctctatcgactacagttgtctaaagccaagggcattgtgaccatagatgcccttgcctcagaggtggactccatagcttctcagtgcccctctctgaaaaccaagctcctggtgtctgatcacagccgtgaagggtggctggacttccgatcgctggttaaatcagcatccccagaacacacctgtgttaagtcaaagaccttggacccaatggtcatcttcttcaccagtgggaccacaggcttccccaagatggcaaaacactcccatgggttggccttacaaccctccttcccaggaagtaggaaattacggagcctgaagacatctgatgtctcctggtgcctgtcggactcaggatggattgtggctaccatttggaccctggtagaaccatggacagcgggttgtacagtctttatccaccatctgccacagtttgacaccaaggtcatcatacagacattgttgaaataccccattaaccacttttggggggtatcatctatatatcgaatgattctgcagcaggatttcaccagcatcaggttccctgccctggagcactgctatactggcggggaggtcgtgttgcccaaggatcaggaggagtggaaaagacggacgggccttctgctctacgagaactatgggcagtcggaaacgggactaatttgtgccacctactggggaatgaagatcaagccgggtttcatggggaaggccactccaccctacgacgtccaggtcattgatgacaagggcagcatcctgccacctaacacagaaggaaacattggcatcagaatcaaacctgtcaggcctgtgagcctcttcatgtgctatgagggtgacccagagaagacagctaaagtggaatgtggggacttctacaacactggggacagaggtaagatggatgaagagggctacatttgtttcctggggaggagtgatgacatcattaatgcctctgggtatcgcatcgggcctgcagaggttgaaagcgctttggtggagcacccagcggtggcggagtcagccgtggtgggcagcccagacccgattcgaggggaggtggtgaaggcctttattgtcctgaccccacagttcctgtcccatgacaaggatcagctgaccaaggaactgcagcagcatgtcaagtcagtgacagccccatacaagtacccaaggaaggtggagtttgtctcagagctgccaaaaaccatcactggcaagattgaacggaaggaacttcggaaaaaggagactggtcagatgtaatcggcagtgaactcagaacgcactgcacacctaaggcaaatccctggccactttagtctccccactatggtgaggacgagggtggggcattgagagtgttgatttgggaaagtatcaggagtgccatgattccaatgttttccttcttttaaattaaattcagttgctctgcttcctccaagtcctctgtatctttagaatttcccaggtgagcactcataacgcaagtaataaaatactgatatcaac

SEQ ID NO: 104446 - DNA, 1894 bp, Homo sapiens
  Payload ID: 509
  Gene Symbol: ACSM1
  Gene Name: acyl-CoA synthetase medium-chain family member 1
  Uniprot ID: Q08AH1
  ENST ID: ENST00000520010
  CDS Start-End: 161-1894
aatcctgcggatcacctgatcagagagaactgaacctacaaaagagagctcaacctccttttccatacctaccagggacctagttcagctacgtcctaaacagtaccaggcaggtggtgacttgagaactctgtgcctggtttctgaggactgtttcaccatgcagtggctaatgaggttccggaccctctggggcatccacaaatccttccacaacatccaccctgccccttcacagctgcgctgccggtctttatcagaatttggagccccaagatggaatgactatgaagtaccggaggaatttaactttgcaagttatgtactggactactgggctcaaaaggagaaggagggcaagagaggtccaaatccagctttttggtgggtgaatggccaaggggatgaagtaaagtggagcttcagagagatgggagacctaacccgccgtgtagccaacgtcttcacacagacctgtggcctacaacagggagaccatctggccttgatgctgcctcgagttcctgagtggtggctggtggctgtgggctgcatgcgaacagggatcatcttcattcctgcgaccatcctgttgaaggccaaagacattctctatcgactacagttgtctaaagccaagggcattgtgaccatagatgcccttgcctcagaggtggactccatagcttctcagtgcccctctctgaaaaccaagctcctggtgtctgatcacagccgtgaagggtggctggacttccgatcgctggttaaatcagcatccccagaacacacctgtgttaagtcaaagaccttggacccaatggtcatcttcttcaccagtgggaccacaggcttccccaagatggcaaaacactcccatgggttggccttacaaccctccttcccaggaagtaggaaattacggagcctgaagacatctgatgtctcctggtgcctgtcggactcaggatggattgtggctaccatttggaccctggtagaaccatggacagcgggttgtacagtctttatccaccatctgccacagtttgacaccaaggtcatcatacagacattgttgaaataccccattaaccacttttggggggtatcatctatatatcgaatgattctgcagcaggatttcaccagcatcaggttccctgccctggagcactgctatactggcggggaggtcgtgttgcccaaggatcaggaggagtggaaaagacggacgggccttctgctctacgagaactatgggcagtcggaaacgggactaatttgtgccacctactggggaatgaagatcaagccgggtttcatggggaaggccactccaccctacgacgtccaggtcattgatgacaagggcagcatcctgccacctaacacagaaggaaacattggcatcagaatcaaacctgtcaggcctgtgagcctcttcatgtgctatgagggtgacccagagaagacagctaaagtggaatgtggggacttctacaacactggggacagaggtaagatggatgaagagggctacatttgtttcctggggaggagtgatgacatcattaatgcctctgggtatcgcatcgggcctgcagaggttgaaagcgctttggtggagcacccagcggtggcggagtcagccgtggtgggcagcccagacccgattcgaggggaggtggtgaaggcctttattgtcctgaccccacagttcctgtcccatgacaaggatcagctgaccaaggaactgcagcagcatgtcaagtcagtgacagccccatacaagtacccaaggaaggtggagtttgtctcagagctgccaaaaaccatcactggcaagattgaacggaaggaacttcggaaaaaggagactggtcagatgtaa

SEQ ID NO: 104447 - DNA, 809 bp, Homo sapiens
  Payload ID: 509
  Gene Symbol: ACSM1
  Gene Name: acyl-CoA synthetase medium-chain family member 1
  ENST ID: ENST00000524149
  CDS Start-End: 1-749
cacagtttgacaccaaggtcatcatacagacattgttgaaataccccattaaccacttttggggggtatcatctatatatcgaatgattctgcagcaggatttcaccagcatcaggttccctgccctggagcactgctatactggcggggaggtcgtgttgcccaaggatcaggaggagtggaaaagacggacgggccttctgctctacgagaactatgggcagtcggaaacgggactaatttgtgccacctactggggaatgaagatcaagccgggtttcatggggaaggccactccaccctacgacgtccagggtgacccagagaagacagctaaagtggaatgtggggacttctacaacactggggacagaggtaagatggatgaagagggctacatttgtttcctggggaggagtgatgacatcattaatgcctctgggtatcgcatcgggcctgcagaggttgaaagcgctttggtggagcacccagcggtggcggagtcagccgtggtgggcagcccagacccgattcgaggggaggtggtgaaggcctttattgtcctgaccccacagttcctgtcccatgacaaggatcagctgaccaaggaactgcagcagcatgtcaagtcagtgacagccccatacaagtacccaaggaaggtggagtttgtctcagagctgccaaaaaccatcactggcaagattgaacggaaggaacttcggaaaaaggagactggtcagatgtaatcggcagtgaactcagaacgcactgcacacctaaggcaaatccctggccactttagtctc

SEQ ID NO: 104448 - DNA, 1568 bp, Homo sapiens
  Payload ID: 509
  Gene Symbol: ACSM1
  Gene Name: acyl-CoA synthetase medium-chain family member 1
  Uniprot ID: Q08AH1
  ENST ID: ENST00000519745
  CDS Start-End: 69-683
agccatctcttcccaaggcaggtggtgacttgagaactctgtgcctggtttctgaggactgtttcaccatgcagtggctaatgaggttccggaccctctggggcatccacaaatccttccacaacatccaccctgccccttcacagctgcgctgccggtctttatcagaatttggagccccaagatggaatgactatgaagtaccggaggaatttaactttgcaagttatgtactggactactgggctcaaaaggagaaggagggcaagagaggtccaaatccagctttttggtgggtgaatggccaaggggatgaagtaaagtggagcttcagagagatgggagacctaacccgccgtgtagccaacgtcttcacacagacctgtggcctacaacagggagaccatctggccttgatgctgcctcgagttcctgagtggtggctggtggctgtgggctgcatgcgaacagggatcatcttcattcctgcgaccatcctgttgaaggccaaagacattctctatcgactacagttgtctaaagccaagggcattgtgaccatagatgcccttgcctcagaggtggactccatagcttctcagtgcccctctctgaaaaccaagctcctggtgtctgatcacagccgtgaagggtggctggacttccgatcgctggttaagtagaagaatgccattcactcccaagtggtgagagacaagcagccagtggtaggaagatcagcatccccagaacacacctgtgttaagtcaaagaccttggacccaatggtcatcttcttcaccagtgggaccacaggcttccccaagatggcaaaacactcccatgggttggccttacaaccctccttcccaggaagttagtaggaaattacggagcctgaagacatctgatgtctcctggtgcctgtcggactcaggatggattgtggctaccatttggaccctggtagaaccatggacagcgggttgtacagtctttatccaccatctgccacagtttgacaccaaggtcatcatacagacattgttgaaataccccattaaccacttttggggggtatcatctatatatcgaatgattctgcagcaggatttcaccagggactaatttgtgccacctactggggaatgaagatcaagccgggtttcatggggaaggccactccaccctacgacgtccagggtgacccagagaagacagctaaagtggaatgtggggacttctacaacactggggacagaggtggtgaaggcctttattgtcctgaccccacagttcctgtcccatgacaaggatcagctgaccaaggaactgcagcagcatgtcaagtcagtgacagccccatacaagtacccaaggaaggtggagtttgtctcagagctgccaaaaaccatcactggcaagattgaacggaaggaacttcggaaaaaggagactggtcagatgtaatcggcagtgaactcagaacgcactgcacacctaaggcaaatccctggccactttagtctccccactatggtgaggacgagggtggggcattgagagtg

SEQ ID NO: 104449 - DNA, 701 bp, Homo sapiens
  Payload ID: 509
  Gene Symbol: ACSM1
  Gene Name: acyl-CoA synthetase medium-chain family member 1
  ENST ID: ENST00000523065
  CDS Start-End: 240-701
taacaaacaaatgaagaagcaaagaaaacaccctgggaggtcccccttcgctgtggccagaagccaagttctgctgggtgcacaatcctgcggatcacctgatcagagagaactgaacctacaaaagagagctcaacctccttttccatacctaccagggacctagttcagctacgtcctaaacagtaccaggtggtgacttgagaactctgtgcctggtttctgaggactgtttcaccatgcagtggctaatgaggttccggaccctctggggcatccacaaatccttccacaacatccaccctgccccttcacagctgcgctgccggtctttatcagaatttggagccccaagatggaatgactatgaagtaccggaggaatttaactttgcaagttatgtactggactactgggctcaaaaggagaaggagggcaagagaggtccaaatccagctttttggtgggtgaatggccaaggggatgaagtaaagtggagcttcagagagatgggagacctaacccgccgtgtagccaacgtcttcacacagacctgtggcctacaacagggagaccatctggccttgatgctgcctcgagttcctgagtggtggctggtggctgtgggctgcatgcgaacagggatcatcttcattcctgcgaccatcctgttgaaggccaaagacattctctatcgacta

SEQ ID NO: 104450 - DNA, 1988 bp, Homo sapiens
  Payload ID: 510
  Gene Symbol: ACSM2A
  Gene Name: acyl-CoA synthetase medium-chain family member 2A
  Uniprot ID: Q08AH3
  ENST ID: ENST00000219054
  CDS Start-End: 142-1875
gtgctctcttccaaggctgtaggagttctggagctgctggctggagaggagggtggacgaagctctctctagaaagacatcctgagaggacttggcagcctgcagatggcctattgtgggaccttgtgatcatgcctgaatatgcattggctgcgaaaagttcagggactttgcaccctgtggggtactcagatgtccagccgcactctctacattaatagtaggcaactggtgtccctgcagtggggccaccaggaagtgccggccaagtttaactttgctagtgatgtgttggatcactgggctgacatggagaaggctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtggggatcgtgtggcagtggtgctgccccgagtgcctgagtggtggctggtgatcctgggctgcattcgagcaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattaagctactggtgtctgagaaaagctgtgatgggtggctgaacttcaagaaactactaaatgaggcatccaccactcatcactgtgtggagactggaagccaggaagcatctgccatctacttcactagtgggaccagtggtcttcccaagatggcagaacattcctactcgagcctgggcctcaaggccaagatggatgctggttggacaggcctgcaagcctctgatataatgtggaccatatcagacacaggttggatactgaacatcttgtgctcacttatggaaccttgggcattaggagcatgcacatttgttcatctcttgccaaagtttgacccactggttattctaaagacactctccagttatccaatcaagagtatgatgggtgcccccattgtttaccggatgttgctacagcaggatctttccagttacaagttcccccatctacagaactgcgtcactgtaggggagtcccttcttccagaaactctggagaactggagggcccagacaggactggacatccgagaatcctatggccagacagaaacgggattaacttgcatggtttccaagacaatgaaaatcaaaccaggatacatgggaacggctgcttcctgttatgatgtacagatcatagatgataagggcaacgtcctgccccccggcacagaaggagacattggcatcagggtcaaacccatcaggcctataggcatcttctctggctatgtggacaatcccgacaagacagcagccaacattcgaggagacttttggctccttggagaccggggaatcaaagatgaagatgggtatttccagtttatgggacgggcaaatgatatcattaactccagcgggtaccggattggaccctcggaggtagagaatgcactgatggagcaccctgctgtggttgagacggctgtgatcagcagcccagaccccgtccgaggagaggtggtgaaggcatttgtggtcctggcctcgcagttcctgtcccatgacccagaacagctcaccaaggagctgcagcagcatgtgaagtcagtgacagccccatacaagtacccaagaaagatagagtttgtcttgaacctgcccaagactgtcacagggaaaattcaacgagccaagcttcgagacaaggagtggaagatgtccggaaaagcccgtgcgcagtgagacatctaagagacattcatttggattcccctcttctttctctttcttttccctttgggcccttggccttcctatgattatatgagattctttatggaagaacatgaatataa

SEQ ID NO: 104451 - DNA, 2734 bp, Homo sapiens
  Payload ID: 510
  Gene Symbol: ACSM2A
  Gene Name: acyl-CoA synthetase medium-chain family member 2A
  Uniprot ID: Q08AH3
  ENST ID: ENST00000396104
  CDS Start-End: 12-1745
caggcctgaatatgcattggctgcgaaaagttcagggactttgcaccctgtggggtactcagatgtccagccgcactctctacattaatagtaggcaactggtgtccctgcagtggggccaccaggaagtgccggccaagtttaactttgctagtgatgtgttggatcactgggctgacatggagaaggctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtggggatcgtgtggcagtggtgctgccccgagtgcctgagtggtggctggtgatcctgggctgcattcgagcaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattaagctactggtgtctgagaaaagctgtgatgggtggctgaacttcaagaaactactaaatgaggcatccaccactcatcactgtgtggagactggaagccaggaagcatctgccatctacttcactagtgggaccagtggtcttcccaagatggcagaacattcctactcgagcctgggcctcaaggccaagatggatgctggttggacaggcctgcaagcctctgatataatgtggaccatatcagacacaggttggatactgaacatcttgtgctcacttatggaaccttgggcattaggagcatgcacatttgttcatctcttgccaaagtttgacccactggttattctaaagacactctccagttatccaatcaagagtatgatgggtgcccccattgtttaccggatgttgctacagcaggatctttccagttacaagttcccccatctacagaactgcgtcactgtaggggagtcccttcttccagaaactctggagaactggagggcccagacaggactggacatccgagaatcctatggccagacagaaacgggattaacttgcatggtttccaagacaatgaaaatcaaaccaggatacatgggaacggctgcttcctgttatgatgtacagatcatagatgataagggcaacgtcctgccccccggcacagaaggagacattggcatcagggtcaaacccatcaggcctataggcatcttctctggctatgtggacaatcccgacaagacagcagccaacattcgaggagacttttggctccttggagaccggggaatcaaagatgaagatgggtatttccagtttatgggacgggcaaatgatatcattaactccagcgggtaccggattggaccctcggaggtagagaatgcactgatggagcaccctgctgtggttgagacggctgtgatcagcagcccagaccccgtccgaggagaggtggtgaaggcatttgtggtcctggcctcgcagttcctgtcccatgacccagaacagctcaccaaggagctgcagcagcatgtgaagtcagtgacagccccatacaagtacccaagaaagatagagtttgtcttgaacctgcccaagactgtcacagggaaaattcaacgagccaagcttcgagacaaggagtggaagatgtccggaaaagcccgtgcgcagtgagacatctaagagacattcatttggattcccctcttctttctctttcttttccctttgggcccttggccttcctatgattatatgagattctttatggaagaacatgaatataagttttgtcttgccttggttattagcacaaaactttaccatgttagatgttgaaagaagaaagggaaggaatgagagagagtgaaaaggagagggtaacagaaaaaaaggaaagaaaagtaagtcagggaaatattaaaactgcaagggaaagcaattgaaaaagaaataaagtagggaaagaaggagagaggaagcaagggaaggaggaagaaaggaaagaggagatgaaagggggagaaaagatagaagaaaaataattgaagggagaatcagaaaaataaagagcagaaaggaaagaaataaagagagaaagagaaagaagaaagagcaaaagaacacaagaaagaaagagagggagaaagagagggagaaagggagagaaaaaaattgtaaaaataaaaatagtaaaagaaactgataaagaaaagtaatggaagacaggaagaaaagaagagaaggaagtaaagaggaaaacttataaatattcccacagatagacaaagtcaagcataaaactggagcttgagaaggaaatgaaaggccgtggcaccttcttataccctagaagaagacctccatacaggaagacttgtgtgtggggttgggacattagaatcatccacaagtcaccccaaaccttggaactgtcagggtcagaggggaaccaccatttattaagcatttgccatgtgccaggcactaacccagatgcattataaataccacgttgtttcacctgtgtgtggcatctacagaccttagatcatagctgtgagaacaacgtaagcactgccaaagttatcagctacccatatctcatgtttttgatgttatctactcttcctagaatcaaatattaaaataattttaaaacc

SEQ ID NO: 104452 - DNA, 1835 bp, Homo sapiens
  Payload ID: 510
  Gene Symbol: ACSM2A
  Gene Name: acyl-CoA synthetase medium-chain family member 2A
  ENST ID: ENST00000417235
  CDS Start-End: 171-1667
gcttgagttactgtgctctcttccaaggctgtaggagttctggagctgctggctggagaggagggtggacgaagctctctctagaaagacatcctgagaggacttggcaggctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtggggatcgtgtggcagtggtgctgccccgagtgcctgagtggtggctggtgatcctgggctgcattcgagcaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattaagctactggtgtctgagaaaagctgtgatgggtggctgaacttcaagaaactactaaatgaggcatccaccactcatcactgtgtggagactggaagccaggaagcatctgccatctacttcactagtgggaccagtggtcttcccaagatggcagaacattcctactcgagcctgggcctcaaggccaagatggatgctggttggacaggcctgcaagcctctgatataatgtggaccatatcagacacaggttggatactgaacatcttgtgctcacttatggaaccttgggcattaggagcatgcacatttgttcatctcttgccaaagtttgacccactggttattctaaagacactctccagttatccaatcaagagtatgatgggtgcccccattgtttaccggatgttgctacagcaggatctttccagttacaagttcccccatctacagaactgcgtcactgtaggggagtcccttcttccagaaactctggagaactggagggcccagacaggactggacatccgagaatcctatggccagacagaaacgggattaacttgcatggtttccaagacaatgaaaatcaaaccaggatacatgggaacggctgcttcctgttatgatgtacagatcatagatgataagggcaacgtcctgccccccggcacagaaggagacattggcatcagggtcaaacccatcaggcctataggcatcttctctggctatgtggacaatcccgacaagacagcagccaacattcgaggagacttttggctccttggagaccggggaatcaaagatgaagatgggtatttccagtttatgggacgggcaaatgatatcattaactccagcgggtaccggattggaccctcggaggtagagaatgcactgatggagcaccctgctgtggttgagacggctgtgatcagcagcccagaccccgtccgaggagaggtggtgaaggcatttgtggtcctggcctcgcagttcctgtcccatgacccagaacagctcaccaaggagctgcagcagcatgtgaagtcagtgacagccccatacaagtacccaagaaagatagagtttgtcttgaacctgcccaagactgtcacagggaaaattcaacgagccaagcttcgagacaaggagtggaagatgtccggaaaagcccgtgcgcagtgagacatctaagagacattcatttggattcccctcttctttctctttcttttccctttgggcccttggccttcctatgattatatgagattctttatggaagaacatgaatataagttttgtcttgccttggttattagcacaaaactttaccatgttagatgttgaaag

SEQ ID NO: 104453 - DNA, 2837 bp, Homo sapiens
  Payload ID: 510
  Gene Symbol: ACSM2A
  Gene Name: acyl-CoA synthetase medium-chain family member 2A
  Uniprot ID: Q08AH3
  ENST ID: ENST00000573854
  CDS Start-End: 115-1848
gagttactgtgctctcttccaaggctgtaggagttctggagctgctggctggagaggagggtggacgaagctctctctagaaagacatcctgagaggacttggcaggcctgaatatgcattggctgcgaaaagttcagggactttgcaccctgtggggtactcagatgtccagccgcactctctacattaatagtaggcaactggtgtccctgcagtggggccaccaggaagtgccggccaagtttaactttgctagtgatgtgttggatcactgggctgacatggagaaggctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtggggatcgtgtggcagtggtgctgccccgagtgcctgagtggtggctggtgatcctgggctgcattcgagcaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattaagctactggtgtctgagaaaagctgtgatgggtggctgaacttcaagaaactactaaatgaggcatccaccactcatcactgtgtggagactggaagccaggaagcatctgccatctacttcactagtgggaccagtggtcttcccaagatggcagaacattcctactcgagcctgggcctcaaggccaagatggatgctggttggacaggcctgcaagcctctgatataatgtggaccatatcagacacaggttggatactgaacatcttgtgctcacttatggaaccttgggcattaggagcatgcacatttgttcatctcttgccaaagtttgacccactggttattctaaagacactctccagttatccaatcaagagtatgatgggtgcccccattgtttaccggatgttgctacagcaggatctttccagttacaagttcccccatctacagaactgcgtcactgtaggggagtcccttcttccagaaactctggagaactggagggcccagacaggactggacatccgagaatcctatggccagacagaaacgggattaacttgcatggtttccaagacaatgaaaatcaaaccaggatacatgggaacggctgcttcctgttatgatgtacagatcatagatgataagggcaacgtcctgccccccggcacagaaggagacattggcatcagggtcaaacccatcaggcctataggcatcttctctggctatgtggacaatcccgacaagacagcagccaacattcgaggagacttttggctccttggagaccggggaatcaaagatgaagatgggtatttccagtttatgggacgggcaaatgatatcattaactccagcgggtaccggattggaccctcggaggtagagaatgcactgatggagcaccctgctgtggttgagacggctgtgatcagcagcccagaccccgtccgaggagaggtggtgaaggcatttgtggtcctggcctcgcagttcctgtcccatgacccagaacagctcaccaaggagctgcagcagcatgtgaagtcagtgacagccccatacaagtacccaagaaagatagagtttgtcttgaacctgcccaagactgtcacagggaaaattcaacgagccaagcttcgagacaaggagtggaagatgtccggaaaagcccgtgcgcagtgagacatctaagagacattcatttggattcccctcttctttctctttcttttccctttgggcccttggccttcctatgattatatgagattctttatggaagaacatgaatataagttttgtcttgccttggttattagcacaaaactttaccatgttagatgttgaaagaagaaagggaaggaatgagagagagtgaaaaggagagggtaacagaaaaaaaggaaagaaaagtaagtcagggaaatattaaaactgcaagggaaagcaattgaaaaagaaataaagtagggaaagaaggagagaggaagcaagggaaggaggaagaaaggaaagaggagatgaaagggggagaaaagatagaagaaaaataattgaagggagaatcagaaaaataaagagcagaaaggaaagaaataaagagagaaagagaaagaagaaagagcaaaagaacacaagaaagaaagagagggagaaagagagggagaaagggagagaaaaaaattgtaaaaataaaaatagtaaaagaaactgataaagaaaagtaatggaagacaggaagaaaagaagagaaggaagtaaagaggaaaacttataaatattcccacagatagacaaagtcaagcataaaactggagcttgagaaggaaatgaaaggccgtggcaccttcttataccctagaagaagacctccatacaggaagacttgtgtgtggggttgggacattagaatcatccacaagtcaccccaaaccttggaactgtcagggtcagaggggaaccaccatttattaagcatttgccatgtgccaggcactaacccagatgcattataaataccacgttgtttcacctgtgtgtggcatctacagaccttagatcatagctgtgagaacaacgtaagcactgccaaagttatcagctacccatatctcatgtttttgatgttatctactcttcctagaatcaaatattaaaataattttaaaacc

SEQ ID NO: 104454 - DNA, 561 bp, Homo sapiens
  Payload ID: 510
  Gene Symbol: ACSM2A
  Gene Name: acyl-CoA synthetase medium-chain family member 2A
  ENST ID: ENST00000571894
  CDS Start-End: 208-561
ctggagctgctggctggagaggagggtggacgaagctctctctagaaagacatcctgagaggacttggcagatctttcttccgtactggatgcttcctgcacttgaacatcagactccaggttcttcagttttggaactcaaactggctctccttgcacctcagcctgcagatggcctattgtgggaccttgtgatcatgcctgaatatgcattggctgcgaaaagttcagggactttgcaccctgtggggtactcagatgtccagccgcactctctacattaatagtaggcaactggtgtccctgcagtggggccaccaggaagtgccggccaagtttaactttgctagtgatgtgttggatcactgggctgacatggagaaggctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtggggatcgtgtggcagtggtgctgccccgagtgcctgag

SEQ ID NO: 104455 - DNA, 545 bp, Homo sapiens
  Payload ID: 510
  Gene Symbol: ACSM2A
  Gene Name: acyl-CoA synthetase medium-chain family member 2A
  ENST ID: ENST00000574251
  CDS Start-End: 361-545
ataaacttggctaggaggactgctgttaccctttgtaagactccaaagttatccactgtcaatgattagctgagctctctttctgacagtgcagggattctgaagctgtctgcttgagttactgtgctctcttccaaggctgtaggagttctggagctgctggctggagaggagggtggacgaagctctctctagaaagacatcctgagaggacttggcaggttcttcagttttggaactcaaactggctctccttgcacctcagcctgcagatggcctattgtgggaccttgtgatcatgctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtggggatcgtgtggcagtggtgctgccccgagtgcctgagtggtggctggtgatcctgggctgcattcgagcaggtctcatctttatgcctggaaccatccagatgaa

SEQ ID NO: 104456 - DNA, 2322 bp, Homo sapiens
  Payload ID: 510
  Gene Symbol: ACSM2A
  Gene Name: acyl-CoA synthetase medium-chain family member 2A
  Uniprot ID: Q08AH3
  ENST ID: ENST00000575690
  CDS Start-End: 471-2204
gtaggagttctggagctgctggctggagaggagggtggacgaagctctctctagaaagacatcctgagaggacttggcagaaaaaaaggagacagaaatgtcagacactgtgatggttaatactgagtgtcaattgattgaattgaaggatacaaagtgttgatcctggatgtgtctgtgagggtgttgtcaaaagagattaacatttgagtcggtgggctgggagaggcagacccacccttaatctgggtaggaaccacctaatccagcatgactagaatataagcaggcagaaaaatatgaaaagagagactggcctagcttcccagcctagatctttcttccgtactggatgcttcctgcacttgaacatcagactccaggttcttcagttttggaactcaaactggctctccttgcacctcagcctgcagatggcctattgtgggaccttgtgatcatgcctgaatatgcattggctgcgaaaagttcagggactttgcaccctgtggggtactcagatgtccagccgcactctctacattaatagtaggcaactggtgtccctgcagtggggccaccaggaagtgccggccaagtttaactttgctagtgatgtgttggatcactgggctgacatggagaaggctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtggggatcgtgtggcagtggtgctgccccgagtgcctgagtggtggctggtgatcctgggctgcattcgagcaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattaagctactggtgtctgagaaaagctgtgatgggtggctgaacttcaagaaactactaaatgaggcatccaccactcatcactgtgtggagactggaagccaggaagcatctgccatctacttcactagtgggaccagtggtcttcccaagatggcagaacattcctactcgagcctgggcctcaaggccaagatggatgctggttggacaggcctgcaagcctctgatataatgtggaccatatcagacacaggttggatactgaacatcttgtgctcacttatggaaccttgggcattaggagcatgcacatttgttcatctcttgccaaagtttgacccactggttattctaaagacactctccagttatccaatcaagagtatgatgggtgcccccattgtttaccggatgttgctacagcaggatctttccagttacaagttcccccatctacagaactgcgtcactgtaggggagtcccttcttccagaaactctggagaactggagggcccagacaggactggacatccgagaatcctatggccagacagaaacgggattaacttgcatggtttccaagacaatgaaaatcaaaccaggatacatgggaacggctgcttcctgttatgatgtacagatcatagatgataagggcaacgtcctgccccccggcacagaaggagacattggcatcagggtcaaacccatcaggcctataggcatcttctctggctatgtggacaatcccgacaagacagcagccaacattcgaggagacttttggctccttggagaccggggaatcaaagatgaagatgggtatttccagtttatgggacgggcaaatgatatcattaactccagcgggtaccggattggaccctcggaggtagagaatgcactgatggagcaccctgctgtggttgagacggctgtgatcagcagcccagaccccgtccgaggagaggtggtgaaggcatttgtggtcctggcctcgcagttcctgtcccatgacccagaacagctcaccaaggagctgcagcagcatgtgaagtcagtgacagccccatacaagtacccaagaaagatagagtttgtcttgaacctgcccaagactgtcacagggaaaattcaacgagccaagcttcgagacaaggagtggaagatgtccggaaaagcccgtgcgcagtgagacatctaagagacattcatttggattcccctcttctttctctttcttttccctttgggcccttggccttcctatgattatatgagattctttatggaagaacatgaatataagtttt

SEQ ID NO: 104457 - DNA, 1214 bp, Homo sapiens
  Payload ID: 510
  Gene Symbol: ACSM2A
  Gene Name: acyl-CoA synthetase medium-chain family member 2A
  ENST ID: ENST00000574692
  CDS Start-End: 84-710
agttctggagctgctggctggagaggagggtggacgaagctctctctagaaagacatcctgagaggacttggcaggcctgaatatgcattggctgcgaaaagttcagggactttgcaccctgtggggtactcagatgtccagccgcactctctacattaatagtaggcaactggtgtccctgcagtggggccaccaggaagtgccggccaagtttaactttgctagtgatgtgttggatcactgggctgacatggagaaggctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtggggatcgtgtggcagtggtgctgccccgagtgcctgagtggtggctggtgatcctgggctgcattcgagcaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattaagctactggtgtctgagaaaagctgtgatgggtggctgaacttcaagaaactactaaaatataaagtcagacacagagacgttaaataagtagtttaaggttgcattgataacaaagtgtgaaacttcagtagttttcaaacccaactctgattgactcagactcccatgatcttaatcactcagcagcctctcttgtgagtgaggcatccaccactcatcactgtgtggagactggaagccaggaagcatctgccatctacttcactagtgggaccagtggtcttcccaagatggcagaacattcctactcgagcctgggcctcaaggccaagatggatgctggttggacaggcctgcaagcctctgatataatgtggaccatatcagacacaggttggatactgaacatcttgtgctcacttatggaaccttgggcattaggagcatgcacatttgttcatctcttgccaaagtttgacccactggttattctaaagacactctccagttatccaatcaagagtatgatgggtgcccccattgtttaccggatgttgctacagcaggatctttccaggtgatggggctttg

SEQ ID NO: 104458 - DNA, 556 bp, Homo sapiens
  Payload ID: 510
  Gene Symbol: ACSM2A
  Gene Name: acyl-CoA synthetase medium-chain family member 2A
  ENST ID: ENST00000576361
  CDS Start-End: 240-556
ctctttctgacagtgcagggattctgaagctgtctgcttgagttactgtgctctcttccaaggctgtaggagttctggagctgctggctggagaggagggtggacgaagctctctctagaaagacatcctgagaggacttggcagactccaggttcttcagttttggaactcaaactggctctccttgcacctcagcctgcagatggcctattgtgggaccttgtgatcatgcctgaatatgcattggctgcgaaaagttcagggactttgcaccctgtggggtactcagatgtccagccgcactctctacattaatagtaggcaactggtgtccctgcagtggggccaccaggaagtgccggccaagtttaactttgctagtgatgtgttggatcactgggctgacatggagaaggctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtgg

SEQ ID NO: 104459 - DNA, 2935 bp, Homo sapiens
  Payload ID: 511
  Gene Symbol: ACSM2B
  Gene Name: acyl-CoA synthetase medium-chain family member 2B
  Uniprot ID: Q68CK6
  ENST ID: ENST00000329697
  CDS Start-End: 170-1903
aatgattagctgagctctctttccgacagtgcagggattctgaagctgtctgcttgagttactgtgctctcttccaaggctgtaggagttctggagctgctggctggagaggagggtggacgaagctctctccagaaagacatcctgagaggacttggcaggcctgaacatgcattggctgcgaaaagttcagggactttgcaccctgtggggtactcagatgtccagccgcactctctacattaatagtaggcaactggtgtccctgcagtggggccaccaggaagtgccggccaagtttaactttgctagtgatgtgttggatcactgggctgacatggagaaggctggcaagcgactcccaagcccagccctgtggtgggtgaatgggaaggggaaggaattaatgtggaatttcagagaactgagtgaaaacagccagcaggcagccaacatcctctcgggagcctgtggcctgcagcgtggggatcgtgtggcagtgatgctgccccgagtgcctgagtggtggctggtgatcctgggctgcattcgagcaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattaagctactggtgtctgagaaaagctgcgatgggtggctgaacttcaagaaactactaaatgaggcatccaccactcatcactgtgtggagactggaagccaggaagcatctgccatctacttcactagtgggaccagtggtcttcccaagatggcagaacattcctactcgagcctgggcctcaaggccaagatggatgctggttggacaggcctgcaagcctctgatataatgtggaccatatcagacacaggttggatactgaacatcttgggctcacttttggaatcttggacattaggagcatgcacatttgttcatctcttgccaaagtttgacccactggttattctaaagacactctccagttatccaatcaagagtatgatgggtgcccctattgtttaccggatgttgctacagcaggatctttccagttacaagttcccccatctacagaactgcctcgctggaggggagtcccttcttccagaaactctggagaactggagggcccagacaggactggacatccgagaattctatggccagacagaaacgggattaacttgcatggtttccaagacaatgaaaatcaaaccaggatacatgggaacggctgcttcctgttatgatgtacaggttatagatgataagggcaacgtcctgccccccggcacagaaggagacattggcatcagggtcaaacccatcaggcctataggcatcttctctggctatgtggaaaatcccgacaagacagcagccaacattcgaggagacttttggctccttggagaccggggaatcaaagatgaagatgggtatttccagtttatgggacgggcagatgatatcattaactccagcgggtaccggattggaccctcggaggtagagaatgcactgatgaagcaccctgctgtggttgagacggctgtgatcagcagcccagaccccgtccgaggagaggtggtgaaggcatttgtgatcctggcctcgcagttcctatcccatgacccagaacagctcaccaaggagctgcagcagcatgtgaagtcagtgacagccccatacaagtacccaagaaagatagagtttgtcttgaacctgcccaagactgtcacagggaaaattcaacgaaccaaacttcgagacaaggagtggaagatgtccggaaaagcccgtgcgcagtgaggcgtctaggagacattcatttggattcccctcttctttctctttcttttccctttgggcccttggccttactatgatgatatgagattctttatgaaagaacatgaatgtaagttttgtcttgccctggttattagcacaaaacattactatgttagatattgaaataagaaagggaaggaatgagagagagtgaaaaggagagggtaacagaaaaagaggaaagaaaagtaagtcagggaaatgttaaaaactgcaagagaaagcaattgaaaaagaaataaagtagggagggaaggcgagaggaagcaagggaaggaggaagaaaggaaagaggagatgaaagggggagaaaagatagaagaaaaataattgaagggagaatcagaaaaataaagagaagaaaggaaagaaataaagagagaaagagaaagaagaaagagcaaaagaacacaagaaagaaagagagggagaaagagagggagaaagggagagaaaaaaattgtaaaaataaaaatagtaaaagaaactgataaagaaaagtcatggaagacaggaagaaaggaagagagggaagtaaagaggaaaacctataaatattcccacagatagacaaagtcaagcataaaactggagcttgagaaggaaatgaaaggaaaagaagtggtactttcttttaccctaggagaagacctccatacaggaagacttgtgtgtggggctgggacattagaatcatccgcaagtcactccaaaccttgaaactgtcagggtcagaggggaaccaccatttattaagcatttgccatgtgccaggcactgacccagacacattataaataccacattgtttcacctgtgtgtggcatctacagaccttagatcatagctgtgagaacaaagtaagcactgccaaagttatcagctacccatacctcatgtttttggtgttatctactcttcctagaatcaaatattaaaataattttaaaaccaagatcctgacaatagtctttaggaaaaacaaaaaaa

SEQ ID NO: 104460 - DNA, 2740 bp, Homo sapiens
  Payload ID: 511
  Gene Symbol: ACSM2B
  Gene Name: acyl-CoA synthetase medium-chain family member 2B
  Uniprot ID: Q68CK6
  ENST ID: ENST00000414188
  CDS Start-End: 12-1745
caggcctgaacatgcattggctgcgaaaagttcagggactttgcaccctgtggggtactcagatgtccagccgcactctctacattaatagtaggcaactggtgtccctgcagtggggccaccaggaagtgccggccaagtttaactttgctagtgatgtgttggatcactgggctgacatggagaaggctggcaagcgactcccaagcccagccctgtggtgggtgaatgggaaggggaaggaattaatgtggaatttcagagaactgagtgaaaacagccagcaggcagccaacatcctctcgggagcctgtggcctgcagcgtggggatcgtgtggcagtgatgctgccccgagtgcctgagtggtggctggtgatcctgggctgcattcgagcaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattaagctactggtgtctgagaaaagctgcgatgggtggctgaacttcaagaaactactaaatgaggcatccaccactcatcactgtgtggagactggaagccaggaagcatctgccatctacttcactagtgggaccagtggtcttcccaagatggcagaacattcctactcgagcctgggcctcaaggccaagatggatgctggttggacaggcctgcaagcctctgatataatgtggaccatatcagacacaggttggatactgaacatcttgggctcacttttggaatcttggacattaggagcatgcacatttgttcatctcttgccaaagtttgacccactggttattctaaagacactctccagttatccaatcaagagtatgatgggtgcccctattgtttaccggatgttgctacagcaggatctttccagttacaagttcccccatctacagaactgcctcgctggaggggagtcccttcttccagaaactctggagaactggagggcccagacaggactggacatccgagaattctatggccagacagaaacgggattaacttgcatggtttccaagacaatgaaaatcaaaccaggatacatgggaacggctgcttcctgttatgatgtacaggttatagatgataagggcaacgtcctgccccccggcacagaaggagacattggcatcagggtcaaacccatcaggcctataggcatcttctctggctatgtggaaaatcccgacaagacagcagccaacattcgaggagacttttggctccttggagaccggggaatcaaagatgaagatgggtatttccagtttatgggacgggcagatgatatcattaactccagcgggtaccggattggaccctcggaggtagagaatgcactgatgaagcaccctgctgtggttgagacggctgtgatcagcagcccagaccccgtccgaggagaggtggtgaaggcatttgtgatcctggcctcgcagttcctatcccatgacccagaacagctcaccaaggagctgcagcagcatgtgaagtcagtgacagccccatacaagtacccaagaaagatagagtttgtcttgaacctgcccaagactgtcacagggaaaattcaacgaaccaaacttcgagacaaggagtggaagatgtccggaaaagcccgtgcgcagtgaggcgtctaggagacattcatttggattcccctcttctttctctttcttttccctttgggcccttggccttactatgatgatatgagattctttatgaaagaacatgaatgtaagttttgtcttgccctggttattagcacaaaacattactatgttagatattgaaataagaaagggaaggaatgagagagagtgaaaaggagagggtaacagaaaaagaggaaagaaaagtaagtcagggaaatgttaaaaactgcaagagaaagcaattgaaaaagaaataaagtagggagggaaggcgagaggaagcaagggaaggaggaagaaaggaaagaggagatgaaagggggagaaaagatagaagaaaaataattgaagggagaatcagaaaaataaagagaagaaaggaaagaaataaagagagaaagagaaagaagaaagagcaaaagaacacaagaaagaaagagagggagaaagagagggagaaagggagagaaaaaaattgtaaaaataaaaatagtaaaagaaactgataaagaaaagtcatggaagacaggaagaaaggaagagagggaagtaaagaggaaaacctataaatattcccacagatagacaaagtcaagcataaaactggagcttgagaaggaaatgaaaggaaaagaagtggtactttcttttaccctaggagaagacctccatacaggaagacttgtgtgtggggctgggacattagaatcatccgcaagtcactccaaaccttgaaactgtcagggtcagaggggaaccaccatttattaagcatttgccatgtgccaggcactgacccagacacattataaataccacattgtttcacctgtgtgtggcatctacagaccttagatcatagctgtgagaacaaagtaagcactgccaaagttatcagctacccatacctcatgtttttggtgttatctactcttcctagaatcaaatattaaaataattttaaaacc

SEQ ID NO: 104461 - DNA, 561 bp, Homo sapiens
  Payload ID: 511
  Gene Symbol: ACSM2B
  Gene Name: acyl-CoA synthetase medium-chain family member 2B
  ENST ID: ENST00000566384
  CDS Start-End: 208-561
ctggagctgctggctggagaggagggtggacgaagctctctccagaaagacatcctgagaggacttggcagatctttcttccgtactggatgcttcctgcccttgaacatcagactccaggttcttcagttttggaactcaaactggctctccttgcacctcagcctgcagatggcctattgtgggaccttgtgatcatgcctgaacatgcattggctgcgaaaagttcagggactttgcaccctgtggggtactcagatgtccagccgcactctctacattaatagtaggcaactggtgtccctgcagtggggccaccaggaagtgccggccaagtttaactttgctagtgatgtgttggatcactgggctgacatggagaaggctggcaagcgactcccaagcccagccctgtggtgggtgaatgggaaggggaaggaattaatgtggaatttcagagaactgagtgaaaacagccagcaggcagccaacatcctctcgggagcctgtggcctgcagcgtggggatcgtgtggcagtgatgctgccccgagtgcctgag

SEQ ID NO: 104462 - DNA, 1214 bp, Homo sapiens
  Payload ID: 511
  Gene Symbol: ACSM2B
  Gene Name: acyl-CoA synthetase medium-chain family member 2B
  ENST ID: ENST00000569327
  CDS Start-End: 84-710
agttctggagctgctggctggagaggagggtggacgaagctctctccagaaagacatcctgagaggacttggcaggcctgaacatgcattggctgcgaaaagttcagggactttgcaccctgtggggtactcagatgtccagccgcactctctacattaatagtaggcaactggtgtccctgcagtggggccaccaggaagtgccggccaagtttaactttgctagtgatgtgttggatcactgggctgacatggagaaggctggcaagcgactcccaagcccagccctgtggtgggtgaatgggaaggggaaggaattaatgtggaatttcagagaactgagtgaaaacagccagcaggcagccaacatcctctcgggagcctgtggcctgcagcgtggggatcgtgtggcagtgatgctgccccgagtgcctgagtggtggctggtgatcctgggctgcattcgagcaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattaagctactggtgtctgagaaaagctgcgatgggtggctgaacttcaagaaactactaaaatataaagtgagacacagagaagttaaataagtagtttaaggttgcattgataacaaagtgccaaacttgagtagttttcaaacccaactctgattgactcaggctcccatgatcttaatcactcagcagcctctcttgtgagtgaggcatccaccactcatcactgtgtggagactggaagccaggaagcatctgccatctacttcactagtgggaccagtggtcttcccaagatggcagaacattcctactcgagcctgggcctcaaggccaagatggatgctggttggacaggcctgcaagcctctgatataatgtggaccatatcagacacaggttggatactgaacatcttgggctcacttttggaatcttggacattaggagcatgcacatttgttcatctcttgccaaagtttgacccactggttattctaaagacactctccagttatccaatcaagagtatgatgggtgcccctattgtttaccggatgttgctacagcaggatctttccaggtgatggggctttg

SEQ ID NO: 104463 - DNA, 2322 bp, Homo sapiens
  Payload ID: 511
  Gene Symbol: ACSM2B
  Gene Name: acyl-CoA synthetase medium-chain family member 2B
  Uniprot ID: Q68CK6
  ENST ID: ENST00000565232
  CDS Start-End: 471-2204
gtaggagttctggagctgctggctggagaggagggtggacgaagctctctccagaaagacatcctgagaggacttggcagaaaaaaaggagacagaaatgtcagacactgtgatggttaatactgagtgtcaattgattgaattgaaggatacaaagtgttgatcctgggtgtgtctgtgagggtgttgtcaaaagagattaacatttgagtcggtgggctgggagaggcagacccacccttaatctgggtaggcaccacctaatccagcatgactagaatataaggaggcagaaaaatatgaaaagagagactggcctagcttcccagcctagatctttcttccgtactggatgcttcctgcccttgaacatcagactccaggttcttcagttttggaactcaaactggctctccttgcacctcagcctgcagatggcctattgtgggaccttgtgatcatgcctgaacatgcattggctgcgaaaagttcagggactttgcaccctgtggggtactcagatgtccagccgcactctctacattaatagtaggcaactggtgtccctgcagtggggccaccaggaagtgccggccaagtttaactttgctagtgatgtgttggatcactgggctgacatggagaaggctggcaagcgactcccaagcccagccctgtggtgggtgaatgggaaggggaaggaattaatgtggaatttcagagaactgagtgaaaacagccagcaggcagccaacatcctctcgggagcctgtggcctgcagcgtggggatcgtgtggcagtgatgctgccccgagtgcctgagtggtggctggtgatcctgggctgcattcgagcaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattaagctactggtgtctgagaaaagctgcgatgggtggctgaacttcaagaaactactaaatgaggcatccaccactcatcactgtgtggagactggaagccaggaagcatctgccatctacttcactagtgggaccagtggtcttcccaagatggcagaacattcctactcgagcctgggcctcaaggccaagatggatgctggttggacaggcctgcaagcctctgatataatgtggaccatatcagacacaggttggatactgaacatcttgggctcacttttggaatcttggacattaggagcatgcacatttgttcatctcttgccaaagtttgacccactggttattctaaagacactctccagttatccaatcaagagtatgatgggtgcccctattgtttaccggatgttgctacagcaggatctttccagttacaagttcccccatctacagaactgcctcgctggaggggagtcccttcttccagaaactctggagaactggagggcccagacaggactggacatccgagaattctatggccagacagaaacgggattaacttgcatggtttccaagacaatgaaaatcaaaccaggatacatgggaacggctgcttcctgttatgatgtacaggttatagatgataagggcaacgtcctgccccccggcacagaaggagacattggcatcagggtcaaacccatcaggcctataggcatcttctctggctatgtggaaaatcccgacaagacagcagccaacattcgaggagacttttggctccttggagaccggggaatcaaagatgaagatgggtatttccagtttatgggacgggcagatgatatcattaactccagcgggtaccggattggaccctcggaggtagagaatgcactgatgaagcaccctgctgtggttgagacggctgtgatcagcagcccagaccccgtccgaggagaggtggtgaaggcatttgtgatcctggcctcgcagttcctatcccatgacccagaacagctcaccaaggagctgcagcagcatgtgaagtcagtgacagccccatacaagtacccaagaaagatagagtttgtcttgaacctgcccaagactgtcacagggaaaattcaacgaaccaaacttcgagacaaggagtggaagatgtccggaaaagcccgtgcgcagtgaggcgtctaggagacattcatttggattcccctcttctttctctttcttttccctttgggcccttggccttactatgatgatatgagattctttatgaaagaacatgaatgtaagtttt

SEQ ID NO: 104464 - DNA, 405 bp, Homo sapiens
  Payload ID: 511
  Gene Symbol: ACSM2B
  Gene Name: acyl-CoA synthetase medium-chain family member 2B
  ENST ID: ENST00000568098
  CDS Start-End: 1-332
tctctggctatgtggaaaatcccgacaagacagcagccaacattcgaggagacttttggctccttggagaccggggaatcaaagatgaagatgggtatttccagtttatgggacgggcatttgtgatcctggcctcgcagttcctatcccatgacccagaacagctcaccaaggagctgcagcagcatgtgaagtcagtgacagccccatacaagtacccaagaaagatagagtttgtcttgaacctgcccaagactgtcacagggaaaattcaacgaaccaaacttcgagacaaggagtggaagatgtccggaaaagcccgtgcgcagtgaggcgtctaggagacattcatttggattcccctcttctttctctttcttttccctttgggcccttggccttact

SEQ ID NO: 104465 - DNA, 545 bp, Homo sapiens
  Payload ID: 511
  Gene Symbol: ACSM2B
  Gene Name: acyl-CoA synthetase medium-chain family member 2B
  ENST ID: ENST00000568882
  CDS Start-End: 361-545
ataaacttggctaggaggactgctgttaccctttgtaagactccaaagttatccactgtcaatgattagctgagctctctttccgacagtgcagggattctgaagctgtctgcttgagttactgtgctctcttccaaggctgtaggagttctggagctgctggctggagaggagggtggacgaagctctctccagaaagacatcctgagaggacttggcaggttcttcagttttggaactcaaactggctctccttgcacctcagcctgcagatggcctattgtgggaccttgtgatcatgctggcaagcgactcccaagcccagccctgtggtgggtgaatgggaaggggaaggaattaatgtggaatttcagagaactgagtgaaaacagccagcaggcagccaacatcctctcgggagcctgtggcctgcagcgtggggatcgtgtggcagtgatgctgccccgagtgcctgagtggtggctggtgatcctgggctgcattcgagcaggtctcatctttatgcctggaaccatccagatgaa

SEQ ID NO: 104466 - DNA, 556 bp, Homo sapiens
  Payload ID: 511
  Gene Symbol: ACSM2B
  Gene Name: acyl-CoA synthetase medium-chain family member 2B
  ENST ID: ENST00000569344
  CDS Start-End: 240-556
ctctttccgacagtgcagggattctgaagctgtctgcttgagttactgtgctctcttccaaggctgtaggagttctggagctgctggctggagaggagggtggacgaagctctctccagaaagacatcctgagaggacttggcagactccaggttcttcagttttggaactcaaactggctctccttgcacctcagcctgcagatggcctattgtgggaccttgtgatcatgcctgaacatgcattggctgcgaaaagttcagggactttgcaccctgtggggtactcagatgtccagccgcactctctacattaatagtaggcaactggtgtccctgcagtggggccaccaggaagtgccggccaagtttaactttgctagtgatgtgttggatcactgggctgacatggagaaggctggcaagcgactcccaagcccagccctgtggtgggtgaatgggaaggggaaggaattaatgtggaatttcagagaactgagtgaaaacagccagcaggcagccaacatcctctcgggagcctgtggcctgcagcgtgg

SEQ ID NO: 104467 - DNA, 592 bp, Homo sapiens
  Payload ID: 511
  Gene Symbol: ACSM2B
  Gene Name: acyl-CoA synthetase medium-chain family member 2B
  ENST ID: ENST00000569163
  CDS Start-End: 1-450
tggctgaacttcaagaaactactaaatgaggcatccaccactcatcactgtgtggagactggaagccaggaagcatctgccatctacttcactagtgggaccagtggtcttcccaagatggcagaacattcctactcgagcctgggcctcaaggccaagatggatgctggttggacaggcctgcaagcctctgatataatgtggaccatatcagacacaggttggatactgaacatcttgggctcacttttggaatcttggacattaggagcatgcacatttgttcatctcttgccaaagtttgacccactggttattctaaaggtctttagatcaactcaaccaattgtcaaccagaaaaaatttaaatctacctataagctggaagcccccgcttcaagttgccccacctttctggaccaaaccaatgtattttttaaatgtgtttgattgatgtcttatgtctccctaaaatgtataaaaccaaagtgcaccctgaccaccttgggcacgtgttctcaggacctcctgagggctctgtcatggccatggttactcatgtttggctcagaataaatctcttcaaatattt

SEQ ID NO: 104468 - DNA, 1988 bp, Homo sapiens
  Payload ID: 511
  Gene Symbol: ACSM2B
  Gene Name: acyl-CoA synthetase medium-chain family member 2B
  Uniprot ID: Q68CK6
  ENST ID: ENST00000567001
  CDS Start-End: 142-1875
gtgctctcttccaaggctgtaggagttctggagctgctggctggagaggagggtggacgaagctctctccagaaagacatcctgagaggacttggcagcctgcagatggcctattgtgggaccttgtgatcatgcctgaacatgcattggctgcgaaaagttcagggactttgcaccctgtggggtactcagatgtccagccgcactctctacattaatagtaggcaactggtgtccctgcagtggggccaccaggaagtgccggccaagtttaactttgctagtgatgtgttggatcactgggctgacatggagaaggctggcaagcgactcccaagcccagccctgtggtgggtgaatgggaaggggaaggaattaatgtggaatttcagagaactgagtgaaaacagccagcaggcagccaacatcctctcgggagcctgtggcctgcagcgtggggatcgtgtggcagtgatgctgccccgagtgcctgagtggtggctggtgatcctgggctgcattcgagcaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattaagctactggtgtctgagaaaagctgcgatgggtggctgaacttcaagaaactactaaatgaggcatccaccactcatcactgtgtggagactggaagccaggaagcatctgccatctacttcactagtgggaccagtggtcttcccaagatggcagaacattcctactcgagcctgggcctcaaggccaagatggatgctggttggacaggcctgcaagcctctgatataatgtggaccatatcagacacaggttggatactgaacatcttgggctcacttttggaatcttggacattaggagcatgcacatttgttcatctcttgccaaagtttgacccactggttattctaaagacactctccagttatccaatcaagagtatgatgggtgcccctattgtttaccggatgttgctacagcaggatctttccagttacaagttcccccatctacagaactgcctcgctggaggggagtcccttcttccagaaactctggagaactggagggcccagacaggactggacatccgagaattctatggccagacagaaacgggattaacttgcatggtttccaagacaatgaaaatcaaaccaggatacatgggaacggctgcttcctgttatgatgtacaggttatagatgataagggcaacgtcctgccccccggcacagaaggagacattggcatcagggtcaaacccatcaggcctataggcatcttctctggctatgtggaaaatcccgacaagacagcagccaacattcgaggagacttttggctccttggagaccggggaatcaaagatgaagatgggtatttccagtttatgggacgggcagatgatatcattaactccagcgggtaccggattggaccctcggaggtagagaatgcactgatgaagcaccctgctgtggttgagacggctgtgatcagcagcccagaccccgtccgaggagaggtggtgaaggcatttgtgatcctggcctcgcagttcctatcccatgacccagaacagctcaccaaggagctgcagcagcatgtgaagtcagtgacagccccatacaagtacccaagaaagatagagtttgtcttgaacctgcccaagactgtcacagggaaaattcaacgaaccaaacttcgagacaaggagtggaagatgtccggaaaagcccgtgcgcagtgaggcgtctaggagacattcatttggattcccctcttctttctctttcttttccctttgggcccttggccttactatgatgatatgagattctttatgaaagaacatgaatgtaa

SEQ ID NO: 104469 - DNA, 1834 bp, Homo sapiens
  Payload ID: 511
  Gene Symbol: ACSM2B
  Gene Name: acyl-CoA synthetase medium-chain family member 2B
  ENST ID: ENST00000565322
  CDS Start-End: 171-1667
gcttgagttactgtgctctcttccaaggctgtaggagttctggagctgctggctggagaggagggtggacgaagctctctccagaaagacatcctgagaggacttggcaggctggcaagcgactcccaagcccagccctgtggtgggtgaatgggaaggggaaggaattaatgtggaatttcagagaactgagtgaaaacagccagcaggcagccaacatcctctcgggagcctgtggcctgcagcgtggggatcgtgtggcagtgatgctgccccgagtgcctgagtggtggctggtgatcctgggctgcattcgagcaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattaagctactggtgtctgagaaaagctgcgatgggtggctgaacttcaagaaactactaaatgaggcatccaccactcatcactgtgtggagactggaagccaggaagcatctgccatctacttcactagtgggaccagtggtcttcccaagatggcagaacattcctactcgagcctgggcctcaaggccaagatggatgctggttggacaggcctgcaagcctctgatataatgtggaccatatcagacacaggttggatactgaacatcttgggctcacttttggaatcttggacattaggagcatgcacatttgttcatctcttgccaaagtttgacccactggttattctaaagacactctccagttatccaatcaagagtatgatgggtgcccctattgtttaccggatgttgctacagcaggatctttccagttacaagttcccccatctacagaactgcctcgctggaggggagtcccttcttccagaaactctggagaactggagggcccagacaggactggacatccgagaattctatggccagacagaaacgggattaacttgcatggtttccaagacaatgaaaatcaaaccaggatacatgggaacggctgcttcctgttatgatgtacaggttatagatgataagggcaacgtcctgccccccggcacagaaggagacattggcatcagggtcaaacccatcaggcctataggcatcttctctggctatgtggaaaatcccgacaagacagcagccaacattcgaggagacttttggctccttggagaccggggaatcaaagatgaagatgggtatttccagtttatgggacgggcagatgatatcattaactccagcgggtaccggattggaccctcggaggtagagaatgcactgatgaagcaccctgctgtggttgagacggctgtgatcagcagcccagaccccgtccgaggagaggtggtgaaggcatttgtgatcctggcctcgcagttcctatcccatgacccagaacagctcaccaaggagctgcagcagcatgtgaagtcagtgacagccccatacaagtacccaagaaagatagagtttgtcttgaacctgcccaagactgtcacagggaaaattcaacgaaccaaacttcgagacaaggagtggaagatgtccggaaaagcccgtgcgcagtgaggcgtctaggagacattcatttggattcccctcttctttctctttcttttccctttgggcccttggccttactatgatgatatgagattctttatgaaagaacatgaatgtaagttttgtcttgccctggttattagcacaaaacattactatgttagatattgaaa

SEQ ID NO: 104470 - DNA, 883 bp, Homo sapiens
  Payload ID: 511
  Gene Symbol: ACSM2B
  Gene Name: acyl-CoA synthetase medium-chain family member 2B
  ENST ID: ENST00000567288
  CDS Start-End: 1-603
gaacattcctactcgagcctgggcctcaaggccaagatggatgctggttggacaggcctgcaagcctctgatataatgtggaccatatcagacacaggttggatactgaacatcttgggctcacttttggaatcttggacattaggagcatgcacatttgttcatctcttgccaaagtttgacccactggttattctaaagacactctccagttatccaatcaagagtatgatgggtgcccctattgtttaccggatgttgctacagcaggatctttccagttacaagttcccccatctacagaactgcctcgctggaggggagtcccttcttccagaaactctggagaactggagggcccagacaggactggacatccgagaattctatggccagacagaaacgggattaacttgcatggtttccaagacaatgaaaatcaaaccaggatacatgggaacggctgcttcctgttatgatgtacaggttatagatgataagggcaacgtcctgccccccggcacagaaggagacattggcatcagggtcaaacccatcaggcctataggcatcttctctggctatgtggtatcatccccatgatctatgccgttgatcttctttagagccatgccaggcactttacgttgagacttcaccatctagttggaggaatccctatcttcagatcttgggaaggtaaagacagataatccttgaatctggccacctcacttgacaggtgaggatggtggagccagagattacaagacttgctcaagctcacaaccattagaaagtggacagagaagaacccaagggcatgccttctgatccctgagataattgactaataaactaaataaataataaatcaaataat

SEQ ID NO: 104471 - DNA, 2845 bp, Homo sapiens
  Payload ID: 512
  Gene Symbol: ACSM3
  Gene Name: acyl-CoA synthetase medium-chain family member 3
  Uniprot ID: Q53FZ2
  ENST ID: ENST00000289416
  CDS Start-End: 476-2236
ctttcctttcaatttcaaaactcctctatggcttcctccatctgttcttccttctgagaagtgctctctctgcccctttacagaactaaccacttcggcaactccttggacactttccttcttgttaataatttgctttctccgcccctcaaaagcttgctgtttctgtaaatcattacctgtaagaggaaccgctgggagtcctgtaaactttagcccagagcttggctcctcctccagaatgtctccaccaatcaaggaaagtgttttgggccagtcttgctcctccggattgtcagactgctcctccctcttctttagactgccacgaggaaaaagcagatgtgagaactcaaggttcagggctgctcttctaagaaacaagtctgccataatctccatctgtgttggaatctgttaactaatgaactggtctctgtgcaaatcctgagtgctaaagcttccaacaagactgatgctagctcgtgtcaccaggaagatgctacgtcatgccaagtgttttcagcgcctagcaatttttggttctgtgagggcactgcataaagataatagaacagcaacccctcagaatttctccaactatgaatccatgaaacaggacttcaaactggggattccagagtatttcaactttgctaaagatgtcctggaccaatggactgataaggaaaaggctggaaagaaaccttcaaatccagccttctggtggatcaacagaaatggagaagagatgcgatggagttttgaggaactgggatctctgtccagaaaatttgccaatatactttcagaagcctgttccctacaaagaggagatcgggtaattctgattctgcccagggtcccagagtggtggcttgcaaatgtggcctgtctgcgaacagggacagttttaattccaggaaccactcagctgacccagaaagacattctctacagactacaatcttcaaaagcaaactgcattatcaccaatgatgttttagccccagcagtagacgctgttgcatccaaatgtgaaaatctgcactccaagctgattgtatcagagaactccagagaggggtgggggaacctcaaggagttgatgaaacatgccagtgacagccacacctgtgtgaagacaaaacacaatgagatcatggccatattctttaccagtggaacaagtggatatccgaaaatgactgcacacacccacagcagttttggtttaggattatctgtaaatggaaggttctggctagatttgacaccctcagatgtgatgtggaatacctcagatacgggctgggcaaagtctgcatggagtagtgttttttctccgtggatccagggagcatgtgtattcacacaccatttaccccgttttgagccgacttctatcttgcaaacactctccaagtaccccatcacagtcttctgttcagcaccaactgtataccgaatgcttgtacagaatgatataaccagctataagtttaaaagcttaaagcactgtgtgagtgctggggaaccaattacccctgacgtgactgaaaaatggagaaacaagacgggcctggatatctacgaaggatatggacagactgaaacggtgctaatctgtggaaattttaagggaatgaaaattaaacctggctcaatgggaaaaccttctcctgctttcgatgttaagattgtagatgtaaatggcaatgttctacctcctggacaagaaggagatattggcattcaagttctacccaaccgaccatttggcctttttactcattacgtagataatccttcaaaaacagcttcaactctacgaggcaatttctatatcactggggacagaggatatatggataaagatgggtatttctggtttgttgcaagagcagatgatgtcatattatcctctggctatcgaattggaccatttgaggtagaaaatgccctgaatgaacacccttcagttgcagagtcagctgttgtcagcagcccagaccccatcagaggagaggtagtaaaggcttttgtcgttctaaatcctgattacaagtcacatgatcaagaacaactaataaaggagattcaggagcatgttaaaaaaactacagcaccttacaaatatcccagaaaggtagaatttattcaagagctgccaaagactatcagtgggaagacaaaaagaaatgaactgaggaagaaagaatggaagacaatttaaagttgtttcattaattaccatatctataaaacaaacatagtatctgtcaatctctagaaaccacaagatgatggagaggtcataaaaactgtggtagtatgcttagaaactgttgatttaaaatatcttgtggttatgatatcagaggctaaattttgaaataaaatatttggcaaattcctccacattagtgtcaatgttcctatcatttcttaatataaaaataataccatcaattgctgattaatttttaaatgtatagtatagaagcagtttctgaaccagatctctgctacataggttttcaaactttagttgactaattcttctgatatgttgatatacaaatcagaaccaatgttcaagcctgaaataaaactaaagaacttataaaagtttttagaaaaatataaaatatcagttagaagattatgataatctcaaagtacaagaatctacctgaaaatagactagggatttttattagtcacattttttgcaaataatttaaaaatagtttagacttgtttcaaggtctaactataaaagaaggatcatatactattgttgcttattatatgtaatctaataaatactgtttacaaaaga

SEQ ID NO: 104472 - DNA, 1517 bp, Homo sapiens
  Payload ID: 512
  Gene Symbol: ACSM3
  Gene Name: acyl-CoA synthetase medium-chain family member 3
  Uniprot ID: Q53FZ2
  ENST ID: ENST00000440284
  CDS Start-End: 138-1454
gcagatgtgagaactcaaggttcagggctgctcttctaagaaacaagtctgccataatctccatctgtgttggaatctgttaactaatgaactggtctctgtgcaaatcctgagtgctaaagcttccaacaagactgatgctagctcgtgtcaccaggaagatgctacgtcatgccaagtgttttcagcgcctagcaatttttggttctgtgagggcactgcataaagataatagaacagcaacccctcagaatttctccaactatgaatccatgaaacaggacttcaaactggggattccagagtatttcaactttgctaaagatgtcctggaccaatggactgataaggaaaaggctggaaagaaaccttcaaatccagccttctggtggatcaacagaaatggagaagagatgcgatggagttttgaggaactgggatctctgtccagaaaatttgccaatatactttcagaagcctgttccctacaaagaggagatcgggtaattctgattctgcccagggtcccagagtggtggcttgcaaatgtggcctgtctgcgaacagggacagttttaattccaggaaccactcagctgacccagaaagacattctctacagactacaatcttcaaaagcaaactgcattatcaccaatgatgttttagccccagcagtagacgctgttgcatccaaatgtgaaaatctgcactccaagctgattgtatcagagaactccagagaggggtgggggaacctcaaggagttgatgaaacatgccagtgacagccacacctgtgtgaagacaaaacacaatgagatcatggccatattctttaccagtggaacaagtggatatccgaaaatgactgcacacacccacagcagttttggtttaggattatctgtaaatggaaggttctggctagatttgacaccctcagatgtgatgtggaatacctcagatacgggctgggcaaagtctgcatggagtagtgttttttctccgtggatccagggagcatgtgtattcacacaccatttaccccgttttgagccgacttctatcttgcaaacactctccaagtaccccatcacagtcttctgttcagcaccaactgtataccgaatgcttgtacagaatgatataaccagctataagtttaaaagcttaaagcactgtgtgagtgctggggaaccaattacccctgacgtgactgaaaaatggagaaacaagacgggcctggatatctacgaaggatatggacagactgaaacggtgctaatctgtggaaattttaagggaatgaaaattaaacctggctcaatgggaaaaccttctcctgctttcgatgttaaggtttgcacatccccttccaggagaatgtttaacaacccaatctgtacactacctacctaccgcttacccccatataaactttctttgttatgatggtgattccattttacttccatgatactttaatttttataaatatgtgaaaatgattagaaa

SEQ ID NO: 104473 - DNA, 561 bp, Homo sapiens
  Payload ID: 512
  Gene Symbol: ACSM3
  Gene Name: acyl-CoA synthetase medium-chain family member 3
  ENST ID: ENST00000561584
  CDS Start-End: 405-561
atttctggtggcccatatggggattggagataacagatttactgtctcctttgcccatgggactagggccctggggctgtggaagacctggcatccaaggcatgccatgggggagtttcacccggatggagactggctctccccgcatcctgcccagcagtgcaactgaacctgagatggggctgcaggatgacaccagcacttcaggaaccgcggtgtcagagccagaggagaagagtggacaacccaactgcccaccacaggtccctagaagtacaggtcaagcctatgctggggagaggcaaacagtttcctggtacatagccgctaaaacccctggaatttctgaagtgatgaactggtctctgtgcaaatcctgagtgctaaagcttccaacaagactgatgctagctcgtgtcaccaggaagatgctacgtcatgccaagtgttttcagcgcctagcaatttttggttctgtgagggcactgcataaagataatagaacagcaacccctcagaatttctccaactatgaatccatgaaacaggacttcaaactgg

SEQ ID NO: 104474 - DNA, 1931 bp, Homo sapiens
  Payload ID: 512
  Gene Symbol: ACSM3
  Gene Name: acyl-CoA synthetase medium-chain family member 3
  ENST ID: ENST00000562251
  CDS Start-End: 1-1747
ctatgaatccatgaaacaggacttcaaactggggattccagagtatttcaactttgctaaagatgtcctggaccaatggactgataaggaaaaggctggaaagaaaccttcaaatccagccttctggtggatcaacagaaatggagaagagatgcgatggagttttgaggaactgggatctctgtccagaaaatttgccaatatactttcagaagcctgttccctacaaagaggagatcgggtaattctgattctgcccagggtcccagagtggtggcttgcaaatgtggcctgtctgcgaacagggacagttttaattccaggaaccactcagctgacccagaaagacattctctacagactacaatcttcaaaagcaaactgcattatcaccaatgatgttttagccccagcagtagacgctgttgcatccaaatgtgaaaatctgcactccaagctgattgtatcagagaactccagagaggggtgggggaacctcaaggagttgatgaaagtctttctctgtcacccaggctggagtacggtggctcgatcttggctcactgcaacctccacctccctggttcaagcgattctcagcctcctgagtagctgggattacagacatgccagtgacagccacacctgtgtgaagacaaaacacaatgagatcatggccatattctttaccagtggaacaagtggatatccgaaaatgactgcacacacccacagcagttttggtttaggattatctgtaaatggaaggttctggctagatttgacaccctcagatgtgatgtggaatacctcagatacgggctgggcaaagtctgcatggagtagtgttttttctccgtggatccagggagcatgtgtattcacacaccatttaccccgttttgagccgacttctatcttgcaaacactctccaagtaccccatcacagtcttctgttcagcaccaactgtataccgaatgcttgtacagaatgatataaccagctataagtttaaaagcttaaagcactgtgtgagtgctggggaaccaattacccctgacgtgactgaaaaatggagaaacaagacgggcctggatatctacgaaggatatggacagactgaaacggtgctaatctgtggaaattttaagggaatgaaaattaaacctggctcaatgggaaaaccttctcctgctttcgatgttaagattgtagatgtaaatggcaatgttctacctcctggacaagaaggagatattggcattcaagttctacccaaccgaccatttggcctttttactcattacgtagataatccttcaaaaacagcttcaactctacgaggcaatttctatatcactggggacagaggatatatggataaagatgggtatttctggtttgttgcaagagcagatgatgtcatattatcctctggctatcgaattggaccatttgaggtagaaaatgccctgaatgaacacccttcagttgcagagtcagctgttgtcagcagcccagaccccatcagaggagaggtagtaaaggcttttgtcgttctaaatcctgattacaagtcacatgatcaagaacaactaataaaggagattcaggagcatgttaaaaaaactacagcaccttacaaatatcccagaaaggtagaatttattcaagagctgccaaagactatcagtgggaagacaaaaagaaatgaactgaggaagaaagaatggaagacaatttaaagttgtttcattaattaccatatctataaaacaaacatagtatctgtcaatctctagaaaccacaagatgatggagaggtcataaaaactgtggtagtatgcttagaaactgttgatttaaaatatcttgtggttatgatatcagaggctaaattttgaaataaaatatttggcaaattcctcc

SEQ ID NO: 104475 - DNA, 558 bp, Homo sapiens
  Payload ID: 512
  Gene Symbol: ACSM3
  Gene Name: acyl-CoA synthetase medium-chain family member 3
  ENST ID: ENST00000568235
  CDS Start-End: 258-558
gttgaaaggctggcttagaggcaggctgagaggatggctggattagaggcttgctgagatgctgactggtgtcagagccagaggagaagagtggacaacccaactgcccaccacaggtccctagaagtacaggtcaagcctatgctggggagaggcaaacagtttcctggtacatagccgctaaaacccctggaatttctgaagtgatgaactggtctctgtgcaaatcctgagtgctaaagcttccaacaagactgatgctagctcgtgtcaccaggaagatgctacgtcatgccaagtgttttcagcgcctagcaatttttggttctgtgagggcactgcataaagataatagaacagcaacccctcagaatttctccaactatgaatccatgaaacaggacttcaaactggggattccagagtatttcaactttgctaaagatgtcctggaccaatggactgataaggaaaaggctggaaagaaaccttcaaatccagccttctggtggatcaacagaaatggagaagagatgcgatggagttttgaggaactgg

SEQ ID NO: 104476 - DNA, 756 bp, Homo sapiens
  Payload ID: 512
  Gene Symbol: ACSM3
  Gene Name: acyl-CoA synthetase medium-chain family member 3
  ENST ID: ENST00000564701
  CDS Start-End: 682-756
cctgcttctcagcttatgttagaagcctgggaaaggggagaagagtattttcaccccctttgctgtcagggttaccaagggaatcccctgtgaaggtgagaggtggttctaagaagagactggcatcacattccttggttgatattcccctctgcctggctgagtgagaaactgagccagaaagagaagtagagacagatggcaaggcagagacagtagagcaggggtggaggacagcagaggagaagcctgaagcataagatagggtgttgcaagtatatgtgcatatctggtacatcaaatggatcttcagaagttgcctgggcttgaccaggtagacccaacagacagaggatgaaagtcacacccagcatagtaagccctctaactccaatcttgtttcctcgccctcaacaatggaggctccagagtgtaaaagaaggagaagggaaaggtgtcagtgacaaataaggccatgtgtctctattccaggtgtcagagccagaggagaagagtggacaacccaactgcccaccacaggtccctagaagtacaggtcaagcctatgctggggagaggcaaacagtttcctggtacatagccgctaaaacccctggaatttctgaagtgatgaactggtctctgtgcaaatcctgagtgctaaagcttccaacaagactgatgctagctcgtgtcaccaggaagatgctacgtcatgccaagtgttttcagcgcctagcaatttttggttctgtg

SEQ ID NO: 104477 - DNA, 405 bp, Homo sapiens
  Payload ID: 512
  Gene Symbol: ACSM3
  Gene Name: acyl-CoA synthetase medium-chain family member 3
  ENST ID: ENST00000569141
  CDS Start-End: 1-405
aaaatggagaaacaagacgggcctggatatctacgaaggatatggacagactgaaacggtgctaatctgtggaaattttaagggaatgaaaattaaacctggctcaatgggaaaaccttctcctgctttcgatgttaagattgtagatgtaaatggcaatgttctacctcctggacaagaaggagatattggcattcaagttctacccaaccgaccatttggcctttttactcattacgtagtagtaaaggcttttgtcgttctaaatcctgattacaagtcacatgatcaagaacaactaataaaggagattcaggagcatgttaaaaaaactacagcaccttacaaatatcccagaaaggtagaatttattcaagagctgccaaagactatcagtgggaagac

SEQ ID NO: 104478 - DNA, 771 bp, Homo sapiens
  Payload ID: 512
  Gene Symbol: ACSM3
  Gene Name: acyl-CoA synthetase medium-chain family member 3
  ENST ID: ENST00000563914
  CDS Start-End: 1-706
cagcctcctgagtagctgggattacagacatgccagtgacagccacacctgtgtgaagacaaaacacaatgagatcatggccatattctttaccagtggaacaagtggatatccgaaaatgactgcacacacccacagcagttttggtttaggattatctgtaaatggaaggttctggctagatttgacaccctcagatgtgatgtggaatacctcagatacgggctgggcaaagtctgcatggagtagtgttttttctccgtggatccagggagcatgtgtattcacacaccatttaccccgttttgagccgacttctatcttgcaaacactctccaagtaccccatcacagtcttctgttcagcaccaactgtataccgaatgcttgtacagaatgatataaccagctataagtttaaaagcttaaagcactgtgtgagtgctggggaaccaattacccctgacgtgactgaaaaatggagaaacaagacgggcctggatatctacgaaggatatggacagactgaaacggtgctaatctgtggaaattttaagggaatgaaaattaaacctggctcaatgggaaaaccttctcctgctttcgatgttaaggtttgcacatccccttccaggagaatgtttaacaacccaatctgtacactacctacctaccgcttacccccatataaactttctttgttatgatggtgattccattttacttccatgatactttaatttttataaatatgtgaaaatgattagaaatg

SEQ ID NO: 104479 - DNA, 580 bp, Homo sapiens
  Payload ID: 512
  Gene Symbol: ACSM3
  Gene Name: acyl-CoA synthetase medium-chain family member 3
  ENST ID: ENST00000561795
  CDS Start-End: 106-580
actgcactccagcctgggtgacagaacaagactccatctcaaaaaaaagaccagatgaactggtctctgtgcaaatcctgagtgctaaagcttccaacaagactgatgctagctcgtgtcaccaggaagatgctacgtcatgccaagtgttttcagcgcctagcaatttttggttctgtgagggcactgcataaagataatagaacagcaacccctcagaatttctccaactatgaatccatgaaacaggacttcaaactggggattccagagtatttcaactttgctaaagatgtcctggaccaatggactgataaggaaaaggctggaaagaaaccttcaaatccagccttctggtggatcaacagaaatggagaagagatgcgatggagttttgaggaactgggatctctgtccagaaaatttgccaatatactttcagaagcctgttccctacaaagaggagatcgggtaattctgattctgcccagggtcccagagtggtggcttgcaaatgtggcctgtctgcgaacagggacagttttaattccaggaaccactcagctgacccagaaagaca

SEQ ID NO: 104480 - DNA, 2142 bp, Homo sapiens
  Payload ID: 513
  Gene Symbol: ACSM4
  Gene Name: acyl-CoA synthetase medium-chain family member 4
  Uniprot ID: P0C7M7
  ENST ID: ENST00000399422
  CDS Start-End: 49-1791
ctgtagtacttctgtgtccatagcagtagacaaagtcctttgggaaccatgaagatttttttccgctaccagacatttagattcatctggctcaccaagccacctggccggcgcttacacaaagatcaccagctttggacgcctctgactcttgctgactttgaagccataaatcgctgtaacaggccattgcctaaaaactttaactttgctgcagatgtgctggaccagtggtcccaaaaggagaagacaggggagagaccagctaacccagccctgtggtgggtgaatggcaaaggggatgaggtaaaatggagcttcagagaactgggctccttgtcccgaaaagctgccaacgtgctcaccaagccctgtggcctgcagagaggagaccgtttggccgtgattctgcccagaatccctgagtggtggctggtcaatgtagcttgcatacgaacagggatcatcttcatgccgggaacaatccagctgacagcaaaagacatcctctaccggctgcgagcatccaaggccaagtgcattgtggccagtgaggaggtggccccagcggtggagtccattgtattggagtgtcctgaccttaagacaaaactcctggtgtctccacaaagctggaatgggtggctcagcttccaggagttatttcaattcgcctctgaagagcacagctgtgtggaaacaggaagtcaagaaccaatgaccatttatttcaccagtgggaccacaggctttcctaaaatggcccagcactctcagagcagcctcggcattgggttcaccctctgcggaaggtattggctggacttgaagtcctcagatatcatatggaatatgtctgacacgggctgggtcaaggccgccattggcagtgtgttttcttcctggctgtgtggagcctgtgtttttgtgcatcgaatggcacagtttgacactgacaccttcctagacacacttactacttatcccatcacgaccctgtgcagtcctcccactgtgtaccggatgctcgtgcaaaaagaccttaagagatataaattcaagagtctgcggcactgcttgaccggaggggagccactcaacccagaagtgctggagcagtggagggtgcaaactgggctggagctatatgagggctatggacagacggaagtgggaatgatttgtgccaatcagaaaggccaagaaattaaaccaggttcaatggggaaaggaatgctgccctatgatgtccagattatagatgaaaatggcaatgttctaccacctggcaaagaaggggaaattgccctcagactcaaacctacacggcccttctgtttcttctctaaatatgtggacaatccacagaaaactgctgccacgataagaggagatttttatgtcactggagacagaggagtgatggacagtgatgggtatttctggtttgtcggcagagctgatgatgtcattatatcctctgggtaccgtattgggccatttgaagtggagagtgcactcattgagcatccagcagttgttgaatcggctgttgtcagtagtccagatcaaatccgcggagaggtggtgaaagcttttgttgtcttagctgcaccctttaagtcctacaacccagagaaattaactcttgaacttcaggatcatgtgaaaaaatcaactgcaccttacaaatatccaagaaaggtggaatttgttcaagaactcccaaagacaatcactgggaaaatcaaacgcaacgttttaagagaccaagaatggagaggaagatagtttgataacaaagctgaagggttaagcagtaatatggttgctttcttttagtatttgttccgataattcagcgactactctcttaaaatgtttaagatctttcctgcttgaaaactcaactgttgattttttggtttttacttagctaaaaagtttaaaagtaaataaaagcctcaaaaacgtatggatgaaaattgttataatgaccaaactgacaaaggtaatgatgatgatttgtagtgtttaaaatagcaggaataaaatgattgcttagaacaagaaagtgcacattgaatctgtatttcatttaccttgtgcctgattgattcaaaataaacatatatcctaaga

SEQ ID NO: 104481 - DNA, 2796 bp, Homo sapiens
  Payload ID: 514
  Gene Symbol: ACSM5
  Gene Name: acyl-CoA synthetase medium-chain family member 5
  Uniprot ID: Q6NUN0
  ENST ID: ENST00000331849
  CDS Start-End: 148-1887
gcatttggggctgaagttccctgtgggaggctgttttctgagggagctgagtgtttacagccactcagccctgctctgctcagctgaagcagaaaacagagaccttttgcattactttggttcaagagcaagacaggaggcgactgcatgagaccatggctgagacacctagtcctccaggcactgaggaactccagggcattctgtgggtctcatgggaagccagcacctctacctgttcctcagaagatcgtggccacctgggaagccatcagcctgggaaggcagctggtgcctgagtacttcaacttcgcccatgatgtgctggatgtgtggagtcggctggaagaggctggacaccgccccccaaatcctgccttctggtgggtcaatggcacaggagcagagatcaagtggagctttgaggagctggggaagcagtccaggaaggcagccaatgtgctggggggtgcatgcggcctgcagcctggggacagaatgatgctggtactcccacggctcccggagtggtggctggtcagtgtggcttgcatgcggacagggactgtgatgattccgggtgtgactcagctgacagagaaggacctcaagtaccggctgcaggcgtccagggccaagtccattatcaccagtgactccctagctccaagggtggatgccatcagtgccgaatgcccctccctccagaccaagctgctggtgtcagacagcagtcggccaggctggttgaacttcagggaactcctccgggaggcttctacagagcacaactgcatgaggacaaagagtcgagacccgctggccatctactttaccagcggaaccaccggggcccccaagatggtcgagcactcccagagcagctacggactgggttttgtggccagcggaagacggtgggtggccttgaccgaatctgacatcttctggaacacgactgacactggctgggtgaaggcagcctggactctcttctctgcctggcctaatggatcttgcatttttgtgcatgagctgccccgagttgatgccaaagttatcctgaatactctctccaaattcccgataaccaccctctgctgtgtcccaaccatctttcggctgcttgtgcaggaggatctgaccaggtaccagtttcagagcctgaggcactgtctgaccggaggagaggccctcaaccctgacgtgagggagaagtggaaacaccagactggtgtggagctgtacgaaggctatggccagtctgaaacggttgtcatctgtgccaatccaaaaggcatgaaaatcaagtctggatccatggggaaggcgtccccaccctacgatgtgcagattgtggatgatgagggcaacgtcctgcctcctggagaagaggggaatgttgccgtccgtatcagacccactcggcccttctgtttcttcaattgctatttggacaatcctgagaagacagctgcatcagaacaaggggacttttacatcacaggggaccgagctcgcatggacaaggatggctacttttggttcatgggaagaaacgacgatgtgatcaattcttcaagctaccggatcgggcctgttgaagtggaaagtgccctggcagagcatcctgctgtcctggagtcggctgtggtcagcagcccagaccccatcaggggagaggtggtaaaggcatttatagtccttactccagcctactcctctcatgacccagaggcactaacgcgggaactccaggagcatgtgaaaagggtgactgctccatacaaataccccaggaaggtggcctttgtttcagaactgccaaagacggtttctggaaagatccaaaggagtaaattgcgaagtcaggagtgggggaaatgaggtgcaccccaggaaggccccgtagacctccgaagactccacaagaaactaatggatcactggtcagtccccatggggagcatcatctcttcgaccctaaagatgtcaaaggtgtgcagcttccaaacggcatccccaggatcactgggcaatgctggaaagagcaaaagaatatcattggccctgatcacatagatgctgcgccgcctagcaaatgcttggtggttcgacttctccctctgtctgggggcaggctcagcatctgcccactggtctcactaagagctttcagatttccctccataggacaggttaccatagacttggggcacttgtgggtactcattttctgccagtgggaatgtaaaggcttcatcctttgtatgtaaccatttggcaaaagtatgcaggaacataaaataaaatatcctttagctcagaaattctatcttcgggagtcaccacaaaagaaaaaaatcaaaatgcagaaaatgtgtggtgcactaagatgatcacacagcattaaaactaaaaaaaaaaaagaaaaaattaacaattaacatccaaacaacaaggaaatgattaacaaaattgtagtagattaactcaattacatatgatgtagccactaaaatatttgagagcagtttagtatgtcttgggaaaagtgtaagctatattaattttaaaaatcagagcaaaaatattcatactggagaatcccaactctgaaaaataaagggaaaactgtggttaattgtaatcctcctggagattgaggagggagggagagaaaataatggatggtagtttttcttcttcctttttccattacatttctgtattttccaagtttttgtacgaagcacatacaactattttaatgaaaaagttatgttaaagaaagca

SEQ ID NO: 104482 - DNA, 1130 bp, Homo sapiens
  Payload ID: 514
  Gene Symbol: ACSM5
  Gene Name: acyl-CoA synthetase medium-chain family member 5
  Uniprot ID: Q6NUN0
  ENST ID: ENST00000575584
  CDS Start-End: 148-774
gcatttggggctgaagttccctgtgggaggctgttttctgagggagctgagtgtttacagccactcagccctgctctgctcagctgaagcagaaaacagagaccttttgcattactttggttcaagagcaagacaggaggcgactgcatgagaccatggctgagacacctagtcctccaggcactgaggaactccagggcattctgtgggtctcatgggaagccagcacctctacctgttcctcagaagatcgtggccacctgggaagccatcagcctgggaaggcagctggtgcctgagtacttcaacttcgcccatgatgtgctggatgtgtggagtcggctggaagaggctggacaccgccccccaaatcctgccttctggtgggtcaatggcacaggagcagagatcaagtggagctttgaggagctggggaagcagtccaggaaggcagccaatgtgctggggggtgcatgcggcctgcagcctggggacagaatgatgctggtactcccacggctcccggagtggtggctggtcagtgtggcttgcatgcggacagggactgtgatgattccgggtgtgactcagctgacagagaaggacctcaagtaccggctgcaggcgtccagggccaagtccattatcaccagtgactccctagctccaagggtggatgccatcagtgccgaatgcccctccctccagaccaagctgctggtgtcagacagcagtcggccaggctggttgaacttcagggaactcctccggtgaattggggctctccagaacagcagaaaaatgaagtcatttcccctttaagcaacaaaagatgaaatgcattgctgattccacacatagagagcgaatcagagaggagcactcccattggcagccaggctgacctgagcataatcctggtccctaccttaatgttcaaggtccctcattcagtcagtgctggatttgtcagcagcttttctgtgcttcatttgcttctataatgcggtggtagttattagagctaccattcagagtacatgaaataaccaatatggtgcatttagcacatagcaggtggtcagttaataataaactagtggccatgtattgggtacttagtgtatcgc

SEQ ID NO: 104483 - DNA, 457 bp, Homo sapiens
  Payload ID: 514
  Gene Symbol: ACSM5
  Gene Name: acyl-CoA synthetase medium-chain family member 5
  ENST ID: ENST00000573920
  CDS Start-End: 1-339
cacaactgcatgaggacaaagagtcgagacccgctggccatctactttaccagcggaaccaccggggcccccaagatggtcgagcactcccagagcagctacggactgggttttgtggccagcggaagacggtgggtggccttgaccgaatctgacatcttctggaacacgactgacactggctgggtgaaggcagcctggactctcttctctgcctggcctaatggatcttgcatttttgtgcatgagctgccccgagttgatgccaaagttatcctgaatgtaccagtttcagagcctgaggcactgtctgaccggaggagaggccctcaaccctgacgtgagggagaagtggaaacaccagactggtgtggagctgtacgaaggctatggccagtctgaaacggttgtcatctgtgccaatccaaaaggcatgaaaatcaagtctggatccatg

SEQ ID NO: 104484 - DNA, 856 bp, Homo sapiens
  Payload ID: 514
  Gene Symbol: ACSM5
  Gene Name: acyl-CoA synthetase medium-chain family member 5
  ENST ID: ENST00000575070
  CDS Start-End: 136-360
gaagttccctgtgggaggctgttttctgagggagctgagtgtttacagccactcagccctgctctgctcagctgaagcagaaaacagagaccttttgcattactttggttcaagagcaagacaggaggcgactgcatgagaccatggctgagacacctagtcctccaggcactgaggaactccagggcattctgtgggtctcatgggaagccagcacctctacctgttcctcagaagatcgtggccacctgggaagccatcagcctgggaaggcagctggtgcctgagtacttcaacttcgcccatgatgtgctggatgtgtggagtcggctggaagaggtgaagcctgttctgtcctagagtccatctggggcatctgaggctgccctcatgtaccacaatgagactcaaggctccaagcatgttgatgaggaaatttggacctgggaattttgctagttctaaaatgtaaactgttggcatttgagacttaggaaaaaattctgagtcagtgttgtgagccttagacatgcttgttccttctctgaagtgtcctgcattcttgagcccaaatcacacagtgagacagttatgtcccttccgattcccttccagttgttcatcaactgaaggaggaagttttgttttgctgctactctgtctttgatgtttttctctcactgtcacgcccttctcttctaaataaggaaagaaggccgggcgcggtggctcatgaccataatcccagcactttgggacaccgagaagggcagatcacctgaggtcaggagttcgagaccaccctcaccaacatggtgaaactccgtctctactaaaaataaaataaaaaaaaatt

SEQ ID NO: 104485 - DNA, 2307 bp, Homo sapiens
  Payload ID: 515
  Gene Symbol: ACSM6
  Gene Name: acyl-CoA synthetase medium-chain family member 6
  ENST ID: ENST00000327739
  CDS Start-End: 126-551
aactaaactataagaggtaagcagttctcagaggagacagaaggcaacagctctaccatcctccaaacatctgaagccccccatagaaactcctcttggaattggtggttccctgtctgacccaaatgctaggccgatttcaacccttctccttggtccggagtttcagactgggatttgaagcctgctgctatccaaaccaaaaatgtgctactcagaccatcagaccccctgactccaggtgcctagtccaagcagtttctcagaactttaattttgcaaaggatgtgttggatcagtggtcccagctggaaaaggacggactcagagggccttaccccgccctctggaaggttagtgccaaaggagaagaggacaaatggagctttgaaaggatgactcaactctccaagaaggccgccagcatcctctcagacacctgtgcccttagccatggagaccggctgatgataatcttgcccccaacacctgaagcctactggatctgcctggcctgtgaatcacctttgtgcctgggagcccccagctgactgccaagaaaattcgctatcaattacgcatgtctaaggcccagtgcattgtggctaatgaagctatggccccagttgtaaactctgccgtgtccgactgccccaccttgaaaaccaagctcctggtgtcagataagagctatgatgggtggttggatttcaagaagttgattcaagttgcccctccaaagcagacctacatgaggaccaaaagccaagatccaatggccatattcttcaccaagggtacaacaggagctcccaaaatggtcgagtattcccagtatggtttgggaatgggattcagccaggcttccagacggtggatggatctccagccaacagatgtcttgtggagtctgggtgatgcctttggtggatctttatccctgagcgctgtcttgggaacttggttccaaggagcctgtgtgtttctgtgtcacatgccaaccttctgccctgagactgttctaaatgtcctgtccagatttcccatcaccactctatctgcaaatccagagatgtaccaggaactgcttcagcacaagtgtttcaccagggtctactctgtgccacttccaaaacaataaaattgaagccaagctctctggggaagccattgccaccttatattgtccagattgtggatgaaaactcaaatctcctgcctccaggggaagaaggaaatattgcaatccgcataaaactaaaccaacctgcttctctgtactgtccacacatggtaagaaaattttcttctttcctaaatactttcattgttgctactaatcgtagtgccattattgttgagtactttatgatttgccaaatacttttgtcccaatttttaattttgcaaatttttgagtctccaaaaatgttaaatagtagcactcacctacattcacttcttattaagattttgccccatttacttcatatttgcacatttttgatgagacatttgggagtaaatgcagacattatgacactttgtccttaaatatttcagcagcatcctcctaataaggactttcttcttaaacatcagcaccatcacatctatgaaaattaaaaataattatttaatactatctaatatctagccaatacttagactttctcaattgtactcagatgtgttttataccttttgtaaatccagaattcaatcaaagttcatgcatttatttggttctcatatctctttagttgtttttatctataactgttccaccaccatgtttttcgtgacgtggacattttgaagaatagaggacggttgtgttaaaaaatgcctcactttctaggcttacatattgtttctttataatgagatccaggataaacatctttctcaagactattatgtagatgatgtatatttcttatttgcttatggggggaaacattaggttgtctcattttggatgctgatcattttgatcttttgattaaggaggtgagtgccatttccattgtaaaggtacattttcctctttgtaattagtaataatctgccgtgtaacaatttgagactctgtaaatatcctattctccaattaactttcacccaatcattttagcatccatagatgattcttttctttttggaaacaattattaaaataaagagtggctgggcacagtggctcatgcctgtaatctcaacactttgggaagctaagatggacagatcacttgagcccaggggttcaagactagcctgggcaacatggcaaaactccatctctac

SEQ ID NO: 104486 - DNA, 1712 bp, Homo sapiens
  Payload ID: 515
  Gene Symbol: ACSM6
  Gene Name: acyl-CoA synthetase medium-chain family member 6
  Uniprot ID: Q6P461
  ENST ID: ENST00000341686
  CDS Start-End: 126-1568
aactaaactataagaggtaagcagttctcagaggagacagaaggcaacagctctaccatcctccaaacatctgaagccccccatagaaactcctcttggaattggtggttccctgtctgacccaaatgctaggccgatttcaacccttctccttggtccggagtttcagactgggatttgaagcctgctgctatccaaaccaaaaatgtgctactcagaccatcagaccccctgactccaggtgcctagtccaagcagtttctcagaactttaattttgcaaaggatgtgttggatcagtggtcccagctggaaaaggacggactcagagggccttaccccgccctctggaaggttagtgccaaaggagaagaggacaaatggagctttgaaaggatgactcaactctccaagaaggccgccagcatcctctcagacacctgtgcccttagccatggagaccggctgatgataatcttgcccccaacacctgaagcctactggatctgcctggcctgtgtgcgcttgggaatcacctttgtgcctgggagcccccagctgactgccaagaaaattcgctatcaattacgcatgtctaaggcccagtgcattgtggctaatgaagctatggccccagttgtaaactctgccgtgtccgactgccccaccttgaaaaccaagctcctggtgtcagataagagctatgatgggtggttggatttcaagaagttgattcaagttgcccctccaaagcagacctacatgaggaccaaaagccaagatccaatggccatattcttcaccaagggtacaacaggagctcccaaaatggtcgagtattcccagtatggtttgggaatgggattcagccaggcttccagacggtggatggatctccagccaacagatgtcttgtggagtctgggtgatgcctttggtggatctttatccctgagcgctgtcttgggaacttggttccaaggagcctgtgtgtttctgtgtcacatgccaaccttctgccctgagactgttctaaatgtcctgtccagatttcccatcaccactctatctgcaaatccagagatgtaccaggaactgcttcagcacaagtgtttcaccagctacagattcaagagtctgaagcagtgtgtggctgcaggaggacccatcagccctggggtgattgaggactggaaacgcatcactaagttggacatctatgaaggctatgggcagacggaaactggtctactctgtgccacttccaaaacaataaaattgaagccaagctctctggggaagccattgccaccttatattgtccagattgtggatgaaaactcaaatctcctgcctccaggggaagaaggaaatattgcaatccgcataaaactaaaccaacctgcttctctgtactgtccacacatggtgagctgggaggaatatgcttcagcaagaggccacatgctttacctcacaggtgacagagggatcatggatgaagacggctacttctggtggtctggtagagttgatgatgttgccaatgcattgggtcagagattgtgaatgctttggttattgctattgagcctggggctgtgggagtttgaagaagactctggactgcttccaatacgtaggaattatatttctaaagtttagaaaatgcaaacaaccaaaaataaaaaaataaaactcatccataatctc

SEQ ID NO: 104487 - DNA, 1592 bp, Homo sapiens
  Payload ID: 515
  Gene Symbol: ACSM6
  Gene Name: acyl-CoA synthetase medium-chain family member 6
  Uniprot ID: Q6P461
  ENST ID: ENST00000394005
  CDS Start-End: 10-1452
ctgacccaaatgctaggccgatttcaacccttctccttggtccggagtttcagactgggatttgaagcctgctgctatccaaaccaaaaatgtgctactcagaccatcagaccccctgactccaggtgcctagtccaagcagtttctcagaactttaattttgcaaaggatgtgttggatcagtggtcccagctggaaaaggacggactcagagggccttaccccgccctctggaaggttagtgccaaaggagaagaggacaaatggagctttgaaaggatgactcaactctccaagaaggccgccagcatcctctcagacacctgtgcccttagccatggagaccggctgatgataatcttgcccccaacacctgaagcctactggatctgcctggcctgtgtgcgcttgggaatcacctttgtgcctgggagcccccagctgactgccaagaaaattcgctatcaattacgcatgtctaaggcccagtgcattgtggctaatgaagctatggccccagttgtaaactctgccgtgtccgactgccccaccttgaaaaccaagctcctggtgtcagataagagctatgatgggtggttggatttcaagaagttgattcaagttgcccctccaaagcagacctacatgaggaccaaaagccaagatccaatggccatattcttcaccaagggtacaacaggagctcccaaaatggtcgagtattcccagtatggtttgggaatgggattcagccaggcttccagacggtggatggatctccagccaacagatgtcttgtggagtctgggtgatgcctttggtggatctttatccctgagcgctgtcttgggaacttggttccaaggagcctgtgtgtttctgtgtcacatgccaaccttctgccctgagactgttctaaatgtcctgtccagatttcccatcaccactctatctgcaaatccagagatgtaccaggaactgcttcagcacaagtgtttcaccagctacagattcaagagtctgaagcagtgtgtggctgcaggaggacccatcagccctggggtgattgaggactggaaacgcatcactaagttggacatctatgaaggctatgggcagacggaaactggtctactctgtgccacttccaaaacaataaaattgaagccaagctctctggggaagccattgccaccttatattgtccagattgtggatgaaaactcaaatctcctgcctccaggggaagaaggaaatattgcaatccgcataaaactaaaccaacctgcttctctgtactgtccacacatggtgagctgggaggaatatgcttcagcaagaggccacatgctttacctcacaggtgacagagggatcatggatgaagacggctacttctggtggtctggtagagttgatgatgttgccaatgcattgggtcagagattgtgaatgctttggttattgctattgagcctggggctgtgggagtttgaagaagactctggactgcttccaatacgtaggaattatatttctaaagtttagaaaatgcaaacaaccaaaaataaaaaaataaaactcatccataa

SEQ ID NO: 104488 - DNA, 1336 bp, Homo sapiens
  Payload ID: 515
  Gene Symbol: ACSM6
  Gene Name: acyl-CoA synthetase medium-chain family member 6
  ENST ID: ENST00000404473
  CDS Start-End: 10-267
ctgacccaaatgctaggccgatttcaacccttctccttggtccggagtttcagactgggatttgaagcctgctgctatccaaaccaaaaatgtgctactcagaccatcagaccccctgactccaggtgcctagtccaagcagtttctcagaactttaattttgcaaaggatgtgttggatcagtggtcccagctggaaaaggataatggccttcagctccatccatgttgctgcaaaagacaggatttcattcttttccatggctgagtaatattccatgttgacggactcagagggccttaccccgccctctggaaggttagtgccaaaggagaagaggacaaatggagctttgaaaggatgactcaactctccaagaaggccgccagcatcctctcagacacctgtgcccttagccatggagaccggctgatgataatcttgcccccaacacctgaagcctactggatctgcctggcctgtgtgcgcttgggaatcacctttgtgcctgggagcccccagctgactgccaagaaaattcgctatcaattacgcatgtctaaggcccagtgcattgtggctaatgaagctatggccccagttgtaaactctgccgtgtccgactgccccaccttgaaaaccaagctcctggtgtcagataagagctatgatgggtggttggatttcaagaagttgattcaagttgcccctccaaagcagacctacatgaggaccaaaagccaagatccaatggccatattcttcaccaagggtacaacaggagctcccaaaatggtcgagtattcccagtatggtttgggaatgggattcagccaggcttccagacggtggatggatctccagccaacagatgtcttgtggagtctgggtgatgcctttggtggatctttatccctgagcgctgtcttgggaacttggttccaaggagcctgtgtgtttctgtgtcacatgccaaccttctgccctgagactgttctaaatgtcctgtccagatttcccatcaccactctatctgcaaatccagagatgtaccaggaactgcttcagcacaagtgtttcaccagctacagattcaagagtctgaagcagtgtgtggctgcaggaggacccatcagccctggggtgattgaggactggaaacgcatcactaagttggacatctatgaaggctatgggcagacggaaactggtctactctgtgccacttccaaaacaataaaattgaagccaagctctctggggaagccattgccaccttatattgtccagattgtggatgaaaactcaaatctcctgcctccaggggaagaaggaa

SEQ ID NO: 104489 - DNA, 3680 bp, Homo sapiens
  Payload ID: 516
  Gene Symbol: ACSS1
  Gene Name: acyl-CoA synthetase short-chain family member 1
  Uniprot ID: Q9NUB1
  ENST ID: ENST00000323482
  CDS Start-End: 81-2150
ggcccgcggagactccacggggcgccccgggcgtgaggcacccactctgggagcacagagagctcaggtagcctgcctagatggcggcgcgcaccctgggccgcggcgtcgggaggctgctgggcagcctgcgagggctctcggggcagcccgcgcggccgccgtgcggggtgagcgcgccgcgcagggcggcctcgggaccctcgggcagcgctcccgcagttgcagcagcagcagcacagccaggctcgtatcccgcgctgagtgcacaggcagcccgggagccggccgccttctgggggcctctggcgcgggacactctcgtgtgggacaccccctaccacaccgtctgggactgcgacttcagcactggcaagatcggctggttcctgggaggccagttaaatgtctctgtcaactgcttggaccagcatgttcggaagtcccccgagagcgttgctttgatctgggagcgcgatgagcctggaacggaagtgaggatcacctacagggaactactggagaccacgtgccgcctggccaacacgctgaagaggcatggagtccaccgtggggaccgtgttgccatctacatgcccgtgtccccattggctgtggcagcaatgctggcctgtgccaggatcggagctgtccacacagtcatctttgctggcttcagtgcagagtccttggctgggaggatcaatgatgccaagtgcaaggtggttatcaccttcaaccaaggactccggggtgggcgcgtggtggagctgaagaaaatagtggatgaggctgtgaagcactgccccaccgtgcagcatgtcctggtggctcacaggacagacaacaaggtccacatgggggatctggacgtcccgctggagcaggaaatggccaaggaggaccctgtttgcgccccagagagcatgggcagtgaggacatgctcttcatgctgtacacctcagggagcaccggaatgcccaagggcatcgtccatacccaggcaggctacctgctctatgccgccctgactcacaagcttgtgtttgaccaccagccaggtgacatctttggctgtgtggccgacatcggttggattacaggacacagctacgtggtgtatgggcctctctgcaatggtgccaccagcgtcctttttgagagcaccccagtttatcccaatgctggtcggtactgggagacagtagagaggttgaagatcaatcagttctatggcgccccaacggctgtccggctgttgctgaaatacggtgatgcctgggtgaagaagtatgatcgctcctccctgcggaccctggggtcagtgggagagcccatcaactgtgaggcctgggagtggcttcacagggtggtgggggacagcaggtgcacgctggtggacacctggtggcagacagaaacaggtggcatctgcatcgcaccacggccctcggaagaaggggcggaaatcctccctgccatggcgatgaggcccttctttggcatcgtccccgtcctcatggatgagaagggcagcgtcgtggagggcagcaacgtctccggggccctgtgcatctcccaggcctggccgggcatggccaggaccatctatggcgaccaccagcgatttgtggacgcctacttcaaggcctacccaggctattacttcactggagacggggcttaccgaactgagggcggctattaccagatcacagggcggatggatgatgtcatcaacatcagtggccaccggctggggaccgcagagattgaggacgccatcgccgaccaccctgcagtaccagaaagtgctgtcattggctacccccacgacatcaaaggagaagctgcctttgccttcattgtggtgaaagatagtgcgggtgactcagatgtggtggtgcaggagctcaagtccatggtggccaccaagatcgccaaatatgctgtgcctgatgagatcctggtggtgaaacgtcttccaaaaaccaggtctgggaaggtcatgcggcggctcctgaggaagatcatcactagtgaggcccaggagctgggagacactaccaccttggaggaccccagcatcatcgcagagatcctgagtgtctaccagaagtgcaaggacaagcaggctgctgctaagtgagctggcaccttgtggggctcttgggatgggcgggcacccaagccctggcttgtccttcccagaaggtacccctgaggttggcgtcttcctacgtcccagaagcagcccccaccccacacatgacccacaccgccctcacgtgaagctgggctgagagccctttctcccatccattggaggtcccaggagtgtcacccatggagaggctatgcgacatggctagggctggttctgccatctgagtttggtttcctggaatgaaaaggcattgccatctccattcctctgccctcttgagccagcacaggaaggtgaggccctgggatagcgcgcctgctcagataacacagagctagttagctagtagcaaccgtgttttctccagatctgtctagatacaaaggtcagaaatcttatttttatacttttatattgtggaagaacagcatgcaacactcacatgtagtgtgtggatttacttgaacatgttctttttaacatgtagttatgaaaatctccttttttgcctctactggtgaggaaacatgaggatcagaggccacatttttaattattgttagtgtatttggaagtctgaattggagatgtttgtacctctgtctaaacagttcccttgagaacttccaagcctccggcatcttttcctggtgagtgtttctcctgtgcttggttgtgtataatggagctaactcctaagcggtggggtgaatgtggccgccttagttctgaagctactccagttatgttctgtttcttcaagctgtgatccagaaagatttttgtgcccccagatgcctcttgataggagaggcaacatactccaaatagttgggttcttcagggaagctattagaaactcaggtgacttgttagagcactaacttggtcagagccaaatcctggcaaacgctgcctgaccttcactctgtggttggggcggtgagaaccactgaggtccaatgatgagacttggaggtctggatccagtctctctttgttttaatgtgacttaggtgctgtcaacattagcaagataatggaaatcacgacgccagtgggtgcttacctccctgctaggcatgcaggggctggcggttggcaggggaaggaggcccagtgagccgggtcccttaggggagggagagtttgtcctctttgccccacagtctacccttcagggccttgtggcagtgccagtgttcggggggtgtctgggccactgagtacccactcggtcgtggttgtgctggcctcttgggtgagtgaacctgtgaagcccaggaggtggtgttggctgcagggtacacaaatactgagtggtggtcttttgttacaggcttagcaacaaagctgtgccctgggcatggggggctgtagtgtagctacagttgtgcgtttgtgaaatggcttagctttccatgttgctgagaggaacctggacatggtcccgggcatctgaatgatctgtaggggagggagttcaaataaagctttattttgttcattttc

SEQ ID NO: 104490 - DNA, 2244 bp, Homo sapiens
  Payload ID: 516
  Gene Symbol: ACSS1
  Gene Name: acyl-CoA synthetase short-chain family member 1
  ENST ID: ENST00000376726
  CDS Start-End: 879-1340
aaaaggaaaacgaggcaccgagaagttaaggaacttgctcaaggtcacagagtttgaactcaggctacagatgctgcagcaactggagaaagtcctcatcgccccatatcacccaccaccgacccccagcaggacgtgacccccgccaggacggaggccggcagctggggggctggagcatgggacccagaacacggactcaggcttgcgcagcctcctggcttctaggcgggagcctagaaaggcgccagcccctttcgcgtgctgctgagactccaggggtggggttcactctcaggggcgcacaaaggcatgaaaaccttggcttcagcctctgagatgcggaactgaccgacctattgtcttgggacccaccagtgcgcttgggtgcaccagcccccttaacgttggtgccggctccctcccggctcctccccatcccagagggtcccctcgccccaggccctgagcctgcgtcctggggtcctgggccgcacgtgcctctggcagctcgaagaagctgtcggggcttgcaggagagcgtgcaaactgaaaccaaaacaggccgactcgaggaacatccgggtgggaccgcagactcaccggagcgcagcgcctgggccagggcctgggaccctgctccgccccgcgctcccctgcaccccttccccacgctgctcccctcttcctaagcggccccccctctcccgggcagcagaagaaggggtgggacccgggcgggctccgggagggggccctggaggaatggatggtggcggaagggcggagcaggggcggggcccgcggagactccacggggcgccccgggcgtgaggcacccactctgggagcacagagagctcaggtagcctgcctagatggcggcgcgcaccctgggccgcggcgtcgggaggctgctgggcagcctgcgagggctctcggggcagcccgcgcggccgccgtgcggggtgagcgcgccgcgcagggcggcctcgggaccctcgggcagcgctcccgcagttgcagcagcagcagcacagccaggctcgtatcccgcgctgagtgcacaggcagcccgggagccggccgccttctgggggcctctggcgcgggacactctcgtgtgggacaccccctaccacaccgtctgggactgcgacttcagcactggcaagatcggctggttcctgggaggccagttaaatgtctctgtcaactgcttggaccagcatgttcggaagtcccccgagagcgttgctttgatctgggagcgcgatgagcctggaacggaagtgaggatcacctacagtccctggttgcagatgccgtgtggcccataggccagcagcattcttctgccctggatcctcgggccccactggacaactgagcggccccccaggtggcccctgcacactggagtgtgcttggctctgaagacccaagctgctgcagctgcccctcgccacggtgggcccagctccatctgcctgcgaacaaagccccttctgagaaggaacttgaggctgctgcccctggagtagttcttcagtaaaagatgaaaaccctctgttgggggtcgggggctaaggagctaactggacacctggaggtccggcagggagggcccagccatggcactccccgaagggccagtttctctccatcagtctctcaggtgtgcctggaccctggggcaggcaggttgtgtgccacgccccctcggctggacgctgcccgtgggagcactgagtgtgtgctaagtagcggttcggtctgtgagcggggctggagccctgtggagacgtgtggttaaacataaaccatgtgagaattctcaggaccacagccagcctgtggaagctaaggacagcttcaggtccatgacactgaaatggccctggcaaagtacttattactctgtctctaaaaataaacaggggccggtcgcagtggctcatgccggtaatcccagcactttgggatggtgaggatcacttgaggacggtgggtggatcgcttgaggtcaggagtttgagaccaacctggccaacatggtgaaaccccgtctctactaaaaatacaaaaattagttgggtgtggtgatgtgcgcctgtagtcccagctacttgggaggctgaagcaggagaactgcttgaaactgggaggtggatgttgcagtgagccaagattgtgccactgcactccatcctgggtgacagagtcagactccatctcaaaaat

SEQ ID NO: 104491 - DNA, 2438 bp, Homo sapiens
  Payload ID: 516
  Gene Symbol: ACSS1
  Gene Name: acyl-CoA synthetase short-chain family member 1
  Uniprot ID: Q9NUB1
  ENST ID: ENST00000432802
  CDS Start-End: 81-1808
ggcccgcggagactccacggggcgccccgggcgtgaggcacccactctgggagcacagagagctcaggtagcctgcctagatggcggcgcgcaccctgggccgcggcgtcgggaggctgctgggcagcctgcgagggctctcggggcagcccgcgcggccgccgtgcggggtgagcgcgccgcgcagggcggcctcgggaccctcgggcagcgctcccgcagttgcagcagcagcagcacagccaggctcgtatcccgcgctgagtgcacaggcagcccgggagccggccgccttctgggggcctctggcgcgggacactctcgtgtgggacaccccctaccacaccgtctgggactgcgacttcagcactggcaagatcggctggttcctgggaggccagttaaatgtctctgtcaactgcttggaccagcatgttcggaagtcccccgagagcgttgctttgatctgggagcgcgatgagcctggaacggaagtgaggatcacctacagggaactactggagaccacgtgccgcctggccaacacgctgaagaggcatggagtccaccgtggggaccgtgttgccatctacatgcccgtgtccccattggctgtggcagcaatgctggcctgtgccaggatcggagctgtccacacagtcatctttgctggcttcagtgcagagtccttggctgggaggatcaatgatgccaagtgcaaggtggttatcaccttcaaccaaggactccggggtgggcgcgtggtggagctgaagaaaatagtggatgaggctgtgaagcactgccccaccgtgcagcatgtcctggtggctcacaggacagacaacaaggtccacatgggggatctggacgtcccgctggagcaggaaatggccaaggaggaccctgtttgcgccccagagagcatgggcagtgaggacatgctcttcatgctgtacacctcagggagcaccggaatgcccaagggcatcgtccatacccaggcaggctacctgctctatgccgccctgactcacaagcttgtgtttgaccaccagccaggtgacatctttggctgtgtggccgacatcggttggattacaggacacagctacgtggtgtatgggcctctctgcaatggtgccaccagcgtcctttttgagagcaccccagtttatcccaatgctggtcggtactgggagacagtagagaggttgaagatcaatcagttctatggcgccccaacggctgtccggctgttgctgaaatacggtgatgcctgggtgaagaagtatgatcgctcctccctgcggaccctggggtcagtgggagagcccatcaactgtgaggcctgggagtggcttcacagggtggtgggggacagcaggtgcacgctggtggacacctggtggcagacagaaacaggtggcatctgcatcgcaccacggccctcggaagaaggggcggaaatcctccctgccatggcgatgaggcccttctttggcatcgtccccgtcctcatggatgagaagggcagcgtcgtggagggcagcaacgtctccggggccctgtgcatctcccaggcctggccgggcatggccaggaccatctatggcgaccaccagcgatttgtggacgcctacttcaaggcctacccaggctattacttcactggagacggggcttaccgaactgagggcggctattaccagatcacagggcggatggatgatgtcatcaacatactccaaatagttgggttcttcagggaagctattagaaactcaggtgacttgttagagcactaacttggtcagagccaaatcctggcaaacgctgcctgaccttcactctgtggttggggcggtgagaaccactgaggtccaatgatgagacttggaggtctggatccagtctctctttgttttaatgtgacttaggtgctgtcaacattagcaagataatggaaatcacgacgccagtgggtgcttacctccctgctaggcatgcaggggctggcggttggcaggggaaggaggcccagtgagccgggtcccttaggggagggagagtttgtcctctttgccccacagtctacccttcagggccttgtggcagtgccagtgttcggggggtgtctgggccactgagtacccactcggtcgtggttgtgctggcctcttgggtgagtgaacctgtgaagcccaggaggtggtgttggctgcagggtacacaaatactgagtggtggtcttttgttacaggcttagcaacaaagctgtgccctgggcatggggggctgtagtgtagctacagttgtgcgtttgtgaaatggcttagctttccatgttgctgagaggaacctggacatggtcccgggcatctgaatgatctgtaggggagggagttcaaataaagctttattttgttcattttctc

SEQ ID NO: 104492 - DNA, 3509 bp, Homo sapiens
  Payload ID: 516
  Gene Symbol: ACSS1
  Gene Name: acyl-CoA synthetase short-chain family member 1
  Uniprot ID: Q9NUB1
  ENST ID: ENST00000537502
  CDS Start-End: 271-1977
agccctttccttgactaccctttgaacagaggagagctatgcaaacacgctgcgagcggccttgagagcccgaggagggtctgctttctgggcccctgcagagggcaggggtcgcgggctggtggtctgccccgcccagagagaaagggccttggcttcccctcattcttcgttctgtgttagctctttttattgcaaataattaattaaagtcagtacagcaagagtgggaaagtggttaatgcaattgccaggtccagattcagagggatgaggcgccgaaaggaaagacaaccttgggatcgcttccacttcctccacttcgcaccgcatggccgggaactactggagaccacgtgccgcctggccaacacgctgaagaggcatggagtccaccgtggggaccgtgttgccatctacatgcccgtgtccccattggctgtggcagcaatgctggcctgtgccaggatcggagctgtccacacagtcatctttgctggcttcagtgcagagtccttggctgggaggatcaatgatgccaagtgcaaggtggttatcaccttcaaccaaggactccggggtgggcgcgtggtggagctgaagaaaatagtggatgaggctgtgaagcactgccccaccgtgcagcatgtcctggtggctcacaggacagacaacaaggtccacatgggggatctggacgtcccgctggagcaggaaatggccaaggaggaccctgtttgcgccccagagagcatgggcagtgaggacatgctcttcatgctgtacacctcagggagcaccggaatgcccaagggcatcgtccatacccaggcaggctacctgctctatgccgccctgactcacaagcttgtgtttgaccaccagccaggtgacatctttggctgtgtggccgacatcggttggattacaggacacagctacgtggtgtatgggcctctctgcaatggtgccaccagcgtcctttttgagagcaccccagtttatcccaatgctggtcggtactgggagacagtagagaggttgaagatcaatcagttctatggcgccccaacggctgtccggctgttgctgaaatacggtgatgcctgggtgaagaagtatgatcgctcctccctgcggaccctggggtcagtgggagagcccatcaactgtgaggcctgggagtggcttcacagggtggtgggggacagcaggtgcacgctggtggacacctggtggcagacagaaacaggtggcatctgcatcgcaccacggccctcggaagaaggggcggaaatcctccctgccatggcgatgaggcccttctttggcatcgtccccgtcctcatggatgagaagggcagcgtcgtggagggcagcaacgtctccggggccctgtgcatctcccaggcctggccgggcatggccaggaccatctatggcgaccaccagcgatttgtggacgcctacttcaaggcctacccaggctattacttcactggagacggggcttaccgaactgagggcggctattaccagatcacagggcggatggatgatgtcatcaacatcagtggccaccggctggggaccgcagagattgaggacgccatcgccgaccaccctgcagtaccagaaagtgctgtcattggctacccccacgacatcaaaggagaagctgcctttgccttcattgtggtgaaagatagtgcgggtgactcagatgtggtggtgcaggagctcaagtccatggtggccaccaagatcgccaaatatgctgtgcctgatgagatcctggtggtgaaacgtcttccaaaaaccaggtctgggaaggtcatgcggcggctcctgaggaagatcatcactagtgaggcccaggagctgggagacactaccaccttggaggaccccagcatcatcgcagagatcctgagtgtctaccagaagtgcaaggacaagcaggctgctgctaagtgagctggcaccttgtggggctcttgggatgggcgggcacccaagccctggcttgtccttcccagaaggtacccctgaggttggcgtcttcctacgtcccagaagcagcccccaccccacacatgacccacaccgccctcacgtgaagctgggctgagagccctttctcccatccattggaggtcccaggagtgtcacccatggagaggctatgcgacatggctagggctggttctgccatctgagtttggtttcctggaatgaaaaggcattgccatctccattcctctgccctcttgagccagcacaggaaggtgaggccctgggatagcgcgcctgctcagataacacagagctagttagctagtagcaaccgtgttttctccagatctgtctagatacaaaggtcagaaatcttatttttatacttttatattgtggaagaacagcatgcaacactcacatgtagtgtgtggatttacttgaacatgttctttttaacatgtagttatgaaaatctccttttttgcctctactggtgaggaaacatgaggatcagaggccacatttttaattattgttagtgtatttggaagtctgaattggagatgtttgtacctctgtctaaacagttcccttgagaacttccaagcctccggcatcttttcctggtgagtgtttctcctgtgcttggttgtgtataatggagctaactcctaagcggtggggtgaatgtggccgccttagttctgaagctactccagttatgttctgtttcttcaagctgtgatccagaaagatttttgtgcccccagatgcctcttgataggagaggcaacatactccaaatagttgggttcttcagggaagctattagaaactcaggtgacttgttagagcactaacttggtcagagccaaatcctggcaaacgctgcctgaccttcactctgtggttggggcggtgagaaccactgaggtccaatgatgagacttggaggtctggatccagtctctctttgttttaatgtgacttaggtgctgtcaacattagcaagataatggaaatcacgacgccagtgggtgcttacctccctgctaggcatgcaggggctggcggttggcaggggaaggaggcccagtgagccgggtcccttaggggagggagagtttgtcctctttgccccacagtctacccttcagggccttgtggcagtgccagtgttcggggggtgtctgggccactgagtacccactcggtcgtggttgtgctggcctcttgggtgagtgaacctgtgaagcccaggaggtggtgttggctgcagggtacacaaatactgagtggtggtcttttgttacaggcttagcaacaaagctgtgccctgggcatggggggctgtagtgtagctacagttgtgcgtttgtgaaatggcttagctttccatgttgctgagaggaacctggacatggtcccgggcatctgaatgatctgtaggggagggagttcaaataaagctttattttgttcattttctc

SEQ ID NO: 104493 - DNA, 2925 bp, Homo sapiens
  Payload ID: 517
  Gene Symbol: ACSS2
  Gene Name: acyl-CoA synthetase short-chain family member 2
  Uniprot ID: Q9NR19
  ENST ID: ENST00000253382
  CDS Start-End: 33-2177
aaaggcggccgcggttctaggaacttgacgtgatggggcttcctgaggagcgggtccggagcggcagcgggagccggggccaggaggaagctggagccggaggccgggcgcggagttggtctccgccgcccgaggtcagccgctccgcgcacgtcccctcgctgcagcgctaccgcgagctgcaccggcgctccgtggaggagccgcgggaattctggggagacattgccaaggaattttactggaagactccatgccctggcccattccttcggtacaactttgatgtgactaaagggaaaatcttcattgagtggatgaaaggagcaactaccaacatctgctacaatgtactggatcgaaatgtccatgagaaaaagcttggagataaagttgctttttactgggagggcaatgagccaggggagaccactcagatcacataccatcagcttctggtccaagtgtgtcagttcagcaatgttctccgaaaacagggcattcagaagggggaccgagtggccatctacatgcctatgatcccagagcttgtggtggccatgctggcatgtgcccgcattggggctttgcactccattgtgtttgcaggcttctcttcagagtctctatgtgaacggatcttggattccagctgcagtcttctcatcactacagatgccttctacaggggggaaaagcttgtgaacctgaaggagctggctgacgaggccctgcagaagtgtcaggagaagggtttcccagtaagatgctgcattgtggtcaagcacctggggcgggcagagctcggcatgggtgactccaccagccagtcccccccaattaagaggtcatgcccagatgtgcagggtaaactgaaagagaaatccaagcgtgttcagccccagatctcatggaaccaagggattgacttgtggtggcatgagctcatgcaagaggcaggggatgagtgtgagcccgagtggtgtgatgccgaggacccactcttcatcctgtacaccagtggctccacaggcaaacccaagggtgtggttcacacagttgggggctacatgctctatgtagccacaaccttcaagtatgtgtttgacttccatgcagaggatgtgttctggtgcacggcagacattggttggatcactggtcattcctacgtcacctatgggccactggccaatggtgccaccagtgttttgtttgaggggattcccacatatccggacgtgaaccgcctgtggagcattgtggacaaatacaaggtgaccaagttctacacagcacccacagccatccgtctgctcatgaagtttggagatgagcctgtcaccaagcatagccgggcatccttgcaggtgttaggcacagtgggtgaacccatcaaccctgaggcctggctatggtaccaccgggtggtaggtgcccagcgctgccccatcgtggacaccttctggcaaacagagacaggtggccacatgttgactccccttcctggtgccacacccatgaaacccggttctgctactttcccattctttggtgtagctcctgcaatcctgaatgagtccggggaagagttggaaggtgaagctgaaggttatctggtgttcaagcagccctggccagggatcatgcgcacagtctatgggaaccacgaacgctttgagacaacctactttaagaagtttcctggatactatgttacaggagatggctgccagcgggaccaggatggctattactggatcactggcaggattgatgacatgctcaatgtatctggacacctgctgagtacagcagaggtggagtcagcacttgtggaacatgaggctgttgcagaggcagctgtggtgggccaccctcatcctgtgaagggtgaatgcctctactgctttgtcaccttgtgtgatggccacaccttcagccccaagctcaccgaggagctcaagaagcagattagagaaaagattggccccattgccacaccagactacatccagaatgcacctggcttgcctaaaacccgctcagggaaaatcatgaggcgagtgcttcggaagattgctcagaatgaccatgacctcggggacatgtctactgtggctgacccatctgtcatcagtcacctcttcagccaccgctgcctgaccatccagtgaacatgatcctgacctttacctaggattcctcctgctccaaactttgcccatcctctttgccccctcaggagtgctgagggccagtgttgacccacactaccctcccttgaccagctgtctgggaccggaaaccagctttgtctccaggtagagacaacatcctgtgactgccaggcagaaaggacagggcccaggtcagcctcagtctgctgtgcctccagactgcagagctctcagaacccagaacagagacgaaaaggctacctctcctacccaagttaagtgttcaaaggggatgtgagggcctccactgaagcagggaggcagctgtgtaatcctatgtcagctctcttaggaagccccagtacttatattgggcatgcacttgcccttaaaaacaatgatttgtgagtccaggaacaatttactatttttaaaatattttgctgcttctgttctgggtctgaattcccttttgtgccagatgccagtactgtctgcccattggctccaggggctgtatgggcagattcagtctccagagggtattcagatcatctgcttctttgaaggagtaaatgtgttttgttcctagggccagaggagcttgtcttccttgtcctctgttcccaccctcccctgaacagaacccagcccataagagacattctcagatgaaactctgttttcttgccccagtcaggctcaagccctgtggttgtaggaataaagcctgtgatctcaagaa

SEQ ID NO: 104494 - DNA, 3065 bp, Homo sapiens
  Payload ID: 517
  Gene Symbol: ACSS2
  Gene Name: acyl-CoA synthetase short-chain family member 2
  Uniprot ID: Q9NR19
  ENST ID: ENST00000360596
  CDS Start-End: 212-2317
tatagtatttctgtccttgccaacctcgatccctccccaaccagacacggccccgccccctctggcaccgcccacccgccagactaagccactcccccactcaccaggccccgcccctctacggaggccccgcctctagttcggcctgttttctcagtcccggcacccgccgcgaccgcaaaggcggccgcggttctaggaacttgacgtgatggggcttcctgaggagcgggtccggagcggcagcgggagccggggccaggaggaagctggagccggaggccgggcgcggagttggtctccgccgcccgaggtcagccgctccgcgcacgtcccctcgctgcagcgctaccgcgagctgcaccggcgctccgtggaggagccgcgggaattctggggagacattgccaaggaattttactggaagactccatgccctggcccattccttcggtacaactttgatgtgactaaagggaaaatcttcattgagtggatgaaaggagcaactaccaacatctgctacaatgtactggatcgaaatgtccatgagaaaaagcttggagataaagttgctttttactgggagggcaatgagccaggggagaccactcagatcacataccatcagcttctggtccaagtgtgtcagttcagcaatgttctccgaaaacagggcattcagaagggggaccgagtggccatctacatgcctatgatcccagagcttgtggtggccatgctggcatgtgcccgcattggggctttgcactccattgtgtttgcaggcttctcttcagagtctctatgtgaacggatcttggattccagctgcagtcttctcatcactacagatgccttctacaggggggaaaagcttgtgaacctgaaggagctggctgacgaggccctgcagaagtgtcaggagaagggtttcccagtaagatgctgcattgtggtcaagcacctggggcgggcagagctcggcatgggtgactccaccagccagtcccccccaattaagaggtcatgcccagatgtgcagatctcatggaaccaagggattgacttgtggtggcatgagctcatgcaagaggcaggggatgagtgtgagcccgagtggtgtgatgccgaggacccactcttcatcctgtacaccagtggctccacaggcaaacccaagggtgtggttcacacagttgggggctacatgctctatgtagccacaaccttcaagtatgtgtttgacttccatgcagaggatgtgttctggtgcacggcagacattggttggatcactggtcattcctacgtcacctatgggccactggccaatggtgccaccagtgttttgtttgaggggattcccacatatccggacgtgaaccgcctgtggagcattgtggacaaatacaaggtgaccaagttctacacagcacccacagccatccgtctgctcatgaagtttggagatgagcctgtcaccaagcatagccgggcatccttgcaggtgttaggcacagtgggtgaacccatcaaccctgaggcctggctatggtaccaccgggtggtaggtgcccagcgctgccccatcgtggacaccttctggcaaacagagacaggtggccacatgttgactccccttcctggtgccacacccatgaaacccggttctgctactttcccattctttggtgtagctcctgcaatcctgaatgagtccggggaagagttggaaggtgaagctgaaggttatctggtgttcaagcagccctggccagggatcatgcgcacagtctatgggaaccacgaacgctttgagacaacctactttaagaagtttcctggatactatgttacaggagatggctgccagcgggaccaggatggctattactggatcactggcaggattgatgacatgctcaatgtatctggacacctgctgagtacagcagaggtggagtcagcacttgtggaacatgaggctgttgcagaggcagctgtggtgggccaccctcatcctgtgaagggtgaatgcctctactgctttgtcaccttgtgtgatggccacaccttcagccccaagctcaccgaggagctcaagaagcagattagagaaaagattggccccattgccacaccagactacatccagaatgcacctggcttgcctaaaacccgctcagggaaaatcatgaggcgagtgcttcggaagattgctcagaatgaccatgacctcggggacatgtctactgtggctgacccatctgtcatcagtcacctcttcagccaccgctgcctgaccatccagtgaacatgatcctgacctttacctaggattcctcctgctccaaactttgcccatcctctttgccccctcaggagtgctgagggccagtgttgacccacactaccctcccttgaccagctgtctgggaccggaaaccagctttgtctccaggtagagacaacatcctgtgactgccaggcagaaaggacagggcccaggtcagcctcagtctgctgtgcctccagactgcagagctctcagaacccagaacagagacgaaaaggctacctctcctacccaagttaagtgttcaaaggggatgtgagggcctccactgaagcagggaggcagctgtgtaatcctatgtcagctctcttaggaagccccagtacttatattgggcatgcacttgcccttaaaaacaatgatttgtgagtccaggaacaatttactatttttaaaatattttgctgcttctgttctgggtctgaattcccttttgtgccagatgccagtactgtctgcccattggctccaggggctgtatgggcagattcagtctccagagggtattcagatcatctgcttctttgaaggagtaaatgtgttttgttcctagggccagaggagcttgtcttccttgtcctctgttcccaccctcccctgaacagaacccagcccataagagacattctcagatgaaactctgttttcttgccccagtcaggctcaagccctgtggttgtaggaataaagcctgtgatctcaagaa

SEQ ID NO: 104495 - DNA, 648 bp, Homo sapiens
  Payload ID: 517
  Gene Symbol: ACSS2
  Gene Name: acyl-CoA synthetase short-chain family member 2
  ENST ID: ENST00000488172
  CDS Start-End: 159-648
aaagtgcagggaagtagctgggaagggaggctgggctagatggggtcacaaggcctgtgtaggcttcaggaggtgggagctgcccgcttcaggcctcagaatcactcttggagttagatatttaagaatccttcctgccttgacagccagtctgtgaaatgatggtgaggtgggcacttctttgtgaattctggggagacattgccaaggaattttactggaagactccatgccctggcccattccttcggtacaactttgatgtgactaaagggaaaatcttcattgagtggatgaaaggagcaactaccaacatctgctacaatgtactggatcgaaatgtccatgagaaaaagcttggagataaagttgctttttactgggagggcaatgagccaggggagaccactcagatcacataccatcagcttctggtccaagtgtgtcagttcagcaatgttctccgaaaacagggcattcagaagggggaccgagtggccatctacatgcctatgatcccagagcttgtggtggccatgctggcatgtgcccgcattggggctttgcactccattgtgtttgcaggcttctcttcagagtctctatgtgaacggatcttggattccagctgcagtcttctcatcacta

SEQ ID NO: 104496 - DNA, 2851 bp, Homo sapiens
  Payload ID: 517
  Gene Symbol: ACSS2
  Gene Name: acyl-CoA synthetase short-chain family member 2
  ENST ID: ENST00000481284
  CDS Start-End: 138-251
gaagggaggctgggctagatggggtcacaaggcctgtgtaggcttcaggaggtgggagctgcccgcttcaggcctcagaatcactcttggagttagatatttaagaatccttcctgccttgacagccagtctgtgaaatgatggtgaggtgggcacttctttgtggtgagtgcagaattctggggagacattgccaaggaattttactggaagactccatgccctggcccattccttcggtacaactttgatgtgactaaagggaaaatcttcattgagtggatgaaaggagcaactaccaacatctgctacaatgtactggatcgaaatgtccatgagaaaaagcttggagataaagttgctttttactgggagggcaatgagccaggggagaccactcagatcacataccatcagcttctggtccaagtgtgtcagttcagcaatgttctccgaaaacagggcattcagaagggggaccgagtggccatctacatgcctatgatcccagagcttgtggtggccatgctggcatgtgcccgcattggggctttgcactccattgtgtttgcaggcttctcttcagagtctctatgtgaacggatcttggattccagctgcagtcttctcatcactacagatgccttctacaggggggaaaagcttgtgaacctgaaggagctggctgacgaggccctgcagaagtgtcaggagaagggtttcccagtaagatgctgcattgtggtcaagcacctggggcgggcagagctcggcatgggtgactccaccagccagtcccccccaattaagaggtcatgcccagatgtgcagatctcatggaaccaagggattgacttgtggtggcatgagctcatgcaagaggcaggggatgagtgtgagcccgagtggtgtgatgccgaggacccactcttcatcctgtacaccagtggctccacaggcaaacccaagggtgtggttcacacagttgggggctacatgctctatgtagccacaaccttcaagtatgtgtttgacttccatgcagaggatgtgttctggtgcacggcagacattggttggatcactggtcattcctacgtcacctatgggccactggccaatggtgccaccagtgttttgtttgaggggattcccacatatccggacgtgaaccgcctgtggagcattgtggacaaatacaaggtgaccaagttctacacagcacccacagccatccgtctgctcatgaagtttggagatgagcctgtcaccaagcatagccgggcatccttgcaggtgttaggcacagtgggtgaacccatcaaccctgaggcctggctatggtaccaccgggtggtaggtgcccagcgctgccccatcgtggacaccttctggcaaacagagacaggtggccacatgttgactccccttcctggtgccacacccatgaaacccggttctgctactttcccattctttggtgtagctcctgcaatcctgaatgagtccggggaagagttggaaggtgaagctgaaggttatctggtgttcaagcagccctggccagggatcatgcgcacagtctatgggaaccacgaacgctttgagacaacctactttaagaagtttcctggatactatgttacaggagatggctgccagcgggaccaggatggctattactggatcactggcaggattgatgacatgctcaatgtatctggacacctgctgagtacagcagaggtggagtcagcacttgtggaacatgaggctgttgcagaggcagctgtggtgggccaccctcatcctgtgaagggtgaatgcctctactgctttgtcaccttgtgtgatggccacaccttcagccccaagctcaccgaggagctcaagaagcagattagagaaaagattggccccattgccacaccagactacatccagaatgcacctggcttgcctaaaacccgctcagggaaaatcatgaggcgagtgcttcggaagattgctcagaatgaccatgacctcggggacatgtctactgtggctgacccatctgtcatcagtcacctcttcagccaccgctgcctgaccatccagtgaacatgatcctgacctttacctaggattcctcctgctccaaactttgcccatcctctttgccccctcaggagtgctgagggccagtgttgacccacactaccctcccttgaccagctgtctgggaccggaaaccagctttgtctccaggtagagacaacatcctgtgactgccaggcagaaaggacagggcccaggtcagcctcagtctgctgtgcctccagactgcagagctctcagaacccagaacagagacgaaaaggctacctctcctacccaagttaagtgttcaaaggggatgtgagggcctccactgaagcagggaggcagctgtgtaatcctatgtcagctctcttaggaagccccagtacttatattgggcatgcacttgcccttaaaaacaatgatttgtgagtccaggaacaatttactatttttaaaatattttgctgcttctgttctgggtctgaattcccttttgtgccagatgccagtactgtctgcccattggctccaggggctgtatgggcagattcagtctccagagggtattcagatcatctgcttctttgaaggagtaaatgtgttttgttcctagggccagaggagcttgtcttccttgtcctctgttcccaccctcccctgaacagaacccagcccataagagacattctcagatgaaactctgttttcttgccccagtcaggctcaagccctgtggttgtaggaataaagcctgtgatctcaagaa

SEQ ID NO: 104497 - DNA, 2450 bp, Homo sapiens
  Payload ID: 517
  Gene Symbol: ACSS2
  Gene Name: acyl-CoA synthetase short-chain family member 2
  ENST ID: ENST00000477932
  CDS Start-End: 57-431
agtcccggcacccgccgcgaccgcaaaggcggccgcggttctaggaacttgacgtgatggggcttcctgaggagcgggtccggagcggcagcgggagccggggccaggaggaagctggagccggaggccgggcgcggagttggtctccgccgcccgaggtcagccgctccgcgcacgtcccctcgctgcagcgctaccgcgagctgcaccggcgctccgtggaggagccgcgggaattctggggagacattgccaaggaattttactggaagactccatgccctggcccattccttcggtacaactttgatgtgactaaagggaaaatcttcattgagtggatgaaaggagcaactaccaacatctgctacaatgtactggatcgaaatgtccatgagaaaaagcttggagataaagttgctttttactgatctcatggaaccaagggattgacttgtggtggcatgagctcatgcaagaggcaggggatgagtgtgagcccgagtggtgtgatgccgaggacccactcttcatcctgtacaccagtggctccacaggcaaacccaagggtgtggttcacacagttgggggctacatgctctatgtagccacaaccttcaagtatgtgtttgacttccatgcagaggatgtgttctggtgcacggcagacattggttggatcactggtcattcctacgtcacctatgggccactggccaatggtgccaccagtgttttgtttgaggggattcccacatatccggacgtgaaccgcctgtggagcattgtggacaaatacaaggtgaccaagttctacacagcacccacagccatccgtctgctcatgaagtttggagatgagcctgtcaccaagcatagccgggcatccttgcaggtgttaggcacagtgggtgaacccatcaaccctgaggcctggctatggtaccaccgggtggtaggtgcccagcgctgccccatcgtggacaccttctggcaaacagagacaggtggccacatgttgactccccttcctggtgccacacccatgaaacccggttctgctactttcccattctttggtgtagctcctgcaatcctgaatgagtccggggaagagttggaaggtgaagctgaaggttatctggtgttcaagcagccctggccagggatcatgcgcacagtctatgggaaccacgaacgctttgagacaacctactttaagaagtttcctggatactatgttacaggagatggctgccagcgggaccaggatggctattactggatcactggcaggattgatgacatgctcaatgtatctggacacctgctgagtacagcagaggtggagtcagcacttgtggaacatgaggctgttgcagaggcagctgtggtgggccaccctcatcctgtgaagggtgaatgcctctactgctttgtcaccttgtgtgatggccacaccttcagccccaagctcaccgaggagctcaagaagcagattagagaaaagattggccccattgccacaccagactacatccagaatgcacctggcttgcctaaaacccgctcagggaaaatcatgaggcgagtgcttcggaagattgctcagaatgaccatgacctcggggacatgtctactgtggctgacccatctgtcatcagtcacctcttcagccaccgctgcctgaccatccagtgaacatgatcctgacctttacctaggattcctcctgctccaaactttgcccatcctctttgccccctcaggagtgctgagggccagtgttgacccacactaccctcccttgaccagctgtctgggaccggaaaccagctttgtctccaggtagagacaacatcctgtgactgccaggcagaaaggacagggcccaggtcagcctcagtctgctgtgcctccagactgcagagctctcagaacccagaacagagacgaaaaggctacctctcctacccaagttaagtgttcaaaggggatgtgagggcctccactgaagcagggaggcagctgtgtaatcctatgtcagctctcttaggaagccccagtacttatattgggcatgcacttgcccttaaaaacaatgatttgtgagtccaggaacaatttactatttttaaaatattttgctgcttctgttctgggtctgaattcccttttgtgccagatgccagtactgtctgcccattggctccaggggctgtatgggcagattcagtctccagagggtattcagatcatctgcttctttgaaggagtaaatgtgttttgttcctagggccagaggagcttgtcttccttgtcctctgttcccaccctcccctgaacagaacccagcccataagagacattctcagatgaaactctgttttcttgccccagtcaggctcaagccctgtggttgtaggaataaagcctgtgatctcaagaa

SEQ ID NO: 104498 - DNA, 567 bp, Homo sapiens
  Payload ID: 517
  Gene Symbol: ACSS2
  Gene Name: acyl-CoA synthetase short-chain family member 2
  ENST ID: ENST00000480274
  CDS Start-End: 67-249
ctgttttctcagtcccggcacccgccgcgaccgcaaaggcggccgcggttctaggaacttgacgtgatggggcttcctgaggagcgggtccggagcggcagcgggagccggggccaggaggaagctggagccggaggccgggcgcggagttggtctccgccgcccgagaattctggggagacattgccaaggaattttactggaagactccatgccctggcccattccttcggtacaactttgatgtgactaaagggaaaatcttcattgagtggatgaaaggagcaactaccaacatctgctacaatgtactggatcgaaatgtccatgagaaaaagcttggagataaagttgctttttactgggagggcaatgagccaggggagaccactcagatcacataccatcagcttctggtccaagtgtgtcagttcagcaatgttctccgaaaacagggcattcagaagggggaccgagtggccatctacatgcctatgatcccagagcttgtggtggccatgctggcatgtgcccgcattggggctttgcactccattgtggtaggag

SEQ ID NO: 104499 - DNA, 603 bp, Homo sapiens
  Payload ID: 517
  Gene Symbol: ACSS2
  Gene Name: acyl-CoA synthetase short-chain family member 2
  ENST ID: ENST00000493805
  CDS Start-End: 57-603
agtcccggcacccgccgcgaccgcaaaggcggccgcggttctaggaacttgacgtgatggggcttcctgaggagcgggtccggagcggcagcgggagccggggccaggaggaagctggagccggaggccgggcgcggagttggtctccgccgcccgaggtcagccgctccgcgcacgtcccctcgctgcagcgctaccgcgagctgcaccggcgctccgtggaggagccgcgggaattctggggagacattgccaaggaattttactggaagactccatgccctggcccattccttcggtacaactttgatgtgactaaagggaaaatcttcattgagtggatgaaaggagcaactaccaacatctgctacaatgtactggatcgaaatgtccatgagaaaaagcttggagataaagttgctttttactgtggagacgtggttttgccatgttggccaggctggtctcaacttcctgacctcagggagggcaatgagccaggggagaccactcagatcacataccatcagcttctggtccaagtgtgtcagttcagcaatgttctccgaaaacagggcattcagaagggggaccgagtggcca

SEQ ID NO: 104500 - DNA, 517 bp, Homo sapiens
  Payload ID: 517
  Gene Symbol: ACSS2
  Gene Name: acyl-CoA synthetase short-chain family member 2
  ENST ID: ENST00000484354
  CDS Start-End: 75-517
agttcggcctgttttctcagtcccggcacccgccgcgaccgcaaaggcggccgcggttctaggaacttgacgtgatggggcttcctgaggagcgggtccggagcggcagcgggagccggggccaggaggaagctggagccggaggccgggcgcggagttggtctccgccgcccgaggtcagccgctccgcgcacgtcccctcgctgcagcgctaccgcgagctgcaccggcgctccgtggaggagccgcgggaattttactggaagactccatgccctggcccattccttcggtacaactttgatgtgactaaagggaaaatcttcattgagtggatgaaaggagcaactaccaacatctgctacaatgtactggatcgaaatgtccatgagaaaaagcttggagataaagttgctttttactgggagggcaatgagccaggggagaccactcagatcacataccatcagcttctggtccaagtgtgtcagttcagcaatgttctccgaaaacaggg

SEQ ID NO: 104501 - DNA, 665 bp, Homo sapiens
  Payload ID: 517
  Gene Symbol: ACSS2
  Gene Name: acyl-CoA synthetase short-chain family member 2
  ENST ID: ENST00000473172
  CDS Start-End: 57-665
agtcccggcacccgccgcgaccgcaaaggcggccgcggttctaggaacttgacgtgatggggcttcctgaggagcgggtccggagcggcagcgggagccggggccaggaggaagctggagccggaggccgggcgcggagttggtctccgccgcccgaggtcagccgctccgcgcacgtcccctcgctgcagcgctaccgcgagctgcaccggcgctccgtggaggagccgcgggaattctggggagacattgccaaggaattttactggaagactccatgccctggcccattccttcggtacaactttgatgtgactaaagggaaaatcttcattgagtggatgaaaggagcaactaccaacatctgctacaatgtactggatcgaaatgtccatgagaaaaagcttggagataaagttgctttttactggtccacttctggtaattcatcctacagatatacttgcagggagggcaatgagccaggggagaccactcagatcacataccatcagcttctggtccaagtgtgtcagttcagcaatgttctccgaaaacagggcattcagaagggggaccgagtggccatctacatgcctatgatcccagagcttgtggtggccatgctggcatgtgcccgcattggggctttgcactccattgtg

SEQ ID NO: 104502 - DNA, 558 bp, Homo sapiens
  Payload ID: 517
  Gene Symbol: ACSS2
  Gene Name: acyl-CoA synthetase short-chain family member 2
  ENST ID: ENST00000475459
  CDS Start-End: 122-346
agatggggtcacaaggcctgtgtaggcttcaggaggtgggagctgcccgcttcaggcctcagaatcactcttggagttagatatttaagaatccttcctgccttgacagccagtctgtgaaatgatggtgaggtgggcacttctttgtgaattctggggagacattgccaaggaattttactggaagactccatgccctggcccattccttcggtacaactttgatgtgactaaagggaaaatcttcattgagtggatgaaaggagcaactaccaacatctgctacaatgtactggatcgaaatgtccatgagaaaaagcttggagataaagttgctttttactgatctcatggaaccaagggattgacttgtggtggcatgagctcatgcaagaggcaggggatgagtgtgagcccgagtggtgtgatgccgaggacccactcttcatcctgtacaccagtggctccacaggcaaacccaagggtgtggttcacacagttgggggctacatgctctatgtagccacaaccttcaagtatgtgtttgacttccatgca

SEQ ID NO: 104503 - DNA, 844 bp, Homo sapiens
  Payload ID: 517
  Gene Symbol: ACSS2
  Gene Name: acyl-CoA synthetase short-chain family member 2
  ENST ID: ENST00000480978
  CDS Start-End: 54-617
cccggcacccgccgcgaccgcaaaggcggccgcggttctaggaacttgacgtgatggggcttcctgaggagcgggtccggagcggcagcgggagccggggccaggaggaagctggagccggaggccgggcgcggagttggtctccgccgcccgaggtcagccgctccgcgcacgtcccctcgctgcagcgctaccgcgagctgcaccggcgctccgtggaggagccgcgggaattctggggagacattgccaaggaattttactggaagactccatgccctggcccattccttcggtacaactttgatgtgactaaagggaaaatcttcattgagtggatgaaaggagcaactaccaacatctgctacaatgtactggatcgaaatgtccatgagaaaaagcttggagataaagttgctttttactggtgttcaagcagccctggccagggatcatgcgcacagtctatgggaaccacgaacgctttgagacaacctactttaagaagtttcctggatactatgttacaggagatggctgccagcgggaccaggatggctattactggatcactggcaggattgatgacatgctcaatgtatctggacacctgctgagtacagcagaggtggagtcagcacttgtggaacatgaggctgttgcagaggcagctgtggtgggccaccctcatcctgtgaagggtgaatgcctctactgctttgtcaccttgtgtgatggccacaccttcagccccaagctcaccgaggagctcaagaagcagattagagaaaagattggccccattgccacaccagactacatccagaatgcacctggcttgcct

SEQ ID NO: 104504 - DNA, 2666 bp, Homo sapiens
  Payload ID: 518
  Gene Symbol: ACSS3
  Gene Name: acyl-CoA synthetase short-chain family member 3
  ENST ID: ENST00000261206
  CDS Start-End: 65-2122
ggccccaggaagttgcaagagtaccatttgtcgcacactcggggaccgcgggtggccggaggagatgaaaccgtcttggctgcagtgtcgtaaagtcaccagcgccggggggctcggagggcccttgcctgggtcctctccggcccggggagccggtgcggccctcagggctttagtggtcccgggcccgcggggcggtctcgggggccggggatgcagggcactgtcctccggcagtggcagcgagtacaagacccacttcgcagcctcggtgaccgaccccgagaggttctggggcaaagctgccgagcagatcagctggtacaagccctggaccaaaacgctggagaacaaacactcgccctctaccaggtttgtggaaggaatgcttaacatttgttacaatgccgttgatcgtcatattgaaaatggtaaaggggataagattgctatcatctatgacagtcctgttacaaacactaaagcaacctttacctataaagaagttctggagcaggtctccaagctggctggtgtcttggtcaagcatggcatcaagaaaggtgacactgtggttatctacatgcctatgatcccacaggcgatgtataccatgttggcatgtgcaaggataggtgccatccacagtctcatatttggaggatttgcttccaaagaactaagtagtcgcattgatcatgtaaagcccaaggtggttgttacagcatcatttggcattgaacctggaaggagggtagagtacgtaccacttgtagaagaagcgctaaaaataggacaacacaaaccagacaaaattctcatttataatcgtccaaatatggaggcggttcctttggctcccggtcgtgaccttgattgggatgaagagatggcaaaagcccagtcacatgactgtgttcctgttctttcagaacacccactgtatattctttacacatctggcacaacggggttacctaagggtgtgattaggcccactgggggatacgctgtcatgctacactggtcaatgtcttccatatacggacttcaacccggagaggtgtggtgggcagcttctgacttaggctgggttgttggacattcctatatctgctatggacctcttcttcatgggaacacaacagttttatatgaggggaagcctgtgggaacaccagatgctggcgcttatttccgtgtgcttgcagagcatggagtagctgccttgtttacagcaccaactgcaattagagcaatccgtcaacaggaccctggggcagctttggggaagcagtactctctgacaaggttcaaaacattatttgtggctggagaacgatgtgatgtagagaccctggaatggtccaaaaatgtcttcagagtacctgtcttagaccattggtggcaaactgagactggatctccaattactgcgtcatgtgttggattaggcaattctaaaacacctccaccagggcaagcaggaaaaagcgtcccaggatacaatgttatgattttggatgacaacatgcaaaaactgaaggctcggtgtttaggaaatattgtggtaaagttaccattgccacctggggctttttcaggactctggaagaatcaggaagcattcaagcatttatactttgaaaaatttcctggatattatgataccatggatgctggttacatggatgaagaaggctatttgtatgttatgtctcgagtggatgatgtaataaatgttgcaggtcacagaatttctgcaggcgccattgaagagtcaatcctttcccatggtaccgtggcagactgtgctgttgttggcaaggaagatcccttaaaaggtcatgtccccttagcactctgtgtattgagaaaagatataaatgcaacagaggagcaagttttggaagaaattgtgaaacacgttagacagaacattggccctgtggctgcttttcgaaatgcagtgtttgtcaaacagctacccaaaaccagatctggcaagatcccccgatcagctttatctgccattgtcaatggcaagccatacaagataacttctacaattgaagaccccagcatttttggccacgtagaagaaatgctgaagcaagcataatgagtttgtcttattcctattttgagttgatttaatttcttaattgaaattaaattatttgagttgtttctcagaaataaatatttcagtagaaattacttgcaaaatgaaatgtgaattgtaaaacttggcctaaacaaatctaatgaaaacatgtgaaagacctgtgccttttttttggtttgaccctgttagcattgttattagttatctataacatggcttattgaatgtcatctactgctttaggaaaaacgtatctagtgtattatttttaaaattgtacctcccaagaagaacactttaattgaaagcaacactaatatagagccacttcctgaaaccaagaatctgtagttttgatccaaaatctaaaacttaaagtcagaaaataattaaaatttttcttgtagaaattttagatattttctagtattctttagatgctcacattgttttaaataaaatagatgaaatgggaagtttaggtaatcatctagacagatgaaattattatctaggtaggagggcttttctatacatt

SEQ ID NO: 104505 - DNA, 534 bp, Homo sapiens
  Payload ID: 518
  Gene Symbol: ACSS3
  Gene Name: acyl-CoA synthetase short-chain family member 3
  ENST ID: ENST00000549175
  CDS Start-End: 255-534
aaggtggtggtggtggagaagaaagcttgggtgggttggtagccagatggagacgcaactgttccgcggcggcagatcttcagttgcggtgcggagctgagcagagacagagactgactgtgatgcccaggcttatctctaactcgtggcctcaagcaatcctcttgcctcaggctcccaaagcacttggattaccggataagctgtagacatgtttttaaaggtggatatgtgcctgtaggtttgtggaaggaatgcttaacatttgttacaatgccgttgatcgtcatattgaaaatggtaaaggggataagattgctatcatctatgacagtcctgttacaaacactaaagcaacctttacctataaagaagttctggagcaggtctccaagctggctggtgtcttggtcaagcatggcatcaagaaaggtgacactgtggttatctacatgcctatgatcccacaggcgatgtataccatgttggcatgtgcaaggataggtgccatccacagtctcatatttggaggat

SEQ ID NO: 104506 - DNA, 379 bp, Homo sapiens
  Payload ID: 518
  Gene Symbol: ACSS3
  Gene Name: acyl-CoA synthetase short-chain family member 3
  ENST ID: ENST00000546664
  CDS Start-End: 1-226
gcttgcagagcatggagtagctgccttgtttacagcaccaactgcaattagagcaatccgtcaacaggaccctggggcagctttggggaagcagtactctctgacaaggttcaaaacattatttgtggctggagaacgatgtgatgtagagaccctggaatggtccaaaaatgtcttcagagtacctgtcttagaccattggtggcaaactggtataaagcactaaagacctctttatcttctcttctttgtttcttatatctgagactggatctccaattactgcgtcatgtgttggattaggcaattctaaaacacctccaccagggcaagcaggaaaaagcgtcccaggatacaatgttatgattttggatgacaa

SEQ ID NO: 104507 - DNA, 9254 bp, Homo sapiens
  Payload ID: 518
  Gene Symbol: ACSS3
  Gene Name: acyl-CoA synthetase short-chain family member 3
  Uniprot ID: Q9H6R3
  ENST ID: ENST00000548058
  CDS Start-End: 911-2971
ctttctttttacattttcccagtttcctcttttgattcatctttacttacttcctatttttgttttttgtttatttgtttgttttgttttctcattagaaaagccacagaaactccaagcaggcaaattagaagggaggcaatgcaacaagtcctatctgttctctgtctagatcacatgcggagtctggtcagcaggtgaatccgcatcccagtggggtcaccttccctgtgacctgtcaatcaccccaagaagcacttcccaatttgtctggcacaacctccttccactcctcctaccctctcagtggtcaggaaatcccggagcagtccttgccctggagctgcttgtgtttttagtaaccagggactgagctgattttgaaaaatcaatcaatcaataaataacaatcaaagagccttgcctcaacgcaccgagttgctggtttcctgcaggtcagaggcgatgccacctccaccaacgaccttccaaagattaaaccagccgtgtacaaactgctggattgaaaattgagagatgggccgttggcctcctcctaggagtacttgtgtgttgaaatcggaaggacgttctggagtttgagcgcgatttttcccggaaggctgcggggttggaagtgcatgttggggtttggatctcgtgcagcagcgcaactaacctgctgcaacggcgctgtgacacccctgtcccggggcccccactttagcctgttgcttctctggtcgctccaggtcggtttttcccggcgactctagtgtggcttccaaacttctgggctctgggctcacttcggaatttgcccccgccccctactcccttccctcaggccccaggaagttgcaagagtaccatttgtcgcacactcggggaccgcgggtggccggaggagatgaaaccgtcttggctgcagtgtcgtaaagtcaccagcgccggggggctcggagggcccttgcctgggtcctctccggcccggggagccggtgcggccctcagggctttagtggtcccgggcccgcggggcggtctcgggggccggggatgcagggcactgtcctccggcagtggcagcgagtacaagacccacttcgcagcctcggtgaccgaccccgagaggttctggggcaaagctgccgagcagatcagctggtacaagccctggaccaaaacgctggagaacaaacactcgccctctaccaggtggtttgtggaaggaatgcttaacatttgttacaatgccgttgatcgtcatattgaaaatggtaaaggggataagattgctatcatctatgacagtcctgttacaaacactaaagcaacctttacctataaagaagttctggagcaggtctccaagctggctggtgtcttggtcaagcatggcatcaagaaaggtgacactgtggttatctacatgcctatgatcccacaggcgatgtataccatgttggcatgtgcaaggataggtgccatccacagtctcatatttggaggatttgcttccaaagaactaagtagtcgcattgatcatgtaaagcccaaggtggttgttacagcatcatttggcattgaacctggaaggagggtagagtacgtaccacttgtagaagaagcgctaaaaataggacaacacaaaccagacaaaattctcatttataatcgtccaaatatggaggcggttcctttggctcccggtcgtgaccttgattgggatgaagagatggcaaaagcccagtcacatgactgtgttcctgttctttcagaacacccactgtatattctttacacatctggcacaacggggttacctaagggtgtgattaggcccactgggggatacgctgtcatgctacactggtcaatgtcttccatatacggacttcaacccggagaggtgtggtgggcagcttctgacttaggctgggttgttggacattcctatatctgctatggacctcttcttcatgggaacacaacagttttatatgaggggaagcctgtgggaacaccagatgctggcgcttatttccgtgtgcttgcagagcatggagtagctgccttgtttacagcaccaactgcaattagagcaatccgtcaacaggaccctggggcagctttggggaagcagtactctctgacaaggttcaaaacattatttgtggctggagaacgatgtgatgtagagaccctggaatggtccaaaaatgtcttcagagtacctgtcttagaccattggtggcaaactgagactggatctccaattactgcgtcatgtgttggattaggcaattctaaaacacctccaccagggcaagcaggaaaaagcgtcccaggatacaatgttatgattttggatgacaacatgcaaaaactgaaggctcggtgtttaggaaatattgtggtaaagttaccattgccacctggggctttttcaggactctggaagaatcaggaagcattcaagcatttatactttgaaaaatttcctggatattatgataccatggatgctggttacatggatgaagaaggctatttgtatgttatgtctcgagtggatgatgtaataaatgttgcaggtcacagaatttctgcaggcgccattgaagagtcaatcctttcccatggtaccgtggcagactgtgctgttgttggcaaggaagatcccttaaaaggtcatgtccccttagcactctgtgtattgagaaaagatataaatgcaacagaggagcaagttttggaagaaattgtgaaacacgttagacagaacattggccctgtggctgcttttcgaaatgcagtgtttgtcaaacagctacccaaaaccagatctggcaagatcccccgatcagctttatctgccattgtcaatggcaagccatacaagataacttctacaattgaagaccccagcatttttggccacgtagaagaaatgctgaagcaagcataatgagtttgtcttattcctattttgagttgatttaatttcttaattgaaattaaattatttgagttgtttctcagaaataaatatttcagtagaaattacttgcaaaatgaaatgtgaattgtaaaacttggcctaaacaaatctaatgaaaacatgtgaaagacctgtgccttttttttggtttgaccctgttagcattgttattagttatctataacatggcttattgaatgtcatctactgctttaggaaaaacgtatctagtgtattatttttaaaattgtacctcccaagaagaacactttaattgaaagcaacactaatatagagccacttcctgaaaccaagaatctgtagttttgatccaaaatctaaaacttaaagtcagaaaataattaaaatttttcttgtagaaattttagatattttctagtattctttagatgctcacattgttttaaataaaatagatgaaatgggaagtttaggtaatcatctagacagatgaaattattatctaggtaggagggcttttctatacattttctgagggaaagcagaacaccggggttatagctataccttcaggtcttttgttacttaggcaaggaaaaccacatgtctgacctggttcagcatgtaatccgagcactttgggaggctgaggcaggcggatcacttgaggtcagcagtttgagacgagcctggccaacatggtgaaaccctgtagctactgaaaatacaaaaataagccaggcgtggtggcgggaggctgaggcaaggagaatcacttgaatacaagaggcagaggttgcagtgagccaagttcccccactgtactccagcctgggtgacagagtaagactccatctcaaaacaacaaaaacaacaaaaaaaccacatgcctggcggagaacaaagagatcatttagtccaatctcttcatggagatgagggctcctgggagcccctcttcatgtctcaggttcttagttgactatgtttatccaaatgattccagattcctgtggaaacaaggaatcgatgtacaaatggggtagggtggcaaggaaaactcttaagagagaaacatcaaggttttcacattaggttaaagacaagaaggtttctaggcaggtagtgtaatgtctaggtgattttgaagtgaacttaagccactaggtttgagggacaaaggacagtagaaaatggtgaagactgcagatcacctgctatacctcaaggagcagcggacccagcagaatatggcccaaaaaggaggcaggtctcctgttgcaagagcctctgtttttttaaagagaaaacaaagaatcctggtttttatgtgaaatctctaattttaaaataataactcattaaaaatattgtaatgtccaaaagtatctttccatttaacttctaaaaatctcttaaatgttttttttaaataattgtaaagtgagtttttgttaagcttataggaatgggccagttaactaaggtagacagatgtaggaaattaaatatttgatttacttagggatctatatgacatcagttatcaaagaatacattttaacccaaaagtataccatgctcattgtatctttgatcgttcttcaagtatttctcaatcttttaatctatcaggaacattactatcaagagcagattgttgtaacataatactcaggatacatgaaatgtatgtgagagataaatagataatagaaagtttattgttataaaaatgacctacaacttatataaaaaaattctgaaaatgttgactttttttggactgaagactgcaaaataaatggcttctcaaagtaaattcctatttacttaaattgccttcttgattgttacacctggaaaaatatattcatctactttttccttttaattatgttagtagactgaattaaaccagctacatagacactctctcatttgaagctgttgggatccttgagttgcctctttcattggtacgttttatccattgtcacaactgtggtcttcattaataactcattttaatgtcttaggagtagaatgtgtttccttattttttttcaaataagagtcagttaatttgaaatggcaaattatttacctgaatgtgtatcattgttcatttgcaaggtttaagctcaggcagatccaataattaggtaaaggttgcatctttggtcctcttgcacattttttctggtaatcaaatctgaagcgacatctcagcaagcagacttgggttattttccactaggatgggaatggaaaacagtgctggagactggggaagtggctatttcctgtgtctcactggggaattgcaagatcaaagaatgttgttacttttatgtgatgaaaaaatagggcaagaaagatatacctgaatcatcagactgcttaaaatttgggaggaaaaaattctattttactactaaccataaatcacttttgctagatagtactttaaagattctgaattaaatgtatctttaaaaacaacaatataatattactaaaaaatgcagacatacttaaacttgctagaataaattctgtgaggtcttcgtttggtattttcataggatttcttactgttaagttattggaaaatgaaaatataaagtgctttcagaagttatagtattttccaattcattgaattactttgcttgtgaaaatatattaaacatatttaaatgagacctatcctacatttaaaaaccagttttgtttatataaaattgtatttgaaaggtcctgaacattaaaaatgtgaaaatttataatgttgatgatcaaaagtaacgtgttgagactctgagcttaatccattaaatggattttagaatctagtagaagttatctttcttataaattaaaacatattttatgcttcttttttgagggaaatacctggatcttttgcatcactatatgttagtgtctattatagatgattaatctttctaacttgatctttaaaagaaagaaattgattttagtgattgagtgttatataatagtagatacaaatctagttatggcattataatgtcgtagttcctatattctatttcatttctatgaatcaagatgcccatgtttagatgagcttagaaagctacttctcattgttcctactcaggccacatttttagaaaaaaattttaagatcactcccataagcaagtttagatctccctcttgtggcagactcaattttgaagctaaatatttgggtcacccaaagaacacatttcctgatagtttaagtaaattgtcgagccttatgtgactagaaaacaaagcttaaacagagaactggaattattattttttttattgacaatggaaagggtttctgttatcattaccttttgactgaatctgttaaataaaaatagacatcaaaacaaatgtaatgtacgtgcaaacatagcaaattaaaatacagaaaagaaattactaatgacaggtcttgcgcttaataagatcaagcagcagaaaatcagcagttagataaatggtattattaaataggctttactttgaatctcccatataaacaaagaataaacaacagtaacaccaccaaataaagccacagggaagagattactcttctatacttttatacactatatatgttaatcattctgtctttcatttatttcctctgataaaactgacttcagggaagtcgcaacaaggccatctcggctaaaagcttataacattagacatgagtctggctaatgccctgttacattgacaaaagggaaaggtatcttgggtttcgttttctctagtggaaatgagcctcagactctgcggtggttgacattcactgtccagtactggctggcatttcaagatatttgaatgaacatgtggttcttagtaaagaagtttttttatctttttttttttcttggtccacaggtaacaagagaagattatggttttttaatataaatttttaaataattgcttttgacccttgtaaacagcttggctttgttttgtattgaaaaggagatcaagccatcacagtgctatttctaaagatataggacatccctgattgcctttaaagctctatttttggctccggttccaggttaaatcattcttttttacatgatcagaggcaggttgttcagctttaagtattgacagacttgaaggagaaacacgttgaagcatgaaacatgcttcaaggaaacatattgatttgactattaacaatccaaaaactgtaaaaatggtggaatggtaaaatacaaacagtacttggaattgtcaaatgtttgcactcgagactccatgaaccatatattttattttttaaaaaatcatatttatatccatttacataagacttacacatttaaaaagaaatgcacggtaatacataaatgcctagtatattacaataaaacatgaaaaacaactggcttcatttcataaaagcatctgttgtacagagtttatgatgtagatgatgtttattattcaaatgacttaagcattttattacaatttgtagtaaactaatcaaatgtaatatctgactccccccaaaaatcacatttttcagcttttaataagtcatgacgtcattatttccttagaattcagttttcacaaaggttttcactgctcgtcttcttagatggtagtgcactttaggtagagtagactgaaaagacgccatctaaaatatacaatggatagcattagttcactgaaaagtcccagactgggaaatctcattctactcctctgtggtgtacctccacgcagcctgcttactcctgtcctagaagatcatgagaaggaaatcatctaggatgtagccaacagccgtatgtaattaacatttgcttttctccaatttggtgcaggggagcttaacaaataatagaatttgctcaactttgtggaaagtatggcagtaatgtaaacaaaggtagttatgcaaaatgttagcatgccttctgaaaaatttacaacttgctaattaataaattgggttgaattgacctatttcataatgtagatttatattctagttcatatattttagagttcttaaaaaatacctttatttgttacaaaaacataacgataataagtcacctattgtaaacgtttgtgtcagtagtatggcattgctgattgttttcagccataatgtacttagaaaaagctcacaattgctattactgacacaaaagaaacagcaagtagtatgctctggattattttaatatcaaaagtgttgttgtttcacccaaacaaaaaatggttgtcctagattgaattattgtaaatgaatactgttatcccaattaatggtaaaaactaggaaatatgaactagaatgtcatgcacaaaaaacagattgcaaatagagtaactctacccatcacttaagagctaagaagcaagcactattgaacatattaaatagtcatttgtaaattagtgaagtgttcatttcctgaagaaattataatgctatgtgtagaatctaatataaacagtattttgggagacctcttatttagccaaattattatatactttaaatcatgtctaattaggtgccaaattatataccataattaaaattttaatgtaagggttgtacattctgaaattaaatctcttatcgggatgcttttcattttatcagcttcaaatagtgatccaaataaggcagcatatctgctcccatcctaagcccaaaagaccaacaataaattgtgtggcacttttagttcaaggcaatgaaaacagcacaaggtgagttgttcctctgtctataactgttttctcttaaccctgtgcacacattttgttctaaatatcgctcttaaaaagtatttttctaaaatattgattcatcgaaagtggttaaatattttggtaaagcatagttttaggttgaaaaaaaattatgaacatttgacatttataaatctaagaaaccacagttttactattaagactgtttttcaataaaacctcatttttatatggattttaaagtagctttcattaattggtatttccttaaaatcaaatgcttggtatttatggttacataggaaggttttgtgctggtcctattctccattcttaaagtaattttattttgttcctatatgtcttaaatacttaaaatttatatttgtttttagcaagtgtaaatcagattgataagaaacaatgtaataaaggtttgaatttttca

SEQ ID NO: 104508 - DNA, 1713 bp, Homo sapiens
  Payload ID: 519
  Gene Symbol: ACOT1
  Gene Name: acyl-CoA thioesterase 1
  Uniprot ID: Q86TX2
  ENST ID: ENST00000311148
  CDS Start-End: 309-1574
gccgggacgaaccagtcctggcccagcccattccgcgagccagcaagcttctgaaaagcaaacctaggaagttgctttccaacataaagtggaggtttcaacacaggagactttaagcaagttccagtgtgtctatatttggtctggctgatcggctggactctggccttccccgctcacattagcagacagctctgccctagtgggcgtttagcctgcgacggcagcccgagaggaagagttgggcagagttgcaggggtctccacagctgaggcagtttggccggattatttgggttcctgctcggatggcggcgacgctgatcctggagcccgcgggccgctgctgctgggacgaaccggtgcgaatcgccgtgcgcggcctagccccggagcagccggtcacgctgcgcgcgtccctgcgcgacgagaagggcgcgcttttccaggcccacgcgcgctaccgcgccgacacccttggcgagctggacctggagcgcgcgcccgcgctgggcggcagcttcgcggggcttgagcccatggggctgctctgggccttggagcccgagaaacccttggtgcggctggtgaagcgcgacgtgcgaacgcccttggccgtggagctggaggtgctggatggccacgaccccgaccccgggcggctgctgtgccgggtgcggcacgagcgctacttcctcccgcccggggtgcggcgcgagccggtgcgcgcgggccgggtgcgaggcacgctcttcctgccgccagaacctgggccctttcctggcattgtggacatgttcggaactggaggtggcctgctggagtatcgggctagtctgctggctgggaagggttttgctgtgatggctctggcttactataactatgaagacctccccaagaccatggagacgctccatctggagtactttgaagaagctgtgaactacttgctcagtcatcctgaggtaaaaggtccaggagttgggctgcttggaatttccaaagggggtgagctctgcctttccatggcctctttcctgaagggcatcacggctgctgtcgtcatcaacggctctgtggccaatgttgggggaaccttacgctacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgccacatttagtgtgtgtatgtgtattcattctttctcataacttcttaaagtttcttcccctcattattaaaatgaatttaccagt

SEQ ID NO: 104509 - DNA, 1271 bp, Homo sapiens
  Payload ID: 519
  Gene Symbol: ACOT1
  Gene Name: acyl-CoA thioesterase 1
  ENST ID: ENST00000557556
  CDS Start-End: 29-1216
tggccggattatttgggttcctgctcggatggcggcgacgctgatcctggagcccgcgggccgctgctgctgggacgaaccggtgcgaatcgccgtgcgcggcctagccccggagcagccggtcacgctgcgcgcgtccctgcgcgacgagaagggcgcgcttttccaggcccacgcgcgctaccgcgccgacacccttggcgagctggacctggagcgcgcgcccgcgctgggcggcagcttcgcggggcttgagcccatggggctgctctgggccttggagcccgagaaacccttggtgcggctggtgaagcgcgacgtgcgaacgcccttggccgtggagctggaggtgctggatggccacgaccccgaccccgggcggctgctgtgccgggtgcggcacgagcgctacttcctcccgcccggggtgcggcgcgagccggtgcgcgcgggccgggtgcgaggcacgctcttcctgccgccagaacctgggccctttcctggcattgtggacatgttcggaactggaggtggcctgctggagtatcgggctagtctgctggctgggaagggttttgctgtgatggctctggcttactataactatgaagacctccccaagaccatggagacgctccatctggagtactttgaagaagctgtgaactacttgctcagtcatcctgagggcatcacggctgctgtcgtcatcaacggctctgtggccaatgttgggggaaccttacgctacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgcc

SEQ ID NO: 104510 - DNA, 3082 bp, Homo sapiens
  Payload ID: 520
  Gene Symbol: ACOT11
  Gene Name: acyl-CoA thioesterase 11
  Uniprot ID: Q8WXI4
  ENST ID: ENST00000343744
  CDS Start-End: 83-1867
atttggagtcaggcctggctgttgctcaggtgaccagcttgtgtctctgggagggcgctgctttccccggccacccggcgcgatgatccagaatgtcggaaatcacctgcgacggggcttggcctctgtgttctccaaccgcacatcccggaagtcagccttacgtgcggggaacgacagtgccatggcagacggcgagggataccggaaccccacggaggtgcagatgagccagctggtgctgccctgccacaccaaccaacgtggtgagctgagcgtcgggcagctgctcaagtggattgacaccacggcttgcctgtccgcggagaggcacgctggctgcccctgtgtcacagcttccatggatgacatctattttgagcacaccattagtgttggacaagtggtgaatatcaaggccaaggtgaaccgggccttcaactccagcatggaggtgggcatccaggtggcctcggaggacctgtgctctgagaagcagtggaatgtgtgcaaggccttggccaccttcgtggcccgccgagagatcaccaaggtgaagctgaagcagatcacgccgcggacagaagaggagaagatggagcacagtgtggcggctgagcgccggcgcatgcgccttgtctatgcagacaccatcaaggacctcctggccaactgcgccattcagggcgatctggagagcagagactgtagccgcatggtgccggctgagaagacccgtgtggagagtgtggagctggtcctgcctccccacgccaatcaccagggcaacacctttgggggccagatcatggcctggatggagaatgtggccaccattgcagccagccggctctgccgtgcccaccctacgctgaaggccattgaaatgttccacttccgaggcccgtcccaggtcggcgaccgtctggtgctcaaagccatcgtgaacaatgccttcaaacatagcatggaggtgggcgtgtgcgtggaggcctatcgccaggaggctgagacccaccggcgccacatcaacagtgcctttatgacctttgtggtcctggacgcagatgaccagccccagttgctgccctggattcggccccagcccggcgatggtgagcggcggtaccgagaggccagtgccagaaagaagatccgcctggacaggaagtacatcgtgtcctgtaagcagacagaggtgcccctctccgtcccctgggaccctagcaaccaggtgtacctgagctacaataacgtctcctccttgaagatgcttgtggccaaggacaactgggtgctgtcctcggagatcagtcaggtccgcctgtacactctggaggatgacaagttcctctccttccacatggagatggtggtgcatgtggatgcagcccaggccttcctgctgctctcggacctgcgtcagaggccagagtgggacaagcactaccggagcgtggagctagtgcagcaggtagacgaggacgacgccatctaccacgtcaccagccctgccctcggaggtcacacaaagccccaggacttcgtgatcctggcctcgaggcggaagccttgtgacaatggggacccctatgtcatcgcgctgaggtcggtcacgctgcccacacaccgagagacgccagagtacagacgcggagagaccctctgctcaggcttctgcctctggcgcgagggggaccagctgaccaaggtatcctactacaaccaggccaccccaggtgttctcaactatgtgaccaccaacgtggccggcctctcctctgagttctacaccaccttcaaggcttgtgagcagtttctcttggacaaccggaatgatctggcccccagcctccagaccctctagatgccctcagtggccacatcatgcccactcccactccatcctgtccccaaggactcacatacagtgcctggagaaagccaaagacctttatttcttcctgcctccccgtgggaagcctccgccctgaggtccgctggcccaccacccctgggtgctcagtttctaccaacatgagccagcaagtccttgtggtagccctggggtagcctgtagtagactcgggtcctgtccacagccctagctgccagcaatgctgtcctcacagaggcatagtcgcccccagctgggttgtgctccactgtgacggtggcccggggggaggatgccagcagcctgcctatggctccagctgtgctgtggcccagcagcatggcctgcatctggaaggacacaggttgccagagcccctggcacaactctagcatatctgtgagcagctgttccctgtagccactgcccagcacctcctcaggccagcctggtgccacagtcacgtgggggaagacctcagccacagctgtaagcagctctctgccagccacatggccggggaccgaaaaactcccgtgggagattttggccccaacccacacaggccaatgcaagaggccaaggctggagaggcgtgccagcaaggccagggatggccggagggctgcgggctccgctatttgcaaatggatgccccagtgtccgggatgtgtggccagctgctgcaggcaggactccagcgtcaggatgttgccacttggagtatgaacaatgggcacggggttttcagccacagttccctcgaggccagtgttcagcaggatcatgccttctgtgtctggaagaggcggcagaggcaacagtgtttaggatttgggttatcataaggtgttaagagtcccttgttaaaggggcagtgggagttatggggtcatcaaggaccttgcctctctggaatctgtcaacccagttttgggctccaggtggatgggttgctttataaatgtgcctggtgcatgagaaactcttgtttcagctcttggcctttacccatgactcagcctgggggctggtgccggccttgcctgcagcaatgtagctgaggactggtctgaaggccaggagccctgtgctcttgacatcactgtactccctctccctccccgcaaccctgccccaccttgcatccagggtatggtgtaaataaacctgtgttgccatggc

SEQ ID NO: 104511 - DNA, 6369 bp, Homo sapiens
  Payload ID: 520
  Gene Symbol: ACOT11
  Gene Name: acyl-CoA thioesterase 11
  Uniprot ID: Q8WXI4
  ENST ID: ENST00000371316
  CDS Start-End: 83-1906
atttggagtcaggcctggctgttgctcaggtgaccagcttgtgtctctgggagggcgctgctttccccggccacccggcgcgatgatccagaatgtcggaaatcacctgcgacggggcttggcctctgtgttctccaaccgcacatcccggaagtcagccttacgtgcggggaacgacagtgccatggcagacggcgagggataccggaaccccacggaggtgcagatgagccagctggtgctgccctgccacaccaaccaacgtggtgagctgagcgtcgggcagctgctcaagtggattgacaccacggcttgcctgtccgcggagaggcacgctggctgcccctgtgtcacagcttccatggatgacatctattttgagcacaccattagtgttggacaagtggtgaatatcaaggccaaggtgaaccgggccttcaactccagcatggaggtgggcatccaggtggcctcggaggacctgtgctctgagaagcagtggaatgtgtgcaaggccttggccaccttcgtggcccgccgagagatcaccaaggtgaagctgaagcagatcacgccgcggacagaagaggagaagatggagcacagtgtggcggctgagcgccggcgcatgcgccttgtctatgcagacaccatcaaggacctcctggccaactgcgccattcagggcgatctggagagcagagactgtagccgcatggtgccggctgagaagacccgtgtggagagtgtggagctggtcctgcctccccacgccaatcaccagggcaacacctttgggggccagatcatggcctggatggagaatgtggccaccattgcagccagccggctctgccgtgcccaccctacgctgaaggccattgaaatgttccacttccgaggcccgtcccaggtcggcgaccgtctggtgctcaaagccatcgtgaacaatgccttcaaacatagcatggaggtgggcgtgtgcgtggaggcctatcgccaggaggctgagacccaccggcgccacatcaacagtgcctttatgacctttgtggtcctggacgcagatgaccagccccagttgctgccctggattcggccccagcccggcgatggtgagcggcggtaccgagaggccagtgccagaaagaagatccgcctggacaggaagtacatcgtgtcctgtaagcagacagaggtgcccctctccgtcccctgggaccctagcaaccaggtgtacctgagctacaataacgtctcctccttgaagatgcttgtggccaaggacaactgggtgctgtcctcggagatcagtcaggtccgcctgtacactctggaggatgacaagttcctctccttccacatggagatggtggtgcatgtggatgcagcccaggccttcctgctgctctcggacctgcgtcagaggccagagtgggacaagcactaccggagcgtggagctagtgcagcaggtagacgaggacgacgccatctaccacgtcaccagccctgccctcggaggtcacacaaagccccaggacttcgtgatcctggcctcgaggcggaagccttgtgacaatggggacccctatgtcatcgcgctgaggtcggtcacgctgcccacacaccgagagacgccagagtacagacgcggagagaccctctgctcaggcttctgcctctggcgcgagggggaccagctgaccaagtgctgctgggttagggtctccctgactgagctggtctcggcaagtggcttctattcctgggggctcgaatccaggtcaaagggtcgcaggagcgacggttggaatggaaaactagctggaggacacctgagtactcttaaagcaatccccgtggccaaaatcaacagccgatttggataccttcaagacacctgaaaccttatcatgagccagatgccaaggaagagactctgggaggatccagaggaccccctggttgcagccacgtagagactgacgctgaggaggactccaactatcatgagcaacacccgtcgaacacagccaccccgctaagaacagatcaagaagctgtcacagatggcggaagaaaacctgaggaaagcgggacaaccagtcacaatgaataatttaatggtagctatgatagcagttatcaccactgccgtgagtattccttcaataagggctggtaataatgcctggatgcaatcattctatgacacagttacacatgctttctgatctcagtatttaccataataaatcggctcctataattgaggcataccaccctcaaaaacctatttgtaaacaggattggacccagttagaaaaaatgaacgtacttatttaggaagattgctttgcagaataggcagagatgctgcacaacgattcctatggaatcattactaattggtcccccaaggggatgtttagcttgaattgcacctctcagtctgcatgccacggtcacactatgttcagatgatctgaacaaaacagtcagatggtagaaatgttaagtacggcaaaagttcctattatctggaaccatggcggtatagtggcacctcaacctcaaataatatggcccgctctaggagctaaacataaggatttgtaaaaactattaaatgctcttaataagatcaaaatttgggaaagaataaaagagtatctagaaggacactctacaaacttgtttttggatatagcaaaattaaaagaacaaatatgtaaagcatcccgggcaacctgaccttaatgccaggaaccagagtgcttaaaggagctgcagaaaaattagcagctagtaacccatttaaatgggtaaaaacacttggaagctctgtgatttcaatgatgactatgctttttaatctgttgtttgcctttgtatagtctgcagatgcggatcccgactcctgcgagagtctctttgcaaatcgaagaagggagacatgttgggagcaagccccccagagtctggccataaactggccccaaaactggccataagcaaaacctctgcagcactaaaacatgtccataatggccctaacgcccaatctggaaggttgtgggtttatgggaatgagagcaaggaacacctggcctgcccagggcggaaaaccgcttaaaggcattcttaagccacaaacaaaagcatgagcgatctgtgtcttacgggtgtgttcctgctgcaattaattcagcccatccctttgtttcccataagggatacttttagttaatttaatatctatagaaacaatgctaatgactggtttgctgttaaatgaaggggtgggttgcccctccacacctgtgggtgtttctcgttaggtggaacgagagacttggaaaagagacacagagacaaagtatagagaaagaaaagtgggcccaggggaccagcattcagcatacagaggatccacactggcaccggcctctgagttcccttagtatttattgatcattatcgagcatggcaggataataggataatagtggagagaaggtcagaaggtaaacacatgaacaaaggtctctgcatcataaacaaggtaaagaattaagtgctgtgctttagatatgtatacacataaacatctcaatgccttaaagagcagtattgctgcccgcatgtcatacctacagccctaaggcggttttcccctatctcagtagatggaagtatattccatgtaaagtaaatcggctttacacccagacattccattgcccagagacgagcaggagacagaagccttcctcttatctcaactgcaaagaggtgttccttcctcttttactaatcctcctcagcacagaccctttatgggtgtcgggctgggggatggtcaggtctttcccttcccacgaggccatatttcagactatcacatggggagaaaccttggacaatacctggctttcctaggcagaggtccctgcggcctttgcagtattttgcgtctctgggtacttgagattagggagtggtttgagattagggagtggtgatgactcttaaggagcatgctgccttcaagcatttgtttaacaaagcacatcttgcacagcccttaatccatttaaccctgagttgacacagcacatgtttcagggagcacagggttgggggtaaggttacagattaacggcatctcaaggcagaagaatttttcttaatacagaacaaaatggagtctcctatgtctacttctttctacacagacacagtaacaatctgatctctcttttccccacagttaataaatatgtgggtaaatctctgttgggggctctcagctctgaaggctgtgagacccctgattttctacttcacacctctatatttttgtgtgtgtgtctttaattcctctagcgctgctgagttagtgaccgagctggtctcggcagaggtgggcgggtcttttgagttcaggagttcaagagcagcctggccaacatggtgaaaccccttctctactaaaaatatgaaaattatccgggcatggtggtgtgcctctgtactttcagctactcaggaagctgaggcacaagaattgctggaacatgggaggtggaggctgcagtgagctgagatcatgccactgcactccagcccaggcaatagagtaagactctgtctcaaaacaaaaagagttttaggccaggtgtggtggctcacgcctgtaatcccagcactttgggaggctgaggtgggcagatcacctgaggtcaggagttcgagaccagtctggccaacatggcgaaaccccatctctctctactaaaaatacaaaatttagccaggtgtggtggtgggtgcctgtaatcacagctgcttgggaggctgaggcaggagaattggttgaacccaggaggcagaggttacagtgagcagagatcgtgccactgcattccagccggggtaagagagcgagactctgcctcaaaaaaagaaggcttagtgtgcaactcatcagagttgcacagggcagagaaagaatgggaaaaaaacaatttctagaaaacttttcgaattttctgatcaacaccaaatattccaaataggaaaaatacaaaaaaatccatacctatatgtggcataatatgattgtagagcaccaaagtaaaagatcttattttttattaaaattaaaaaaaaattaaaatagagggtctcactatgctgcccaggctggtcttgaactcctggcttcaagctatcctcccaccatggcatcctaaagtgctgggattgcaggcatgagctgctgcatctggcccaaagtaaaagatcttagaagcggccagaaaaaatagatttgggctgggcatgaatagattgatcaccaaaaaggtggcagactaacttctcgacagaatccacagaagccagaaggcagtggaacattagctttgatgtactaaaataaaataccacgctaggctcctacatacagtgaaaatgttttgagaatgagaattataattttttggcaaacaaaactaaaggagtttacaactaagaaactcttttgtgagacagccttgctctgttgcccaggctggagtgcagtgacgaaatctcagctcactgcaacctcggcctcccgggttcaggcaattcttgtgtctcagccttccaagtagctgggattacagatgtgcgccaccaggcccagctactttttatatttttagtggagatggggtttcactgtgttggccaggctggtctcaaactcctgacttcaagtgatctgcccgccttggcctgctaaagtgctgggattacaggcatgagcgactgtgcctctccagtccctgtgtttttttttgtttttggaggttttatttgtttgtttttagagacactttcactgtgttgcccaggcctgtctgttggcctcaagtgatcctcctgccttggatctcccaaagtgctgggattacaggtgtgaaccactgtgctcagcccattttttatttgtttcttgaaggaaggtagcagtattaattaattttggactttgctcactaaagtttgaatgttaagaatagatgtatacagtctggatgcagtggtgcatgcttgtaattttagcactttgggaggctgaagcgggaggatcgcttgggctcaagagtttgagaccagcctgggcaacatggtgaaaccttgtctctacaaaaaaattttaaaaaattagccagacatgatggcatgcacctataatcccagctacttgggaggctgaggtgggaggattgcttgagtccagggaggtcgaggctgcagtgagccatgatcacaccactgcactccagcctgggtgacagagtgatactgtctc

SEQ ID NO: 104512 - DNA, 2086 bp, Homo sapiens
  Payload ID: 521
  Gene Symbol: ACOT12
  Gene Name: acyl-CoA thioesterase 12
  Uniprot ID: Q8WYK0
  ENST ID: ENST00000307624
  CDS Start-End: 30-1697
gccgcaggcgtagcgctctcgccctggccatggagcggccggcgcccggcgaggtggtcatgagccaagccatccagccggcgcacgccactgcgcgcggcgagctgagcgcggggcagctgctcaagtggatcgacaccaccgcctgcctggcggctgagaaacatgctggagtttcctgcgttacagcctcagtggatgacatacagtttgaggagacagctagagttggacaagttataaccatcaaagcaaaagttactagagcattcagcacaagcatggagatcagtatcaaggtcatggtacaggatatgctcactggcattgagaagcttgttagtgtggctttctccacatttgtagccaaaccagttggaaaagaaaagattcatttaaaaccagtcacacttctaactgaacaagatcatgtggaacataatctggctgctgagagaaggaaagttcgattacaacatgaagatacctttaacaatttaatgaaggaaagtagcaaatttgatgatctcatttttgatgaagaggaaggagcggtttccacaaggggcacctccgttcagagcattgaactggtcctcccaccccatgcaaaccatcacggaaatacatttggtggccagattatggcgtggatggagacagtggctactatttctgcaagccgcctgtgttgggctcatccctttctgaagtccgtagatatgtttaagttccggggaccatctacagttggagatcgtcttgtcttcactgccattgtcaacaatacatttcagacctgtgttgaagttggagttcgcgtggaggcctttgactgtcaggaatgggccgagggccgagggcgtcacatcaacagtgcttttctcatttacaatgctgctgatgataaggaaaatctcatcacgtttcccagaatccaacccatttcaaaggatgatttcagacgctatcggggagctattgcacgcaagcgaattcgcctaggcagaaaatatgttatttcccacaaagaagaggttccactttgcatacactgggatatcagcaagcaggcatccctgagtgacagcaatgtggaggccctcaaaaaactggcagccaaaaggggttgggaggttaccagcactgtggaaaagataaaaatatatactctggaagagcatgatgttttatctgtttgggttgaaaagcacgtgggaagtccagcacatttggcttatcgtctcttgtctgactttacaaagcgacctttgtgggacccccattttgtgtcctgtgaagtcatagactgggtgagtgaagatgatcagctgtatcacatcacctgtcctatactgaatgatgacaaacccaaagacttggtagtactcgtatcacgaagaaaacccctcaaagatggtaacacttacacagtggcagtgaagtcggtcattttgccatcggtccccccgtctccacagtacatcagaagtgaaatcatatgtgccggatttctcatccatgctattgacagcaattcatgcatcgtatcttactttaaccatatgtctgctagcatccttccttactttgctggaaatcttggtggctggtcaaaatccattgaagaaacagcagcctcttgtatacagttcttagagaatcctcctgatgatgggtttgtaagcacattttaaaggtcaactttcaattactggtaatttaatttcccacttttaattccaagcacccttagccctgacatctgtcaagctttggggccacaaaataatttaatataaccctaagcaaaatgcagtgacggagttaaaaaacaaaatgcatcttaagtcaaataccagtgatttggattagcattaaaagagctttagaattctgttgtaagtcatctgtggctctgcctcttccaggggcacagatagtggaaaattgcctgtatgcagtactatgtgttctataaaatggcatgaatttagtttaaattatcgtaaacatttttaggttacagaggtgaaacatgcattctgtgtgaaattccaaaaaaaaaattataaaatctaaaatg

SEQ ID NO: 104513 - DNA, 612 bp, Homo sapiens
  Payload ID: 521
  Gene Symbol: ACOT12
  Gene Name: acyl-CoA thioesterase 12
  Uniprot ID: Q8WYK0
  ENST ID: ENST00000513751
  CDS Start-End: 66-569
cggggcgggcggagcgggcatggtggggtgtcgggggccgcaggcgtagcgctctcgccctggccatggagcggccggcgcccggcgaggtggtcatgagccaagccatccagccggcgcacgccactgcgcgcggcgagctgagcgcggggcagctgctcaagtggatcgacaccaccgcctgcctggcggctgagaaacatgctggagtttcctgcgttacagcctcagtggatgacatacagtttgaggagacagctagagttggacaagttataaccatcaaagcaaaagttactagagcattcagcacaagcatggagatcagtatcaaggtcatggtacaggatatgctcactggcattgagaagcttgttagtgtggctttctccacatttgtagccaaaccagttggaaaagaaaagattcatttaaaaccagtcacacttctaactgaacaagatcatgtggaacataatctggctgctgagagaaggaaagttcgattacaacatgaagatacctttaacaatttaatgaaggaaagtagcaaatttgatggtcagtaaatccacttataagaattttaattctataactgtgacaggcaaa

SEQ ID NO: 104514 - DNA, 4047 bp, Homo sapiens
  Payload ID: 522
  Gene Symbol: ACOT13
  Gene Name: acyl-CoA thioesterase 13
  Uniprot ID: Q9NPJ3
  ENST ID: ENST00000230048
  CDS Start-End: 194-616
aaagtcagtgagcaaatcgcggaccaccggggctgccagctcgcctgactcccggcctcttgcgctcctaggggcggagaagggtgcgggctcttcgccctttgtgtcctccttctttcactaacttctggactttccagctcttccgaagttcgttcttgcgcaaagcccaaaggctggaaaaccgtccacgatgaccagcatgactcagtctctgcgggaggtgataaaggccatgaccaaggctcgcaattttgagagagttttgggaaagattactcttgtctctgctgctcctgggaaagtgatttgtgaaatgaaagtagaagaagagcataccaatgcaataggcactctccacggcggtttgacagccacgttagtagataacatatcaacaatggctctgctatgcacggaaaggggagcacccggagtcagtgtcgatatgaacataacgtacatgtcacctgcaaaattaggagaagatatagtgattacagcacatgttctgaagcaaggaaaaacacttgcatttacctctgtggatctgaccaacaaggccacaggaaaattaatagcacaaggaagacacacaaaacacctgggaaactgagagaacagcagaatgacctaaagaaacccaacaatgaatatcaagtatagatttgactcaaacaattgtaatttttgaaataaactagcaaaaccagaagcagctagaaatattcttggaggaaaaggacctggatatcaagtagggtaaaggtgggggtgtcttttttcactttaagcatcttgttttctaatcatgtgtgataattgggtgaaaaattcttagctcaaagtgttttaaaaacaggtaaagcaaagaaactagcaggaccactctcagttaagattaaaactaaagtccagtgttaagctaaaggagaaatagaaattaatggttctaattctgtttgggctgctaggaacaacagaaatttttcatggttctagaagctggaaagtcctgggtcaaggcccagcagatcctgttaggtgagggcccgcttcctggctcatagatggtgccttctcactgtgtggtggaaggggcaagtgagccctctgggttctcgtttttgaaatggagtctcgctctgttgcccaggctggagtacagcagcacgatctcggctcactgcaatctctgccccctgggttcaagtgattctcctgcctcagcctcccaagtagctgggactataggcatgtgccatcacacctagctaatttttgtagttttttgtagaaacagggttcaccatgttggccaggctggtctcgaactcgtgacctcaggtgatccgcctgccttggccccccaaagtgctgggattacaggtgtgagccaatgtgcccagcctgggttctcttttgtaagggcacttactccaatcttgagggttctgccctcgtgatctaataacttcccaaagacccccacctgctaatatcaccttgggggttgggattttaacatacaaatttaggggaaacacatggagaccacagcaatggccaatccttagcgaatcttaggtccttcccagatctaaaatgccaagctacacttgcatttcctttttttaagattatgaaacttcaaaatatatgaactacagcccatattgaaaaataaaatagattgagccatatgcctaaaaaagacctcaagaaaagtttgaggctaagcatgttagtgttacaggaaatggtccaatagagggggaagaaaaaaagcatgctactagccccttttcttgtaccgagaataaaaccatgcagatctcaaacctccaagtctatagtattgaaaagaccaagttcacttctcagaagtctccaagttcagttgactgtggcactctgagacagcttctgtcactcaggctggagtgatacaatcacagcttcccatagcctcaaaatcccaggctcaagacattcttccacctcagtctcctgagtagctggaactacaggcgtgtgccaccacgcctaattttatttttgtagaaacaaggtctcactgttgcccagcctcgtctcaaactcctaggctcaagcaatcctcctgccttggccccccaagtactggacttacaggtgtgaaccactgcacccagctgactcttacttgatttctgtcagggaatcttaatgaacatttcatgactaaagactaaaaaggatgcagctttaagtaaatttaagtcaagttaacagttaaagacaaatcctttccctacattagatcgcctgctgatctgtccactgtgaaagggcagaagactccacagtagcaatagcagcagtgagcatacaggagtcccagatgtttacttctagtatttcccactaaaaggaagctgggctccttggagaaacagctgactccagggcttgaggctgggacagaaaggttacagtatcttatgcatgaaaggagatgctcaaaataataaaggcatgcaaattatgatttggagggaaaaaatatgaggccatagtgtttaggtagataataaatggcagagatagaacactctcttacaacaaatgctgtaaatggacaaagcattagatttggaaaatcactattttgtaaccatcatagttaaagactggtttgggttttagtctggaaagaatcgccaagggagctcctgataaaggaacagggtatttgcacattgcttcccagagattgctagtagtaagtaccacacatagggcaaaaccaggacaccttgaccaggcgctcaaaagtaacatcaatgaagagcagatggagagtatacttgagaagggcgttaagcatgaataaacaattcaaatgcaaaatgagtaacaatttacaagaaaaattgccctgtactccaaaaaacatagaggtcatggaacacataaaggctaaggaactgttccacattaaagacaactgagaacaactaaattcaatgatcctgtactctagagggggggatctaaaacaagctaccaaggatactgggacaacaaaacgaatatggatgataaagagtatcaacattccctgagtttggtaattttactctagttatatgaaatattcttgtacttggaacatatgccgaagtactaaggaaggggtaaggaagcacaaagtgtgcaacaaactcaaatagctcacaggtataagtgtacagagaaaatgaaaaaaatgtggcaaaataataaaaatgagggtaaagattacacaacagctttcatattactctggtaacttttctaaattattccaaaataaaaacgtaaacaatggctgccaaaatgcctaacttggtgaacataagtgtaattcaatatggtaaattaattcaacatggtaaattaagagcataggccttaagagccagccagcctggttttaaatcctccactacttatgatctgagcttgagcaagttacttaacctctgcatctatttccaccaaaggttgagaggttaagacaagagcttagaagagtacctggttataataaacattcaaaatgttatttcaaatagattctaatttttaaataagaggacacatgaaagcattttgaaatttaagaatggccctttcccatgaagcaaggcataaggccaggttgctaactgttgaaagctgacagtatgttcttgattcctgttcttgttgaagttacacactcaattgccaggtatttttcttctgaatttactatttagccacagactatgaaataattctctaaggtgaccagtaacatcagtgaaatggaaagaaaaagttaacacttcaaactttgtgtattcacctgaatagtcagggaactttcacctattttatttaggttttctttttctttttttctttttttttcaaattccaaccagaagctaaatacaattggaaactggtaagcactagttttactccaaaggagtaggatcattcagatttactccaataaaagtatgcaacccttaa

SEQ ID NO: 104515 - DNA, 4391 bp, Homo sapiens
  Payload ID: 522
  Gene Symbol: ACOT13
  Gene Name: acyl-CoA thioesterase 13
  Uniprot ID: Q9NPJ3
  ENST ID: ENST00000537591
  CDS Start-End: 588-941
aagcgcgcatgcgcgcttcgtcacaagggtgcgaggaaagtcagtgagcaaatcgcggaccaccggggctgccagctcgcctgactcccggcctcttgcgctcctaggggcggagaagggtgcgggctcttcgccctttgtgtcctccttctttcactaacttctggactttccagctcttccgaagttcgttcttgcgcaaagcccaaaggctggaaaaccgtccacgatgaccagcatgactcagtctctgcgggaggtgataaaggccatgaccaaggctcgcaattttgagagagttttgggaaagtaacacgtggaggaacatacgttgggaatatcaactgacacgcactgtgctaggatctagaaataccatgtggactccaacacacatagaaataaggaagtggaattccaaaggaaggcaaagtgtaaagtcatctttatggaaatgagtgatgaaggtgaatacctgaatgagatgtcaagaggaggaacacactggagagaagcagtaaagatttaggactgaaccttaaagacatacaggcttgagagaaagaaagcatgtaaagaagacagaaatggttagaaagattactcttgtctctgctgctcctgggaaagtgatttgtgaaatgaaagtagaagaagagcataccaatgcaataggcactctccacggcggtttgacagccacgttagtagataacatatcaacaatggctctgctatgcacggaaaggggagcacccggagtcagtgtcgatatgaacataacgtacatgtcacctgcaaaattaggagaagatatagtgattacagcacatgttctgaagcaaggaaaaacacttgcatttacctctgtggatctgaccaacaaggccacaggaaaattaatagcacaaggaagacacacaaaacacctgggaaactgagagaacagcagaatgacctaaagaaacccaacaatgaatatcaagtatagatttgactcaaacaattgtaatttttgaaataaactagcaaaaccagaagcagctagaaatattcttggaggaaaaggacctggatatcaagtagggtaaaggtgggggtgtcttttttcactttaagcatcttgttttctaatcatgtgtgataattgggtgaaaaattcttagctcaaagtgttttaaaaacaggtaaagcaaagaaactagcaggaccactctcagttaagattaaaactaaagtccagtgttaagctaaaggagaaatagaaattaatggttctaattctgtttgggctgctaggaacaacagaaatttttcatggttctagaagctggaaagtcctgggtcaaggcccagcagatcctgttaggtgagggcccgcttcctggctcatagatggtgccttctcactgtgtggtggaaggggcaagtgagccctctgggttctcgtttttgaaatggagtctcgctctgttgcccaggctggagtacagcagcacgatctcggctcactgcaatctctgccccctgggttcaagtgattctcctgcctcagcctcccaagtagctgggactataggcatgtgccatcacacctagctaatttttgtagttttttgtagaaacagggttcaccatgttggccaggctggtctcgaactcgtgacctcaggtgatccgcctgccttggccccccaaagtgctgggattacaggtgtgagccaatgtgcccagcctgggttctcttttgtaagggcacttactccaatcttgagggttctgccctcgtgatctaataacttcccaaagacccccacctgctaatatcaccttgggggttgggattttaacatacaaatttaggggaaacacatggagaccacagcaatggccaatccttagcgaatcttaggtccttcccagatctaaaatgccaagctacacttgcatttcctttttttaagattatgaaacttcaaaatatatgaactacagcccatattgaaaaataaaatagattgagccatatgcctaaaaaagacctcaagaaaagtttgaggctaagcatgttagtgttacaggaaatggtccaatagagggggaagaaaaaaagcatgctactagccccttttcttgtaccgagaataaaaccatgcagatctcaaacctccaagtctatagtattgaaaagaccaagttcacttctcagaagtctccaagttcagttgactgtggcactctgagacagcttctgtcactcaggctggagtgatacaatcacagcttcccatagcctcaaaatcccaggctcaagacattcttccacctcagtctcctgagtagctggaactacaggcgtgtgccaccacgcctaattttatttttgtagaaacaaggtctcactgttgcccagcctcgtctcaaactcctaggctcaagcaatcctcctgccttggccccccaagtactggacttacaggtgtgaaccactgcacccagctgactcttacttgatttctgtcagggaatcttaatgaacatttcatgactaaagactaaaaaggatgcagctttaagtaaatttaagtcaagttaacagttaaagacaaatcctttccctacattagatcgcctgctgatctgtccactgtgaaagggcagaagactccacagtagcaatagcagcagtgagcatacaggagtcccagatgtttacttctagtatttcccactaaaaggaagctgggctccttggagaaacagctgactccagggcttgaggctgggacagaaaggttacagtatcttatgcatgaaaggagatgctcaaaataataaaggcatgcaaattatgatttggagggaaaaaatatgaggccatagtgtttaggtagataataaatggcagagatagaacactctcttacaacaaatgctgtaaatggacaaagcattagatttggaaaatcactattttgtaaccatcatagttaaagactggtttgggttttagtctggaaagaatcgccaagggagctcctgataaaggaacagggtatttgcacattgcttcccagagattgctagtagtaagtaccacacatagggcaaaaccaggacaccttgaccaggcgctcaaaagtaacatcaatgaagagcagatggagagtatacttgagaagggcgttaagcatgaataaacaattcaaatgcaaaatgagtaacaatttacaagaaaaattgccctgtactccaaaaaacatagaggtcatggaacacataaaggctaaggaactgttccacattaaagacaactgagaacaactaaattcaatgatcctgtactctagagggggggatctaaaacaagctaccaaggatactgggacaacaaaacgaatatggatgataaagagtatcaacattccctgagtttggtaattttactctagttatatgaaatattcttgtacttggaacatatgccgaagtactaaggaaggggtaaggaagcacaaagtgtgcaacaaactcaaatagctcacaggtataagtgtacagagaaaatgaaaaaaatgtggcaaaataataaaaatgagggtaaagattacacaacagctttcatattactctggtaacttttctaaattattccaaaataaaaacgtaaacaatggctgccaaaatgcctaacttggtgaacataagtgtaattcaatatggtaaattaattcaacatggtaaattaagagcataggccttaagagccagccagcctggttttaaatcctccactacttatgatctgagcttgagcaagttacttaacctctgcatctatttccaccaaaggttgagaggttaagacaagagcttagaagagtacctggttataataaacattcaaaatgttatttcaaatagattctaatttttaaataagaggacacatgaaagcattttgaaatttaagaatggccctttcccatgaagcaaggcataaggccaggttgctaactgttgaaagctgacagtatgttcttgattcctgttcttgttgaagttacacactcaattgccaggtatttttcttctgaatttactatttagccacagactatgaaataattctctaaggtgaccagtaacatcagtgaaatggaaagaaaaagttaacacttcaaactttgtgtattcacctgaatagtcagggaactttcacctattttatttaggttttctttttctttttttctttttttttcaaattccaaccagaagctaaatacaattggaaactggtaagcactagttttactccaaaggagtaggatcattcagatttactccaataaaagtatgcaacccttaagcaaagcttttcttcattt

SEQ ID NO: 104516 - DNA, 1774 bp, Homo sapiens
  Payload ID: 523
  Gene Symbol: ACOT2
  Gene Name: acyl-CoA thioesterase 2
  Uniprot ID: P49753
  ENST ID: ENST00000238651
  CDS Start-End: 183-1634
aaagcaaacctaggaagtagctttccaacataaagtggaggtttcaacacaggagactttaagcaagttccagtgtgtctatatttggtctggctgatcggctggactctggccttccccgctcacgttagcagacagctctgccctagtgggcgcttagcctgcgacggcagcccgagaggatgtctaacaagcttctttctccccacccccattcagttgttctcaggtctgaattcaaaatggcctcatctcctgctgtccttcgagcgtcccggctgtaccaatggagcctgaagagttcggcgcagttcctggggtctccacagctgaggcaggttggtcagatcattagggttcctgctcggatggcggcgacgctgatcctggagcctgcgggccgctgctgctgggacgaaccggtgcgaatcgccgtgcgcggcctagccccggagcagccggtcacgctgcgcgcgtccctgcgcgacgagaagggcgcgcttttccaggcccacgcgcgctaccgcgccgacactcttggcgagctggacctggagcgcgcgcccgcgctgggcggcagcttcgcggggcttgagcccatggggctgctctgggccttggagcccgagaaacctttggtgcggctggtgaagcgcgacgtgcgaacgcccttggccgtggagctggaggtgctggatggccacgaccccgaccccgggcggctgctgtgccagacgcggcacgagcgctacttcctcccgcccggggtgcggcgcgagccggtgcgcgtgggccgggtgcgaggcacgctcttcctgccgccagaacctgggccctttcctgggattgtggacatgttcggaactggaggtggcctgctggagtatcgggctagtctgctggctgggaagggttttgctgtgatggctctggcttattataactatgaagacctccccaagaccatggagacgctccatctggagtactttgaagaagccatgaactacttgctcagtcatcccgaggtaaaaggtccaggagttgggctgcttggaatttccaaagggggtgagctctgcctttccatggcctctttcctgaagggcatcacggctgctgtcgtcatcaacggctctgtggccaatgttgggggaaccttacactacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgccacatttagtgtgtgtatgtgtattcattcttttgtttttaataactaaagttttttcccctcattattaaaatgaatttaccagt

SEQ ID NO: 104517 - DNA, 1578 bp, Homo sapiens
  Payload ID: 523
  Gene Symbol: ACOT2
  Gene Name: acyl-CoA thioesterase 2
  ENST ID: ENST00000538782
  CDS Start-End: 534-728
aacctgcgtgagttccgctccaggctgatggaagctttgttcttttgtacttcacaataaaccttgctactgctccttctttgggtccatactgcatttcagagctgtaacaccgtgaaggtatacagcttcactcctgaagccaagaccatgaacccactgagaggaacaagaaaaacaactctggacctgctgcctttatgagctgtaacactcaccttgaaggtctgtggctttactcttgaagtcggtgagaagcgagaccatgaacccaccagaaggaacacattccggacgcatctgaacatcagaggaaacaaactccagacacactacttttcagaactgtattaagaactgtaacagtcactgcgagggtctgcggcttcattcttgatgtcagcgagaccaagaatccaccagaaggaaccaattccagacacagaattatttgccttcttacttcctgagagttctaggcacagaacatacttgaggtgttatacaaagttgttctcaggtctgaattcaaaatggcctcatctcctgctgtccttcgagcgtcccggctgtaccaatggagcctgaagagttcggcgcagttcctggggtctccacagctgaggcagaacctgggccctttcctgggattgtggacatgttcggaactggaggtggcctgctggagtatcgggctagtctgctggctgggaagggttttgctgtgatggctctggcttattataactatgaagacctccccaagaccatggagacgctccatctggagtactttgaagaagccatgaactacttgctcagtcatcccgaggtaaaaggtccaggagttgggctgcttggaatttccaaagggggtgagctctgcctttccatggcctctttcctgaagggcatcacggctgctgtcgtcatcaacggctctgtggccaatgttgggggaaccttacactacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgccacatttagtgtgtgtatgtgtattcattcttttgtttttaataactaaagttttttcccctcattattaaaatgaatttaccagt

SEQ ID NO: 104518 - DNA, 1553 bp, Homo sapiens
  Payload ID: 523
  Gene Symbol: ACOT2
  Gene Name: acyl-CoA thioesterase 2
  ENST ID: ENST00000613168
  CDS Start-End: 17-1408
caggtctgaattcaaaatggcctcatctcctgctgtccttcgagcgtcccggctgtaccaatggagcctgaagagttcggcgcagttcctggggtctccacagctgaggcaggttggtcagatcattagggttcctgctcggatggcggcgacgctgatcctggagcctgcgggccgctgctgctgggacgaaccggtgcgaatcgccgtgcgcggcctagccccggagcagccggtcacgctgcgcgcgtccctgcgcgacgagaagggcgcgcttttccaggcccacgcgcgctaccgcgccgacactcttggcgagctggacctggagcgcgcgcccgcgctgggcggcagcttcgcggggcttgagcccatggggctgctctgggccttggagcccgagaaacctttggtgcggctggtgaagcgcgacgtgcgaacgcccttggccgtggagctggaggtgctggatggccacgaccccgaccccgggcggctgctgtgccagacgcggcacgagcgctacttcctcccgcccggggtgcggcgcgagccggtgcgcgtgggccgggtgcgaggcacgctcttcctgccgccagaacctgggccctttcctgggattgtggacatgttcggaactggaggtggcctgctggagtatcgggctagtctgctggctgggaagggttttgctgtgatggctctggcttattataactatgaagacctccccaagaccatggagacgctccatctggagtactttgaagaagccatgaactacttgctcagtcatcccgaggtaaaaggtccaggagttgggctgcttggaatttccaaagggggtgagctctgcctttccatggcctctttcctgaagggcatcacggctgctgtcgtcatcaacggctctgtggccaatgttgggggaaccttacactacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgccacatttagtgtgtgtatgtgtattcattcttttgtttttaataactaaagttttttcccctcattattaaaatgaatttaccagtaagaa

SEQ ID NO: 104519 - DNA, 1604 bp, Homo sapiens
  Payload ID: 523
  Gene Symbol: ACOT2
  Gene Name: acyl-CoA thioesterase 2
  ENST ID: ENST00000622407
  CDS Start-End: 199-1464
ctttaagcaagttccagtgtgtctatatttggtctggctgatcggctggactctggccttccccgctcacgttagcagacagctctgccctagtgggcgcttagcctgcgacggcagcccgagaggaagagttcggcgcagttcctggggtctccacagctgaggcaggttggtcagatcattagggttcctgctcggatggcggcgacgctgatcctggagcctgcgggccgctgctgctgggacgaaccggtgcgaatcgccgtgcgcggcctagccccggagcagccggtcacgctgcgcgcgtccctgcgcgacgagaagggcgcgcttttccaggcccacgcgcgctaccgcgccgacactcttggcgagctggacctggagcgcgcgcccgcgctgggcggcagcttcgcggggcttgagcccatggggctgctctgggccttggagcccgagaaacctttggtgcggctggtgaagcgcgacgtgcgaacgcccttggccgtggagctggaggtgctggatggccacgaccccgaccccgggcggctgctgtgccagacgcggcacgagcgctacttcctcccgcccggggtgcggcgcgagccggtgcgcgtgggccgggtgcgaggcacgctcttcctgccgccagaacctgggccctttcctgggattgtggacatgttcggaactggaggtggcctgctggagtatcgggctagtctgctggctgggaagggttttgctgtgatggctctggcttattataactatgaagacctccccaagaccatggagacgctccatctggagtactttgaagaagccatgaactacttgctcagtcatcccgaggtaaaaggtccaggagttgggctgcttggaatttccaaagggggtgagctctgcctttccatggcctctttcctgaagggcatcacggctgctgtcgtcatcaacggctctgtggccaatgttgggggaaccttacactacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgccacatttagtgtgtgtatgtgtattcattcttttgtttttaataactaaagttttttcccctcattattaaaatgaatttaccagt

SEQ ID NO: 104520 - DNA, 2362 bp, Homo sapiens
  Payload ID: 524
  Gene Symbol: ACOT4
  Gene Name: acyl-CoA thioesterase 4
  Uniprot ID: Q8N9L9
  ENST ID: ENST00000326303
  CDS Start-End: 255-1520
ttgggcgccacaccttgcgcgccccggggcccaaggagacgaccctgaagaggagcctggctacttttgcctcagacgagtccggagcgccgggttaaccggtctgaagtcccaggggctttctgggactgctcagccaccggcagcttccggcaccaggggacgccggacgccgtccggacattcggcgcgcttgccacgatcttggacgggtctcgggcctcgacctttgaattccccgctccggctccaagatgtcagcaacgctgatcctggagcccccaggccgctgctgctggaacgagccggtgcgcattgccgtgcgcggcctggccccggagcagcgggttacgctgcgcgcgtccctgcgcgacgagaagggcgcgctcttccgggcccacgcgcgctactgcgccgacgcccgcggcgagctggacctggagcgcgcacccgcgctgggcggcagcttcgcgggactcgagcccatggggctgctctgggccctggaacccgagaagcctttttggcgcttcctgaagcgggacgtacagattccttttgtcgtggagttggaggtgctggacggccacgaccccgagcctggacggctgctgtgccaggcgcagcacgagcgccacttcctcccgccaggggtgcggcgccagtcggtgcgagcgggccgggtgcgcgccacgctcttcctgccgccaggacctggacccttcccagggatcattgacatctttggtattggagggggcctcttggaatatcgagccagcctccttgctggccatggctttgccacgttggctctagcttattataactttgaagatctccccaataacatggacaacatatccctggagtacttcgaagaagccgtatgctacatgcttcaacatccccaggtaaaaggcccaggcattgggcttttgggcatttctctaggagctgatatttgtctctcaatggcctcattcttgaagaatgtctcagccacagtttccatcaatggatctgggatcagtgggaacacagccatcaactataagcacagtagcattccaccattgggctatgacctgaggagaatcaaggtagctttctcaggcctcgtggacattgtggatataaggaatgctctcgtaggagggtacaagaaccccagcatgattccaatagagaaggcccaggggcccatcctgctcattgttggtcaggatgaccataactggagaagtgagttgtatgcccaaacagtctctgaacggttacaggcccatggaaaggaaaaaccccagatcatctgttaccctgggactgggcattacatcgagcctccttacttccccctgtgcccagcttcccttcacagattactgaacaaacatgttatatggggtggggagcccagggctcattctaaggcccaggaagatgcctggaagcaaattctagccttcttctgcaaacacctgggaggtacccagaaaacagctgtccctaaattgtaatgcatttgtctgttgttgacatgagagattcaagatcagattctagtgttcagtaaccctatgtgaatcagatgtctcctggataacattaaagccatgtctttgtcattaatggtgtattttacgtaactttgttgaataagctttgtcgttagttttactaatgtaacttgcttgttgtagaagattaagaggcatatgacacatataagtgaaaaacattcccaccagttaacatttgtgtttccttctagatttttttagttaatgttttgagtcacaggtgagctttaaagctggtgactttttccatcactatgaaagaatggtcacttaatgtttgctgttcaaccatcagtagcagggtagaattttctttggccagaaacatacagaggggtgttaatatgaggaaaggcagctgaccttttcattataaacgtgagagaagactcttttgacaggaggagatgagacctgtctctagaatagttaagtctgtactctcttccaagggtgaattactacgatctattttccctctcacttcctctctaagagcagaccctggggccgagtacagtggctcacacctgtaatcccagtactttgggaagtcaaggggggcatattgcttgagctcaggatttcatgaccagcttaggcaacatggcaaaacccaatccctacaaaaattagccaaacatggtacacacctgtagtcccagctactcgagactcagatgggacgattgcttgagcccgggaggtcaagattggtgcagtgagccgtgattgcaccactgcactccagcccaggtaacacagcgagaccccgtttc

SEQ ID NO: 104521 - DNA, 1004 bp, Homo sapiens
  Payload ID: 525
  Gene Symbol: ACOT6
  Gene Name: acyl-CoA thioesterase 6
  Uniprot ID: Q3I5F7
  ENST ID: ENST00000381139
  CDS Start-End: 332-955
tatattatcattattgtttgagaaaataagacattttgttctttctctgccaatctctctacccccaatctccttggcttcaaaaacttgtttgcttactgtcttttgagaaactaaagctccctgtgatttgtgatgttctccaggcagggggccctttcctgggatcattgatctgtttgggagcagcaggggcctttgtgaatacagggccagcctcctggccggacatggttttgctgtgcttgccctggcttatttcagatttgaagacctccccgaagatctgaatgatgtacatctggagtactttgaagaagccgtggactttatgctgcagcatccaaaggtgaaaggtcctagtattgcgcttcttggattttccaaaggaggtgacctgtgtctctcaatggcttctttcttgaagggcatcacagccactgtacttatcaatgcctgtgtagccaacacagtagctcctctacattacaaggatatgattattcctaaacttgtcgatgatctaggaaaagtaaaaatcactaagtcaggatttctcacttttatggacacttggagcaatccactggaggaacacaatcaccaaagtcttgttccattggaaaaggcgcaggtgcccttcttgtttattgttggcatggatgatcaaagctggaagagtgaattctatgctcagatagcctctgaaaggctacaagctcatgggaaagaaagaccccagataatctgttacccagaaactggtcactgtattgacccaccttattttcctccttctagagcttctgtgcacgctgttttgggtgaggcaatattctatggaggtgagccaaaggctcactcaaaggcacaggtagatgcctggcagcaaattcaaactttcttccataaacatctcaatggtaaaaaatctgtcaagcacagcaaaatataacattgtagccacagaccagataccattaataaaaatcctattcatacaa

SEQ ID NO: 104522 - DNA, 870 bp, Homo sapiens
  Payload ID: 525
  Gene Symbol: ACOT6
  Gene Name: acyl-CoA thioesterase 6
  ENST ID: ENST00000554229
  CDS Start-End: 365-870
acacacatgagattccatcacccaggcagcattcctgagccttgggggactggtttccaatgattcttaggcttctgtcattctttgctgcctatctgctgagagtgccacttgcttactgccagaactctgtatgcatacaacccaaaatggactctgccagtgattagatttgtgaggcagggggccctttcctgggatcattgatctgtttgggagcagcaggggcctttgtgaatacagggccagcctcctggccggacatggttttgctgtgcttgccctggcttatttcagatttgaagacctccccgaagatctgaatgatgtacatctggagtactttgaagaagccgtggactttatgctgcagcatccaaaggtgaaaggtcctagtattgcgcttcttggattttccaaaggaggtgacctgtgtctctcaatggcttctttcttgaagggcatcacagccactgtacttatcaatgcctgtgtagccaacacagtagctcctctacattacaaggatatgattattcctaaacttgtcgatgatctaggaaaagtaaaaatcactaagtcaggatttctcacttttatggacacttggagcaatccactggaggaacacaatcaccaaagtcttgttccattggaaaaggcgcaggtgcccttcttgtttattgttggcatggatgatcaaagctggaagagtgaattctatgctcagatagcctctgaaaggctacaagctcatgggaaagaaagaccccagataatctgttacccagaaactggtcactgtattgacccaccttattttcctccttctagagcttctgtgcacgctgttttgggtgaggcaatatt

SEQ ID NO: 104523 - DNA, 2429 bp, Homo sapiens
  Payload ID: 526
  Gene Symbol: ACOT7
  Gene Name: acyl-CoA thioesterase 7
  Uniprot ID: O00154
  ENST ID: ENST00000361521
  CDS Start-End: 993-2105
gccggagttgcgtgggttttaatttaaagatgtaagtacaaatctatgtgcattgtagaaaattcggaaaaggtccaactgcctagcaagtaaaaagctgtcattccagcacgtggggggtgaccgcttctcccttcttgggtgttttttggtggattttttttggtgaccccgactggcctagactccattcaagggcacatcttgtgcagtaaaacacgcatgtttcagggctcctcactgcaacacgtgcacctccaggctggcgctcagcgctcccagtaaaagctgcaggcggcggtgtagatagtcgccggcctttcctcctccccacctcgtgacgctttgtgctgcggaagcaaaggcccgttccattccccgtgtcttcccagcagccgccaccaatgctcctttctaggaaacagccttccattctctcttagggccgatcttagcgagagccgcgatgcgggcgactggtgccggggtgggttgggggcgggggtgggaatcaggccccactgccaggagcccgggccgcgccttccgctctgacctcatccggccgcccaggcactgggcgcggcagcgaatcggcggcgcgggcggccgggaacgcccagcacaaatatttaccgccgcgcggagagtgagggcccaagtccgccctgctccgccacttaggccgccccagacgcttccctcggggctgccaccgggtcgggcgcggctgccgcggctagcgggccttccccgcaccggcgcggcccaaccgccaccgaaccttctggaagcggcggctgcctgggcccccacgccgccagaatcgtacgcccgcgcgagctctctgcagccttggcggcctgggaggcggggctcggggtggggccggcgcgggggcggggtcggcgcggggaggccgcgttcgattgcccccggcgcgcaggccccgcctcaccagccccatcgctccacctctgccctccccctttatggcgcggcccgggctcattcattccgcgccgggcctgccagacacctgcgcccttctgcagccgcccgccgcatccgccgccgcagcccccagcatgtcgggcccagacgtcgagacgccgtccgccatccagatctgccggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctgg

SEQ ID NO: 104524 - DNA, 1813 bp, Homo sapiens
  Payload ID: 526
  Gene Symbol: ACOT7
  Gene Name: acyl-CoA thioesterase 7
  Uniprot ID: O00154
  ENST ID: ENST00000377842
  CDS Start-End: 500-1489
aggatgcaggcttggacctgctggagtccttgctggcctgtgaccttcctcccctgtctacatttcagggagctctagaaggcggcagtggggccagacctggctttggctgagaccctggagaaagactagggggtcttgtgccctgtcagagaaggcagagcctcatagccgcttccctgaggccgctcagcagcggcccctctgccttcctgatctcctggcatggcagccagaagagctcacagaattacttcttctgtaattatttataaagcaaggtttccatgacgaccggtttctggtagacgctctggattggcgaggcagcctcttcctggccagattgggcagctcaggaagctgggggtggggggtgctccccaccaagcccggtgtggcagggagctgggacagtcctgggtcaggcaaggactctgtgatgcttccctgctccctcgcctttctctgcatctgatcctgggatgtcctagccaccatggctttccagctgagcaggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctgg

SEQ ID NO: 104525 - DNA, 1432 bp, Homo sapiens
  Payload ID: 526
  Gene Symbol: ACOT7
  Gene Name: acyl-CoA thioesterase 7
  Uniprot ID: O00154
  ENST ID: ENST00000377845
  CDS Start-End: 56-1108
gagttccatttggctgcagcttctggagggagccgacaggagacgtggggagacgatgctcctgcttcggagaagcttgtcactaaacgtcctcagaaaggaagtcgacagggcctgttttggggagaaggccaaacagatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctgg

SEQ ID NO: 104526 - DNA, 1614 bp, Homo sapiens
  Payload ID: 526
  Gene Symbol: ACOT7
  Gene Name: acyl-CoA thioesterase 7
  Uniprot ID: O00154
  ENST ID: ENST00000377855
  CDS Start-End: 148-1290
cggtcctaggaggagcaggagcctggtgctttctatcagggagggatcacaccggctcactgctgagccggccaggcagacacaggcttgggctctgctgggcatcatacttgtcactgggtaaacagtttgcccacttaccgcaggatgaagctgcttgccagggctctccggctctgtgagtttgggaggcaggcatcttccaggaggctggtggctggccagggatgtgtggggccccggcgagggtgctgcgctcccgtccaggtggttgggcccagggctgatctcccaccctgtggagcctgcattactggaaggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctgg

SEQ ID NO: 104527 - DNA, 1472 bp, Homo sapiens
  Payload ID: 526
  Gene Symbol: ACOT7
  Gene Name: acyl-CoA thioesterase 7
  Uniprot ID: O00154
  ENST ID: ENST00000377860
  CDS Start-End: 59-910
gccagacacctgcgcccttctgcagccgcccgccgcatccgccgccgcagcccccagcatgtcgggcccagacgtcgagacgccgtccgccatccagatctgccggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaagctcacgtaatgcctgctggcgctgaccacacagctccttcctcctctcccagcactggcacgaagtgctccctgctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctgg

SEQ ID NO: 104528 - DNA, 1564 bp, Homo sapiens
  Payload ID: 526
  Gene Symbol: ACOT7
  Gene Name: acyl-CoA thioesterase 7
  Uniprot ID: O00154
  ENST ID: ENST00000418124
  CDS Start-End: 59-799
gccagacacctgcgcccttctgcagccgcccgccgcatccgccgccgcagcccccagcatgtcgggcccagacgtcgagacgccgtccgccatccagatctgccggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaagctccttagctggggcctgacccatggcctgccctcctcccggggtgcgtcttgtgactgcgggcgctttgcatgggactctgtaccttacagctcacgtaatgcctgctggcgctgaccacacagctccttcctcctctcccagcactggcacgaagtgctccctgctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctgg

SEQ ID NO: 104529 - DNA, 1804 bp, Homo sapiens
  Payload ID: 526
  Gene Symbol: ACOT7
  Gene Name: acyl-CoA thioesterase 7
  Uniprot ID: O00154
  ENST ID: ENST00000545482
  CDS Start-End: 368-1480
caaatatttaccgccgcgcggagagtgagggcccaagtccgccctgctccgccacttaggccgccccagacgcttccctcggggctgccaccgggtcgggcgcggctgccgcggctagcgggccttccccgcaccggcgcggcccaaccgccaccgaaccttctggaagcggcggctgcctgggcccccacgccgccagaatcgtacgcccgcgcgagctctctgcagccttggcggcctgggaggcggggctcggggtggggccggcgcgggggcggggtcggcgcggggaggccgcgttcgattgcccccggcgcgcaggccccgcctcaccagccccatcgctccacctctgccctccccctttatggcgcggcccgggctcattcattccgcgccgggcctgccagacacctgcgcccttctgcagccgcccgccgcatccgccgccgcagcccccagcatgtcgggcccagacgtcgagacgccgtccgccatccagatctgccggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctgg

SEQ ID NO: 104530 - DNA, 868 bp, Homo sapiens
  Payload ID: 526
  Gene Symbol: ACOT7
  Gene Name: acyl-CoA thioesterase 7
  ENST ID: ENST00000473466
  CDS Start-End: 30-868
tctgatttggggaaagggagaaggggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaagg

SEQ ID NO: 104531 - DNA, 1403 bp, Homo sapiens
  Payload ID: 526
  Gene Symbol: ACOT7
  Gene Name: acyl-CoA thioesterase 7
  Uniprot ID: O00154
  ENST ID: ENST00000608083
  CDS Start-End: 59-1075
gccagacacctgcgcccttctgcagccgcccgccgcatccgccgccgcagcccccagcatgtcgggcccagacgtcgagacgccgtccgccatccagatctgccggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctggaccc

SEQ ID NO: 104532 - DNA, 1168 bp, Homo sapiens
  Payload ID: 527
  Gene Symbol: ACOT8
  Gene Name: acyl-CoA thioesterase 8
  Uniprot ID: O14734
  ENST ID: ENST00000217455
  CDS Start-End: 92-1051
tactagggcaatctgccggaagagtcaggttctgtgtatgtctccgcgtcttccgcggagcgggtgtgcagggcctgcagcattgaactagatgtcgtccccgcaggccccagaagatgggcagggctgtggcgaccgcggcgatccccctggggacctccgtagcgtcttggtcacgaccgtgctcaacctcgagccgctggacgaggatctcttcagaggaaggcattactgggtaccggccaagaggctgtttggtggtcagatcgtgggccaggccctggtggctgcagccaagtctgtgagtgaagacgtccacgtgcactccctgcactgctactttgttcgggcaggggacccgaagctgccagtactgtaccaagtggagcggacacgaacagggtcgagcttctcggtgcgctctgtgaaggccgtgcaacatgggaagcccatcttcatctgccaggcctccttccagcaggcccagcccagccccatgcagcaccagttctccatgcccactgtgccaccaccagaagagctgcttgactgtgagaccctcattgaccagtatttaagggaccctaacctccaaaagaggtacccattggcgctcaaccgaattgctgctcaggaggtccccattgagatcaagccagtaaacccatcccccctgagccagctgcagagaatggagcccaaacagatgttctgggtgcgagcccggggctatattggcgagggcgacatgaagatgcactgctgcgtggccgcctatatctccgactatgccttcttgggcactgcactgctgcctcaccagtggcagcacaaggtgcacttcatggtctcactggaccattccatgtggttccacgcccccttccgagctgaccactggatgctctatgaatgcgagagcccctgggccggtggctctcgggggctggtccatgggcggctgtggcgtcaggatggagtcctagctgtgacctgtgcccaggagggcgtgatccgagtgaagccccaggtctcagagagcaagctgtagccagaggtaccagcttcgcctggggcttcaagaacctcccatctatccccattcctgagacaggagttacagtcccttttggccctcacatccaataaagagactgataccactgga

SEQ ID NO: 104533 - DNA, 708 bp, Homo sapiens
  Payload ID: 527
  Gene Symbol: ACOT8
  Gene Name: acyl-CoA thioesterase 8
  ENST ID: ENST00000457981
  CDS Start-End: 1-223
tctcttcagaggaaggcattactgggtaccggccaagaggctgtttggtggtcagatcgtgggccaggccctggtggctgcagccaagtctgtgagtgaagacgtccacgtgcactccctgcactgctactttgttcgggcagagcagatgccctcatgtgttctgcgtagatccccagctgagaagagtttgtggacctttacagtatgtgatttgtattaagaaaaccatggggtttcccccttcattttgtaaatatgaaagttatccctgtaatggtaaatacactttttcatactgtcccgtgtctcttactcctcatccctgaggagtattgattggcccccctcttctcggcccccagtcactgctataaagtatttgaatacttaccttgggctcagccaggttcttatctttatgctagttgggagtaaatatgtgctttgtttctttaatttgtttgtaagtaccagccttttgatattgtaatccttccagcctagtgaaatacctggctgttttcttttgtgtgggtgggggcattacttgaactctgaatctcttcatcctgtgatggaagaattcaatgagtctttgccagtaaagtatctagtgcagggcttggcataatctagttttccataaatattattagtttttgatgattaacttatgggaataattaaaatttgcatgatacagag

SEQ ID NO: 104534 - DNA, 814 bp, Homo sapiens
  Payload ID: 527
  Gene Symbol: ACOT8
  Gene Name: acyl-CoA thioesterase 8
  ENST ID: ENST00000426915
  CDS Start-End: 1-279
tccccgcaggccccagaagatgggcagggctgtggcgaccgcggcgatccccctggggacctccgtagcgtcttggtcacgaccgtgctcaacctcgagccgctggacgaggatctcttcagaggaaggcattactgggtaccggccaagaggctgtttggtggtcagatcgtgggccaggccctggtggctgcagccaagtctgtgagtgaagacgtccacgtgcactccctgcactgctactttgttcgggcagatgccctcatgtgttctgcgtagatccccagctgagaagagtttgtggacctttacagtatgtgatttgtattaagaaaaccatggggtttcccccttcattttgtaaatatgaaagttatccctgtaatggtaaatacactttttcatactgtcccgtgtctcttactcctcatccctgaggagtattgattggcccccctcttctcggcccccagtcactgctataaagtatttgaatacttaccttgggctcagccaggttcttatctttatgctagttgggagtaaatatgtgctttgtttctttaatttgtttgtaagtaccagccttttgatattgtaatccttccagcctagtgaaatacctggctgttttcttttgtgtgggtgggggcattacttgaactctgaatctcttcatcctgtgatggaagaattcaatgagtctttgccagtaaagtatctagtgcagggcttggcataatctagttttccataaatattattagtttttgatgattaacttatgggaataattaaaatttgcatgatacag

SEQ ID NO: 104535 - DNA, 702 bp, Homo sapiens
  Payload ID: 527
  Gene Symbol: ACOT8
  Gene Name: acyl-CoA thioesterase 8
  ENST ID: ENST00000487205
  CDS Start-End: 1-629
attactgggtaccggccaagaggctgtttggtggtcagatcgtgggccaggccctggtggctgcagccaagtctgtgagtgaagacgtccacgtgcactccctgcactgctactttgttcgggcaggggacccgaagctgccagtactgtaccaagtggagcggacacgaacagggtcgagcttctcggtgcgctctgtgaaggccgtgcaacatgggaagcccatcttcatctgccaggcctccttccagcaggcccagcccagccccatgcagcaccagttctccatgcccactgtgccaccaccagaagagctgcttgactgtgagaccctcattgaccagtatttaagggaccctaacctccaaaagaggtacccattggcgctcaaccgaattgctgctcaggaggtccccattgagatcaagccagtaaacccatcccccctgagccagctgcagagaatggagcccaaacagatgttctgggtgcgagcccggggctatattggtggctctcgggggctggtccatgggcggctgtggcgtcaggatggagtcctagctgtgacctgtgcccaggagggcgtgatccgagtgaagccccaggtctcagagagcaagctgtagccagaggtaccagcttcgcctggggcttcaagaacctcccatctatccccattcctgagacaggagttacagt

SEQ ID NO: 104536 - DNA, 552 bp, Homo sapiens
  Payload ID: 527
  Gene Symbol: ACOT8
  Gene Name: acyl-CoA thioesterase 8
  ENST ID: ENST00000481938
  CDS Start-End: 91-375
actagggcaatctgccggaagagtcaggttctgtgtatgtctccgcgtcttccgcggagcgggtgtgcagggcctgcagcattgaactagatgtcgtccccgcaggccccagaagatgggcagggctgtggcgaccgcggcgatccccctggggacctccgtagcgtcttggtcacgaccgtgctcaacctcgagccgctggacgaggatctcttcagaggaaggcattactgggtaccggccaagaggctgtttggtggtcagatcgtgggccaggccctggtggctgcagccaagtctgtgagtgaagacgtccacgtgcactccctgcactgctactttgttcgggcagatgccctcatgtgttctgcgtagatccccagctgagaagagtttgtggacctttacagggacccgaagctgccagtactgtaccaagtggagcggacacgaacagggtcgagcttctcggtgcgctctgtgaaggccgtgcaacatgggaagcccatcttcatctgccaggcctccttccagcaggcccagcccagcccc

SEQ ID NO: 104537 - DNA, 764 bp, Homo sapiens
  Payload ID: 527
  Gene Symbol: ACOT8
  Gene Name: acyl-CoA thioesterase 8
  ENST ID: ENST00000486165
  CDS Start-End: 57-455
gtatgtctccgcgtcttccgcggagcgggtgtgcagggcctgcagcattgaactagatgtcgtccccgcaggccccagaagatgggcagggctgtggcgaccgcggcgatccccctggggacctccgtagcgtcttggtcacgaccgtgctcaacctcgagccgctggacgaggatctcttcagaggaaggcattactgggtaccggccaagaggctgtttggtggtcagatcgtgggccaggccctggtggctgcagccaagtctgtgagtgaagacgtccacgtgcactccctgcactgctactttgttcgggcagagcagatgccctcatgtgttctgcgtagatccccagctgagaagagtttgtggacctttacagggacccgaagctgccagtactgtaccaagtggagcggacacgaacagggtcgagcttctcggtgcgctctgtgaaggccgtgcaacatgggaagcccatcttcatctgccaggcctccttccagcaggcccagcccagccccatgcagcaccagttctccatgcccactgtgccaccaccagaagagctgcttgactgtgagaccctcattgaccagtatttaagggaccctaacctccaaaagaggtacccattggcgctcaaccgaattgctgctcaggaggtccccattgagatcaagccagtaaacccatcccccctgagccagctgcagagaatggagcccaaacagatgttctgggtgcgagcccggggctatattg

SEQ ID NO: 104538 - DNA, 1187 bp, Homo sapiens
  Payload ID: 527
  Gene Symbol: ACOT8
  Gene Name: acyl-CoA thioesterase 8
  ENST ID: ENST00000483141
  CDS Start-End: 55-570
atgtctccgcgtcttccgcggagcgggtgtgcagggcctgcagcattgaactagatgtcgtccccgcaggccccagaagatgggcagggctgtggcgaccgcggcgatccccctggggacctccgtagcgtcttggtcacgaccgtgctcaacctcgagccgctggacgaggatctcttcagggaccctaacctccaaaagaggtacccattggcgctcaaccgaattgctgctcaggaggtccccattgagatcaagccagtaaacccatcccccctgagccagctgcagagaatggagcccaaacagatgttctgggtgcgagcccggggctatattggcgagggcgacatgaagatgcactgctgcgtggccgcctatatctccgactatgccttcttgggcactgcactgctgcctcaccagtggcagcacaaggtgcacttcatggtctcactggaccattccatgtggttccacgcccccttccgagctgaccactggatgctctatgaatgcgagagcccctgggccggctttggcatcttcatcttcaaaatgagagggtgaggccgggacacctgctctgctctaaatttctagaatgtgctggaaatgtgattcaccttctcccagggacccagttctagtcccaaaaccagttcagattctttgtattacaataggcaaatcatatcttccatctgaacctcagtttcctcatctaaacaaagagggttacattacagcagtggtatccaaacccgcagtccatcagactgccatttggggatgccttttcaaaatagattctgattccaccctcaagattctcactcagtaggtcttggataaggtccaggaaactgtatttttaagttctctaagtgattctgattaacctgattgggatcggggcattcagtggtccctaagggcctgcttggaccttccttgcaggggagagaaacaagactcgttcatcaatgtctagcttcagaaccctgacctcctttccaagggagtacatttcaaatgaagaaaagctttgcttgataaaccaaggacaaaactcaaggattctttatactcagataaggggtattctcaagtaccaatagcatcacaatccaagattgataaccttgaagtgaggacatgggttcagatttggcttcatcatgggg

SEQ ID NO: 104539 - DNA, 1013 bp, Homo sapiens
  Payload ID: 527
  Gene Symbol: ACOT8
  Gene Name: acyl-CoA thioesterase 8
  ENST ID: ENST00000488679
  CDS Start-End: 88-411
agggcaatctgccggaagagtcaggttctgtgtatgtctccgcgtcttccgcggagcgggtgtgcagggcctgcagcattgaactagatgtcgtccccgcaggccccagaagatgggcagggctgtggcgaccgcggcgatccccctggggacctccgtagcgtcttggtcacgaccgtgctcaacctcgagccgctggacgaggatctcttcaggggacccgaagctgccagtactgtaccaagtggagcggacacgaacagggtcgagcttctcggtgcgctctgtgaaggccgtgcaacatgggaagcccatcttcatctgccaggcctccttccagcaggcccagcccagccccatgcagcaccagttctccatgcccactgtgccaccaccagaagagctgcttgactgtgagaccctcattgaccagtatttaagggaccctaacctccaaaagaggtacccattggcgctcaaccgaattgctgctcaggaggtccccattgagatcaagccagtaaacccatcccccctgagccagctgcagagaatggagcccaaacagatgttctgggtgcgagcccggggctatattggcgagggcgacatgaagatgcactgctgcgtggccgcctatatctccgactatgccttcttgggcactgcactgctgcctcaccagtggcagcacaaggtgcacttcatggtctcactggaccattccatgtggttccacgcccccttccgagctgaccactggatgctctatgaatgcgagagcccctgggccggtggctctcgggggctggtccatgggcggctgtggcgtcaggatggagtcctagctgtgacctgtgcccaggagggcgtgatccgagtgaagccccaggtctcagagagcaagctgtagccagaggtaccagcttcgcctggggcttcaagaacctcccatctatccccattcctgagacaggagttacagtcccttttggccctcacatccaataaag

SEQ ID NO: 104540 - DNA, 1197 bp, Homo sapiens
  Payload ID: 527
  Gene Symbol: ACOT8
  Gene Name: acyl-CoA thioesterase 8
  ENST ID: ENST00000461272
  CDS Start-End: 75-755
ggaagagtcaggttctgtgtatgtctccgcgtcttccgcggagcgggtgtgcagggcctgcagcattgaactagatgtcgtccccgcaggccccagaagatgggcagggctgtggcgaccgcggcgatccccctggggacctccgtagcgtcttggtcacgaccgtgctcaacctcgagccgctggacgaggatctcttcagaggaaggcattactgggtaccggccaagaggctgtttggtggtcagatcgtgggccaggccctggtggctgcagccaagtctgtgagtgaagacgtccacgtgcactccctgcactgctactttgttcgggcaggggacccgaagctgccagtactgtaccaagtggagcggacacgaacagggtcgagcttctcggtgcgctctgtgaaggccgtgcaacatgggaagcccatcttcatctgccaggcctccttccagcaggcccagcccagccccatgcagcaccagttctccatgcccactgtgccaccaccagaagagctgcttgactgtgagaccctcattgaccagtatttaagggaccctaacctccaaaagaggtacccattggcgctcaaccgaattgctgctcaggaggtccccattgagatcaagccagtaaacccatcccccctgagccagctgcagagaatggagcccaaacagatgttctgggtgcgagcccggggctatattggtcctgagctggaaagcccaggagcccagggctgatggggacctgttgcaggcgagggcgacatgaagatgcactgctgcgtggccgcctatatctccgactatgccttcttgggcactgcactgctgcctcaccagtggcagcacaaggtgcacttcatggtctcactggaccattccatgtggttccacgcccccttccgagctgaccactggatgctctatgaatgcgagagcccctgggccggtggctctcgggggctggtccatgggcggctgtggcgtcaggatggagtcctagctgtgacctgtgcccaggagggcgtgatccgagtgaagccccaggtctcagagagcaagctgtagccagaggtaccagcttcgcctggggcttcaagaacctcccatctatccccattcctgagacaggagttacagtcccttttggccctcacatccaataaagagactgatacca

SEQ ID NO: 104541 - DNA, 1675 bp, Homo sapiens
  Payload ID: 528
  Gene Symbol: ACOT9
  Gene Name: acyl-CoA thioesterase 9
  Uniprot ID: Q9Y305
  ENST ID: ENST00000336430
  CDS Start-End: 133-1452
gctgtccggctcccgggctgtcctcagcaagggcgcggtctggtactcgtgcgtcttttatcgcctcagtttccctccgccgactagcgcgcggggcccggttctccatcgcgcgcacggcagcctagcgcaatgaggcgggcagcactgcggctttgtgccttgggcaaagggcagcttactcctggaagaggactgactcaaggaccccagaaccccaagaaacagggaatcttccacattcatgaagttcgagataagttgcgggagatagtaggagcatccacaaactggagagaccatgtgaaggcaatggaagaaaggaaattacttcatagtttcttggctaaatcacaggatggactgcctcctaggagaatgaaggacagttatattgaagttctcttgcctttgggcagtgagcctgaattacgagagaaatatttgactgttcaaaacaccgtaagatttggcaggattcttgaggatcttgacagcttgggagttcttatttgttacatgcacaacaaaatccactccgccaagatgtctcctttatcgatagttacagccctggtggataagattgatatgtgtaagaagagcttgagcccagaacaggacattaagttcagtggccatgttagctgggtcgggaagacatccatggaagtgaagatgcaaatgttccagttacatggtgatgaattttgtcctgttttggatgcaacatttgtaatggtggctcgtgattctgaaaataaagggccggcatttgtaaatccactcatccctgaaagcccagaggaagaggagctctttagacaaggggaattgaacaaggggagaagaattgccttcagctccacgtcgttactgaaaatggcccccagcgctgaggagaggaccaccatacatgagatgtttctcagcacactggatccaaagactataagttttcggagtcgagttttaccctctaatgcagtgtggatggagaattcaaaactgaagagtttggaaatttgccaccctcaggagcggaacattttcaatcggatctttggtggtttccttatgaggaaggcatatgaacttgcgtgggctactgcttgtagctttggtggttctcgaccgtttgtggtagcagtagatgacatcatgtttcagaaacctgttgaggttggctcattgctctttctttcttcacaggtatgctttactcagaataattatattcaagtcagagtacacagtgaagtggcctccctgcaggagaagcagcatacaaccaccaatgtctttcatttcacgttcatgtcggaaaaagaagtgccattggttttcccaaaaacatatggagagtccatgttgtacttagatgggcagcggcatttcaactccatgagtggcccagcgaccttgagaaaggactaccttgtggagccctaagaacaccacatttgttgaaaactagcactctacccacagtgacgtggtatctgatgaagacctgatcgagtgtattgattttagtattgcttcgtgtcctccacacaggaggaggatgtattcagcctttaggatgatcagaaaagcagaaagagagagtggccggatggggctgaggggagaaagaattattaaacaataaatactttcaagacaattttaa

SEQ ID NO: 104542 - DNA, 2768 bp, Homo sapiens
  Payload ID: 528
  Gene Symbol: ACOT9
  Gene Name: acyl-CoA thioesterase 9
  Uniprot ID: Q9Y305
  ENST ID: ENST00000379295
  CDS Start-End: 1419-2558
aagagcagtaacacaaacagggctgaaacacgccctcctcccgtccccacacccccgcgacttgccatgttgcgggtgatgtgaaggagagaagtgctgtggcccttcagggagcacagacctaggggctccctgagccagggctgtgacaccctctttggggctctgcggtttctggtatcttcaaacttccgggcaccactgcattccccttgtccagacacaggtgcccacagcagaagccgcttgtggttcatcagatccagctgcagacttgcatagaaccggcacctttgccggcgcctggagctgcctgcccagctgcagcagctggtgtgtccggctctgcgcagtggccagaccctgcgttcgctcgcctgcacacccctcgctgttccgtgcctggctcaccctcggcaggcgtggaatcctggctggtagcatgagctgagcacagcctgccaggccacgtcagtggaacaagtctggcgggcctgatcaaaactcaggcaaaggcaccactggtcacagagctttctagctggaaaagcaacacctgaaggatcccgtgacacaatcaacctgctaggagatccctgccaccctgagaggctgcaggaagctgcctccatccaggcctcttcacagaaggagaattgcagagaccgtaggatttttctactcacaggaacagatggtgtccggtcaggaaggtaaaatgcttcaagaaaagtgcaatagggattataatactgatgatctgagactctgataatgactctgagatgattcccaattctatgatgaatcatctcagaatgactccgagatgatgattcctgattctacgatgattgaggcagagctcactggttggtgaatctagttggtagagctgaggcaccgcaataccatcatttctttctgaggaaatctaaagatgaaagaattcatcactaaaactgtactacgagaaatgctaaaggaagttgttcaaactgatggaaaattataccagatggacacttgaatttgcccaaaggaatgaagagcaccagaaatggcaaatgtgtggtcttactgtatcttcatgtcagtgtcatatcaaggacaagacagcagaaatggtccactccagttgcagatagtaaagaccctgtagctccagcatcagctcacctttctggttttgaatttcatgcttattaccatcctgtcatcacctactgtttccatggtagacgggactaagagatgggctttgtgccttgggcaaagggcagcttactcctggaagaggactgactcaaggaccccagaaccccaagaaacagggaatcttccacattcatgaagttcgagataagttgcgggagatagtaggagcatccacaaactggagagaccatgtgaaggcaatggaagaaaggaaattacttcatagtttcttggctaaatcacaggatggactgcctcctaggagaatgaaggacagttatattgaagttctcttgcctttgggcagtgagcctgaattacgagagaaatatttgactgttcaaaacaccgtaagatttggcaggattcttgaggatcttgacagcttgggagttcttatttgttacatgcacaacaaaatccactccgccaagatgtctcctttatcgatagttacagccctggtggataagattgatatgtgtaagaagagcttgagcccagaacaggacattaagttcagtggccatgttagctgggtcgggaagacatccatggaagtgaagatgcaaatgttccagttacatggtgatgaattttgtcctgttttggatgcaacatttgtaatggtggctcgtgattctgaaaataaagggccggcatttgtaaatccactcatccctgaaagcccagaggaagaggagctctttagacaaggggaattgaacaaggggagaagaattgccttcagctccacgtcgttactgaaaatggcccccagcgctgaggagaggaccaccatacatgagatgtttctcagcacactggatccaaagactataagttttcggagtcgagttttaccctctaatgcagtgtggatggagaattcaaaactgaagagtttggaaatttgccaccctcaggagcggaacattttcaatcggatctttggtggtttccttatgaggaaggcatatgaacttgcgtgggctactgcttgtagctttggtggttctcgaccgtttgtggtagcagtagatgacatcatgtttcagaaacctgttgaggttggctcattgctctttctttcttcacaggtatgctttactcagaataattatattcaagtcagagtacacagtgaagtggcctccctgcaggagaagcagcatacaaccaccaatgtctttcatttcacgttcatgtcggaaaaagaagtgccattggttttcccaaaaacatatggagagtccatgttgtacttagatgggcagcggcatttcaactccatgagtggcccagcgaccttgagaaaggactaccttgtggagccctaagaacaccacatttgttgaaaactagcactctacccacagtgacgtggtatctgatgaagacctgatcgagtgtattgattttagtattgcttcgtgtcctccacacaggaggaggatgtattcagcctttaggatgatcagaaaagcagaaagagagagtggccggatggggctgaggggagaaagaattattaaacaataaatactttc

SEQ ID NO: 104543 - DNA, 3117 bp, Homo sapiens
  Payload ID: 528
  Gene Symbol: ACOT9
  Gene Name: acyl-CoA thioesterase 9
  Uniprot ID: Q9Y305
  ENST ID: ENST00000379303
  CDS Start-End: 130-1476
gtccggctcccgggctgtcctcagcaagggcgcggtctggtactcgtgcgtcttttatcgcctcagtttccctccgccgactagcgcgcggggcccggttctccatcgcgcgcacggcagcctagcgcaatgaggcgggcagcactgcggctttgtgccttgggcaaagggcagcttactcctggaagaggactgactcaaggaccccagaaccccaagaaacagggaatcttccacattcatgaagcatgttcatctatacatgtgaatcatgttcgagataagttgcgggagatagtaggagcatccacaaactggagagaccatgtgaaggcaatggaagaaaggaaattacttcatagtttcttggctaaatcacaggatggactgcctcctaggagaatgaaggacagttatattgaagttctcttgcctttgggcagtgagcctgaattacgagagaaatatttgactgttcaaaacaccgtaagatttggcaggattcttgaggatcttgacagcttgggagttcttatttgttacatgcacaacaaaatccactccgccaagatgtctcctttatcgatagttacagccctggtggataagattgatatgtgtaagaagagcttgagcccagaacaggacattaagttcagtggccatgttagctgggtcgggaagacatccatggaagtgaagatgcaaatgttccagttacatggtgatgaattttgtcctgttttggatgcaacatttgtaatggtggctcgtgattctgaaaataaagggccggcatttgtaaatccactcatccctgaaagcccagaggaagaggagctctttagacaaggggaattgaacaaggggagaagaattgccttcagctccacgtcgttactgaaaatggcccccagcgctgaggagaggaccaccatacatgagatgtttctcagcacactggatccaaagactataagttttcggagtcgagttttaccctctaatgcagtgtggatggagaattcaaaactgaagagtttggaaatttgccaccctcaggagcggaacattttcaatcggatctttggtggtttccttatgaggaaggcatatgaacttgcgtgggctactgcttgtagctttggtggttctcgaccgtttgtggtagcagtagatgacatcatgtttcagaaacctgttgaggttggctcattgctctttctttcttcacaggtatgctttactcagaataattatattcaagtcagagtacacagtgaagtggcctccctgcaggagaagcagcatacaaccaccaatgtctttcatttcacgttcatgtcggaaaaagaagtgccattggttttcccaaaaacatatggagagtccatgttgtacttagatgggcagcggcatttcaactccatgagtggcccagcgaccttgagaaaggactaccttgtggagccctaagaacaccacatttgttgaaaactagcactctacccacagtgacgtggtatctgatgaagacctgatcgagtgtattgattttagtattgcttcgtgtcctccacacaggaggaggatgtattcagcctttaggatgatcagaaaagcagaaagagagagtggccggatggggctgaggggagaaagaattattaaacaataaatactttcaagacaattttaattgtgaacctaccatgttgcctcccatcttctgaaaaaacaaaaaaattgagaggctgggcgtggtggctcatgcctataatcccagcactttgggaggctgaggcgggcggatcatgaagtcaggagatcaagaccatcctggccaacatggtgaaaccctgtctctactaaaaatacagaaaattagccgtggtggcatgtgcctgtagtcccagctacttgggaggctgaggcaggagaattgcttgaacccaggaggtggaggttgcagtgagctgagattgcaccattgcactccagcctgggcgacagagagagactgtctcaaaaattaattaattaattaattaattgaggataccattggatgcattcttttcttacacatattgcaactgtcagtatacaaggtttcctgccagggtatttggatgacgttctttaaacctaaccacttgctctgtgctgtctaaatcccatcagccgtacatgattcctttgcttccctctatttcccagcttttgttgtcagagggtagatgaaaagttggggcgaagggatttaacaaaagttactgcatccgtaaagatttgtgggaagatttaggtctgaaaccataccattagaaggtgtttagagatgatctagataaggaaatacaggaccatttggtcattctttcattcaccagacagctatttagcacattctgctagtggctccgcaggatatatctgatttaaaaaataggaaccacaataataatagctgcttatgcttatggagcattgccatgtgctagataggcaccatcctcagcccttggcaggtctgagctcctttatttcttccaatcaacactatgaggcaggttctgtaaccccccttagggttaggccactcgggaaactgaagcacagagagtttaagtaacttcctggaggtccgacgcgtaacatgtggaggtgctgggattcaaaaccaggcaatgtgggtcccgggcactcttgaccagtgcctgtacttcttccaaggaatagagcaagggaggtcataccgaatatcacagtgtcacctaggaagcccaagggaggtattcccgttaatctgcagccaaggccgggcgcggtagctcatgcctgtaatcccagcactttgggaggccaaggcggatggatcatgaggtcaggagttcaagaccagcctggccgagatggtgaaaccccgtttctactaaaaatacaaaaattagccgggcgtggtggcggacgcctgtaatcccagctactcgggaggctgaggcagagaactgcttgaacctgggaggcagaggttgcagtgagctgtgatcatgccactgcactccagcctgggtgacagaacgagactccatctcaaaaaaaaaaaaaaaaaaa

SEQ ID NO: 104544 - DNA, 683 bp, Homo sapiens
  Payload ID: 528
  Gene Symbol: ACOT9
  Gene Name: acyl-CoA thioesterase 9
  ENST ID: ENST00000492081
  CDS Start-End: 189-599
gcaagggcgcggtctggtactcgtgcgtcttttatcgcctcagtttccctccgccgactagcgcgcggggcccggttctccatcgcgcgcacggcagcctagcgcaatgaggcgggcagcactgcgttcgagataagttgcgggagatagtaggagcatccacaaactggagagaccatgtgaaggcaatggaagaaaggaaattacttcatagtttcttggctaaatcacaggatggactgcctcctaggagaatgaaggacagttatattgaagttctcttgcctttgggcagtgagcctgaattacgagagaaatatttgactgttcaaaacaccgtaagatttggcaggattcttgaggatcttgacagcttgggagttcttatttgttacatgcacaacaaaatccactccgccaagatgtctcctttatcgatagttacagccctggtggataagattgatatgtgtaagaagagcttgagcccagaacaggacattaagttcagtggccatgttagctgggtcgggaagacatccatggaagtgaagatgcaaatgttccaggccggcatttgtaaatccactcatccctgaaagcccagaggaagaggagctctttagacaaggggaatgtacattaatttgtttataataaaataaatttgaaaagcacattaa

SEQ ID NO: 104545 - DNA, 1682 bp, Homo sapiens
  Payload ID: 528
  Gene Symbol: ACOT9
  Gene Name: acyl-CoA thioesterase 9
  ENST ID: ENST00000494361
  CDS Start-End: 147-287
cgcccccggacaccgctgtccggctcccgggctgtcctcagcaagggcgcggtctggtactcgtgcgtcttttatcgcctcagtttccctccgccgactagcgcgcggggcccggttctccatcgcgcgcacggcagcctagcgcaatgaggcgggcagcactgcggctttgtgccttgggcaaagggcagcttactcctggaagaggactgactcaaggaccccagaaccccaagaaacagggaatcttccacattcatgaaggcaagcatggtgtctctgtttgatgcctatgtgataagttgcgggagatagtaggagcatccacaaactggagagaccatgtgaaggcaatggaagaaaggaaattacttcatagtttcttggctaaatcacaggatggactgcctcctaggagaatgaaggacagttatattgaagttctcttgcctttgggcagtgagcctgaattacgagagaaatatttgactgttcaaaacaccgtaagatttggcaggattcttgaggatcttgacagcttgggagttcttatttgttacatgcacaacaaaatccactccgccaagatgtctcctttatcgatagttacagccctggtggataagattgatatgtgtaagaagagcttgagcccagaacaggacattaagttcagtggccatgttagctgggtcgggaagacatccatggaagtgaagatgcaaatgttccagttacatggtgatgaattttgtcctgttttggatgcaacatttgtaatggtggctcgtgattctgaaaataaagggccggcatttgtaaatccactcatccctgaaagcccagaggaagaggagctctttagacaaggggaattgaacaaggggagaagaattgccttcagctccacgtcgttactgaaaatggcccccagcgctgaggagaggaccaccatacatgagatgtttctcagcacactggatccaaagactataagttttcggagtcgagttttaccctctaatgcagtgtggatggagaattcaaaactgaagagtttggaaatttgccaccctcaggagcggaacattttcaatcggatctttggtggtttccttatgaggaaggcatatgaacttgcgtgggctactgcttgtagctttggtggttctcgaccgtttgtggtagcagtagatgacatcatgtttcagaaacctgttgaggttggctcattgctctttctttcttcacaggtatgctttactcagaataattatattcaagtcagagtacacagtgaagtggcctccctgcaggagaagcagcatacaaccaccaatgtctttcatttcacgttcatgtcggaaaaagaagtgccattggttttcccaaaaacatatggagagtccatgttgtacttagatgggcagcggcatttcaactccatgagtggcccagcgaccttgagaaaggactaccttgtggagccctaagaacaccacatttgttgaaaactagcactctacccacagtgacgtggtatctgatgaagacctgatcgagtgtattgattttagtattgcttcgtgtcctccacacaggaggaggatgtattcagcctttaggatgatcagaaaagcagaaagagagagtggccggatggggctgaggggagaaagaat

SEQ ID NO: 104546 - DNA, 793 bp, Homo sapiens
  Payload ID: 528
  Gene Symbol: ACOT9
  Gene Name: acyl-CoA thioesterase 9
  ENST ID: ENST00000473710
  CDS Start-End: 1-793
atagtaggagcatccacaaactggagagaccatgtgaaggcaatggaagaaaggaaattacttcatagtttcttggctaaatcacaggatggactgcctcctaggagaatgaaggacagttatattgaagttctcttgcctttgggcagtgagcctgaattacgagagaaatatttgactgttcaaaacaccgtaagatttggcaggattcttgaggatcttgacagcttgggagatatgtgtaagaagagcttgagcccagaacaggacattaagttcagtggccatgttagctgggtcgggaagacatccatggaagtgaagatgcaaatgttccagttacatggtgatgaattttgtcctgttttggatgcaacatttgtaatggtggctcgtgattctgaaaataaagggccggcatttgtaaatccactcatccctgaaagcccagaggaagaggagctctttagacaaggggaattgaacaaggggagaagaattgccttcagctccacgtcgttactgaaaatggcccccagcgctgaggagaggaccaccatacatgagatgtttctcagcacactggatccaaagactataagttttcggagtcgagttttaccctctaatgcagtgtggatggagaattcaaaactgaagagtttggaaatttgccaccctcaggagcggaacattttcaatcggatctttggtggtttccttatgaggaaggcatatgaacttgcgtgggctactgcttgtagctttggtggttctcgaccgtttgtggtag

SEQ ID NO: 104547 - DNA, 1365 bp, Homo sapiens
  Payload ID: 529
  Gene Symbol: AWAT1
  Gene Name: acyl-CoA wax alcohol acyltransferase 1
  Uniprot ID: Q58HT5
  ENST ID: ENST00000374521
  CDS Start-End: 42-1028
actgttctgagatctttgcctccctcaggctcccgagaatcatggctcattccaagcagcctagtcacttccagagtctgatgcttctgcagtggcctttgagctaccttgccatcttttggatcttgcagccattgttcgtctacctgctgtttacatccttgtggccgctaccagtgctttactttgcctggttgttcctggactggaagaccccagagcgaggtggcaggcgttcggcctgggtaaggaactggtgtgtctggacccacatcagggactatttccccattacgatcctgaagacaaaggacctatcacctgagcacaactacctcatgggggttcacccccatggcctcctgacctttggcgccttctgcaacttctgcactgaggccacaggcttctcgaagaccttcccaggcatcactcctcacttggccacgctgtcctggttcttcaagatcccctttgttagggagtacctcatggccaaaggtgtgtgctctgtgagccagccagccatcaactatctgctgagccatggcactggcaacctcgtgggcattgtagtgggaggtgtgggtgaggccctgcaaagtgtgcccaacaccaccaccctcatcctccagaagcgcaaggggttcgtgcgcacagccctccagcatggggctcatctggtccccaccttcacttttggggaaactgaggtgtatgatcaggtgctgttccataaggatagcaggatgtacaagttccagagctgcttccgccgtatctttggtttctactgttgtgtcttctatggacaaagcttctgtcaaggctccactgggctcctgccatactccaggcctattgtcactgtggttggggagcctctgccactgccccaaattgaaaagccaagccaggagatggtggacaaataccatgcactttatatggatgctctgcacaaactgttcgaccagcataagacccactatggctgctcagagacccaaaagctgtttttcctgtgaatgaaggtactgcatgcccaggagcacaggagtgcctgccttgaagaagagactcatctgccactaaccaaagacaggcaggagatgagggaggttatatgtggtaggggagggcatgaggaattccttctttgccttcttgccacagggtccttacaggaattctttctgaagagctgcacacagtcattcctcaaaggagggcatcctagtgcccctcatgctggggcctgatgcctggtcatcatttgagtcctctgggacacattagcagtcactgcatattcccccagcccctgggcaactatctactttctgtctctgtggatttgccaat

SEQ ID NO: 104548 - DNA, 2124 bp, Homo sapiens
  Payload ID: 530
  Gene Symbol: AWAT2
  Gene Name: acyl-CoA wax alcohol acyltransferase 2
  Uniprot ID: Q6E213
  ENST ID: ENST00000276101
  CDS Start-End: 7-1008
ggcacaatgctcttgccctctaagaaggacctcaagactgccctggatgtctttgctgttttccagtggtccttcagtgccttgcttatcacaaccactgtgattgctgtcaacctctacctggtggtgttcacaccatactggcctgtcactgtgcttattcttacctggctggcttttgactggaagacccctcagcgaggcggccgccggtttacctgtgtgaggcactggcgcctgtggaaacactacagcgattatttccctctcaagcttctgaagactcatgacatctgccccagccgcaactacatcctcgtctgccaccctcatgggctctttgcccatggatggtttggccactttgccacagaggcctcaggcttctccaagatatttcctggcatcaccccttacatactcacactgggagcctttttctggatgcctttcctcagagaatatgtaatgtctacaggggcctgctctgtgagtcgatcctccattgactttctgctgactcataaaggcacaggcaacatggtcattgtggtgattggtggactggctgagtgcagatacagcctgccaggttcttctaccctggtgttgaagaaccggtctggctttgtgcgcatggcccttcagcatggggtgcctctaatacctgcctatgcctttggggagacggacctctatgatcagcacattttcactcctggtggctttgtcaaccgcttccagaagtggttccagagcatggtacacatctacccttgtgctttctatggacgtggcttcaccaagaactcctggggccttctgccctatagtcggcctgtaaccaccatcgtcggggagcctctaccaatgcccaagattgagaatccaagccaggagatcgtggctaaatatcacacactctatattgatgccctacgtaaactgtttgaccagcataagaccaagtttggtatctcagagacccaggagctggagataatttgacagacatccccagtagccttcaccctggctggaagctcttttctgccctttctttgcagctactggtgagatagtcccaagaaacagggaagagcctaggggagaggtgccctgacggcactttggtgccagcattgaggaaaacaatggacaaaataaaaagcccatcttctgataactgcgtgtgcaccaactactctgttttgaaggctctgggatgcatgtctctccttctctagctgtcaaacagccccatctcccggcattgagccccatcttctggcattgagtcctgcttcctacaggagtaggactggggccttgagagccagtgggctttgagtttaagctccaccaacttcaagccatgtgactttggggcaatcagtcacctctgagcctcctttcttcttctataaaatgagactaacaatctgtctcttgcttacctcaaaggccgttgggaagatcaaacaatattggatgtgattgaactttataaactggagagctacaccattttcttctccaaccattttacccatttcctgtccctgagcaaacaacgcccgaaataccctctgctacccactagccctcactcagtttctgcctcacaaagctgtaacagaatgggttgggctcaggcctaattttctctgtcattccctcagcaacttgcctatacttgtgtggccctataattctggcctttgtttgagagtcagccagcctgctcaggatgaaaatgaggcgcctggcttttagcagccataaagaactctccttctgaatggcaagtctctcagactcttggtctaatggctgttgcaatgacaggctacaaaatttggctcacatccctctcattccatccctcttgggtgggtgccatttggtccagtgatttacctgcattacgttggtcaatttggtctacaacatcctgcgtgtttactgcagtgtgagctgctgcctctatcctgggtgcctgcctcatgtgatgatttgtatacagtggccaaagacatgcttctgcttttctgctgtctttgttacttcttgtgccagagattacgttttccctgagcttccataaagtgtttttaaacagtc

SEQ ID NO: 104549 - DNA, 986 bp, Homo sapiens
  Payload ID: 530
  Gene Symbol: AWAT2
  Gene Name: acyl-CoA wax alcohol acyltransferase 2
  ENST ID: ENST00000440401
  CDS Start-End: 1-501
gaggcctcaggcttctccaagatatttcctggcatcaccccttacatactcacactgggagcctttttctggatgcctttcctcagagaatatgtaatgtctacaggggcctgctctgtgagtcgatcctccattgactttctgctgactcataaaggcacaggcaacatggtcattgtggtgattggtggactggctgagtgcagatacagcctgccaggttcttctaccctggtgttgaagaaccggtctggctttgtgcgcatggcccttcagcatgggcagccaggggtaggccatggagcccccacactcaacttggacctaggcacagctggactggggtctgagaagcctgtaggcagacccagggatcatgcgccgtcagcgtgtctggcattcgacaaggtccctacctttctgggcttcagaagatatgcttttgctctgcagggtgcctctaatacctgcctatgcctttggggagacggacctctatgatcagcacattttcactcctggtggctttgtcaaccgcttccagaagtggttccagagcatggtacacatctacccttgtgctttctatggacgtggcttcaccaagaactcctggggccttctgccctatagtcggcctgtaaccaccatcgtcggggagcctctaccaatgcccaagattgagaatccaagccaggagatcgtggctaaatatcacacactctatattgatgccctacgtaaactgtttgaccagcataagaccaagtttggtatctcagagacccaggagctggagataatttgacagacatccccagtagccttcaccctggctggaagctcttttctgccctttctttgcagctactggtgagatagtcccaagaaacagggaagagcctaggggagaggtgccctgacggcactttggtgccagcattgaggaaaacaatggacaaaataaaaagcccatcttctgataa

SEQ ID NO: 104550 - DNA, 3849 bp, Homo sapiens
  Payload ID: 531
  Gene Symbol: AGK
  Gene Name: acylglycerol kinase
  Uniprot ID: Q53H12
  ENST ID: ENST00000355413
  CDS Start-End: 261-1529
atgaaaggaagagtgagccaataaacgagggaacgccgggaaaggcagcctcaagccggtgggccctgccacccccaccgtccctgagcatccgagccggttcccgcccccggcccgaactggcccgcgcgcgctcgcagccccgcggcggaacccgagggcggcggcagcggtttcccttgaacgagccggggaatctggagggagcacacaggaaaggcagagccgcgagctggaccagccgtgcaaatctctagaagatgacggtgttctttaaaacgcttcgaaatcactggaagaaaactacagctgggctctgcctgctgacctggggaggccattggctctatggaaaacactgtgataacctcctaaggagagcagcctgtcaagaagctcaggtgtttggcaatcaactcattcctcccaatgcacaagtgaagaaggccactgtttttctcaatcctgcagcttgcaaaggaaaagccaggactctatttgaaaaaaatgctgccccgattttacatttatctggcatggatgtgactattgttaagacagattatgagggacaagccaagaaactcctggaactgatggaaaacacggatgtgatcattgttgcaggaggagatgggacactgcaggaggttgttactggtgttcttcgacgaacagatgaggctaccttcagtaagattcccattggatttatcccactgggagagaccagtagtttgagtcataccctctttgccgaaagtggaaacaaagtccaacatattactgatgccacacttgccattgtgaaaggagagacagttccacttgatgtcttgcagatcaagggtgaaaaggaacagcctgtatttgcaatgaccggccttcgatggggatctttcagagatgctggcgtcaaagttagcaagtactggtatcttgggcctctaaaaatcaaagcagcccactttttcagcactcttaaggagtggcctcagactcatcaagcctctatctcatacacgggacctacagagagacctcccaatgaaccagaggagacccctgtacaaaggccttctttgtacaggagaatattacgaaggcttgcgtcctactgggcacaaccacaggatgccctttcccaagaggtgagcccggaggtctggaaagatgtgcagctgtccaccattgaactgtccatcacaacacggaataatcagcttgacccgacaagcaaagaagattttctgaatatctgcattgaacctgacaccatcagcaaaggagactttataactataggaagtcgaaaggtgagaaaccccaagctgcacgtggagggcacggagtgtctccaagccagccagtgcactttgcttatcccggagggagcagggggctcttttagcattgacagtgaggagtatgaagcgatgcctgtggaggtgaaactgctccccaggaagctgcagttcttctgtgatcctaggaagagagaacagatgctcacaagccccacccagtgagcagcagaagacaagcactctgagaccacactttaggccaccggtgggaccaaaagggaacaggtgcctcagccatcccaacagtgtcgtcagagggtccccagggcattttcatggcaagtacccctctgcccccactccagcagtgcttcccaaagtgtgctctgtcacctgctttgcaatcggcttccattagcgcatgttttattttggtgtgacggttggccctcctaaacacggactttcctcaggctggttcaagacggaaaaggactttcttctgttttcttccaaagtgcaaccacagtggagagcccacggtgggcttagcctgcctaggcccttccatttctcttctttgaccgtgctaggaattccaggaaagtgcattcctgccctggtgaccttttcctatgtctaggctcctccacaggtgctgctattttgtgagctccggctcctgtttagcttttatttcagttctaacctcagtccagaaacatatgtgaggttgtttccctcttcagccacggctacaataccggaaaatgctagtttttatttatttttttaagtagtgcttcctaaatggtttgcatgagagccacctggggtacatgttgaaaacttatttggggtctaccccaaacctaataacccaaatttggggatggggcccaggaatatgcatttttaaaaagtcatctgcccttcccaggtgattctgtaagttgtccctcaactgtacttggagaaatcgtgttttaaagcagtagtccacaaagtattctgctcatgtgcccccaaaagtattttgaaaaatcatgtataccctcacccatctaagttgatatctaaaattttatctaagttggtatctaaaatttttcatgggaagttaaatagttgacaaagtatgtatttgctggtgtcgtgtaaatattggtattttaaaataaaaactgttacatcactattttaaacatatccagtacaatttaaatatcacaacaatttgacacccttcattcatttataaaaataaatgagctagttctttagtagttaaacatttcaaattggcttttctccttctgtatttccataccacttttcagccaagaatcctatcataatgtaatctattatgcccgacatcttttaatcattcaccccattacttcttgtcaacaaaaaatataaatggaaattttttttttagctcttgctttaagtgtttgtttgttatctcagtccagaaccaatattatcgtaattaattattggtatataatgaaaacggtattaattcttggatgattaaaagtttttttattagaatgttctttatcctaattagttcatttatccaagaatacatgaatgtgatttacagctgagatggggttcaacctcagctgtattccttgtttctgtatagatgtaagcacataaattcgatggaatagaattacgttaacaatgtttttacagttctttggattcctttggcattttgacaaagatcacagtgctctatcatcaagaattattaatgatgatctatcaactaacaaacaacttgattagattctcctttagtctgttgaaagcagagaactgaaatccacctgatttaccatggctttgccagccagtcattagcaccatttacttttactatcgctgacattttcctttgttcagtggccctgaggttcttacactctagggggcagtgcaccacaggaagatagatcaatgagggaggattgcgagggggaaggggaggaagcagagctggcaggccttagctacaggctctctctcaggcagatcccttttaagatacatacaccatgcccacacatcccatggagagagaccaatgctttagtagattacagaacagctatgaaaagtccatgaatgaagatcacaaaaaggaaggctttcttatttcatactgtattcttcagggtggtaaaatttctgcttttggcaaaaacataacagacggttccaaacatcagcataaagatcactcatcccataccacccacaggtagggaggaaggatgctgtagtatatgaaaacaaaagttttcacctgagctgagagcatttagcatatcgtggttctgtaacaatatcaaggaccagtgcagaatctggctttcttttctgataggctaccagtgtgtgtttatgtgtgctcattttgtggttctaatcataatggtacatataattagggaaggatatggaagccactttagaatcttattcatttttaaatataaatatgccttgtttcaaa

SEQ ID NO: 104551 - DNA, 951 bp, Homo sapiens
  Payload ID: 531
  Gene Symbol: AGK
  Gene Name: acylglycerol kinase
  ENST ID: ENST00000494688
  CDS Start-End: 15-749
caaatctctagaagatgacggtgttctttaaaacgcttcgaaatcactggaagaaaactacagctgggctctgcctgctgacctggggaggccattggctctatggaaaacactgtgataacctcctaaggagagcagcctgtcaagaagctcaggtgtttggcaatcaactcattcctcccaatgcacaagtgaagaaggccactgtttttctcaatcctgcagcttgcaaagggactctatttgaaaaaaatgctgccccgattttacatttatctggcatggatgtgactattgttaagacagattatgagggacaagccaagaaactcctggaactgatggaaaacacggatgtgatcattgttgcaggaggagatgggacactgcaggaggttgttactggtgttcttcgacgaacagatgaggctaccttcagtaagattcccattggatttatcccactgggagagaccagtagtttgagtcataccctctttgccgaaagtggaaacaaagtccaacatattactgatgccacacttgccattgtgaaaggagagacagttccacttgatgtcttgcagatcaagggtgaaaaggaacagcctgtatttgcaatgaccggccttcgatggggatctttcagagatgctggcgtcaaagttagcaagtactggtatcttgggcctctaaaaatcaaagcagcccactttttcagcactcttaagccctttcccaagaggtgagcccggaggtctggaaagatgtgcagctgtccaccattgaactgtccatcacaacacggaataatcagcttgacccgacaagcaaagaagattttctgaatatctgcattgaacctgacaccatcagcaaaggagactttataactataggaagtcgaaaggtgagaaaccccaagctgcacgtggagggcacggagtgtct

SEQ ID NO: 104552 - DNA, 1046 bp, Homo sapiens
  Payload ID: 531
  Gene Symbol: AGK
  Gene Name: acylglycerol kinase
  Uniprot ID: Q53H12
  ENST ID: ENST00000492693
  CDS Start-End: 15-212
caaatctctagaagatgacggtgttctttaaaacgcttcgaaatcactggaagaaaactacagctgggctctgcctgctgacctggggaggccattggctctatggaaaacactgtgataacctcctaaggagagcagcctgtcaagaagctcagcactatcaggatgaatcacgctgggagccaactctgagtagaactccaggaagttaaccatctggtgaagagcagttctgacgcccacccctatagactgtttgtttctggattggtcccaagaacacagaactggactggtagaagctctgggaatttgtttgtgtctgcagttgtctttgtagatttgtctaacccctgaatcatccctgatctgaataacccccaaggatatcagttcagagcaagtgttacctctaaaagtcaaatcttcttaaaattgttgattcatatttttaaagctcatctccaagttcaactgatccatatcatgtacactgttatattccatgagattttacttaaatattcatttatatggctaattatagctggattataatatttgtcctttcaaatataagacagcatttttgcccccccactgcaaaaatgtgcattataccttgcagatgaaattctgagactgagttgcctttttgttttatatcatttgagcttatgatgtcagaaataccaaaatagaaacatgaaaatcaaaagtggcaaatgtgtgaagcatttagtaataaaaataggtggcagacctcatgtttgtttctgaaatgttttaatggatgacagtgagaatagatactataaattaattcctctctttagcgattgttacaatagatactataaattaattcctctctttagcagttgttacagtatatactataattcctctttttagcgattgttatctagctgttctaaacctgtgttttacgaatttgattacttctttgtttaaatgtattatctttcatatggctctaagttgttttggaaatcaattcaaataaactttaatattaaattaaa

SEQ ID NO: 104553 - DNA, 568 bp, Homo sapiens
  Payload ID: 531
  Gene Symbol: AGK
  Gene Name: acylglycerol kinase
  ENST ID: ENST00000473884
  CDS Start-End: 32-172
gagctggaccagccgtgcaaatctctagaagatgacggtgttctttaaaacgcttcgaaatcactggaagaaaactacagctgggctctgcctgctgacctggggaggccattggctctatggaaaacactggtgtttggcaatcaactcattcctcccaatgcacaagtgaagaaggccactgtttttctcaatcctgcagcttgcaaaggaaaagccaggactctatttgaaaaaaatgctgccccgattttacatttatctggcatggatgtgactattgttaagacagattatgagggacaagccaagaaactcctggaactgatggaaaacacggatgtgatcattgttgcaggaggagatgggacactgcaggaggttgttactggtgttcttcgacgaacagatgaggctaccttcagtaagattcccattggatttatcccactgggagagaccagtagtttgagtcataccctctttgccgaaagtggaaacaaagtccaacatattactgatgccacacttgccattgtgaaaggagagacagttccacttgatgtct

SEQ ID NO: 104554 - DNA, 1550 bp, Homo sapiens
  Payload ID: 531
  Gene Symbol: AGK
  Gene Name: acylglycerol kinase
  ENST ID: ENST00000473247
  CDS Start-End: 143-1327
gcacacaggaaaggcagagccgcgagctggaccagccgtgcaaatctctagaagatgacggtgttctttaaaacgcttcgaaatcactggaagaaaactacagctgggctctgcctgctgacctggggaggccattggctctatggaaaacactgatagtgataacctcctaaggagagcagcctgtcaagaagctcaggtgtttggcaatcaactcattcctcccaatgcacaagtgaagaaggccactgtttttctcaatcctgcagcttgcaaaggaaaagccaggactctatttgaaaaaaatgctgccccgattttacatttatctggcatggatgtgactattgttaagacagattatgagggacaagccaagaaactcctggaactgatggaaaacacggatgtgatcattgttgcaggaggagatgggacactgcaggaggttgttactggtgttcttcgacgaacagatgaggctaccttcagtaagattcccattggatttatcccactgggagagaccagtagtttgagtcataccctctttgccgaaagtggaaacaaagtccaacatattactgatgccacacttgccattgtgaaaggagagacagttccacttgatgtcttgcagatcaagggtgaaaaggaacagcctgtatttgcaatgaccggccttcgatggggatctttcagagatgctggcgtcaaagttagcaagtactggtatcttgggcctctaaaaatcaaagcagcccactttttcagcactcttaaggagtggcctcagactcatcaagcctctatctcatacacgggacctacagagagacctcccaatgaaccagaggagacccctgtacaaaggccttctttgtacaggagaatattacgaaggcttgcgtcctactgggcacaaccacaggatgccctttcccaagaggtgagcccggaggtctggaaagatgtgcagctgtccaccattgaactgtccatcacaacacggaataatcagcttgacccgacaagcaaagaagattttctgaatatctgcattgaacctgacaccatcagcaaaggagactttataactataggaagtcgaaaggtgagaaaccccaagctgcacgtggagggcacggagtgtctccaagccagccagtgcactttgcttatcccggagggagcagggggctcttttagcattgacagtgaggagtatgaagcgatgcctgtggaggtgaaactgctccccaggaagctgcagttcttctgtgatcctaggaagagagaacagatgctcacaagccccacccagtgagcagcagaagacaagcactctgagaccacactttaggccaccggtgggaccaaaagggaacaggtgcctcagccatcccaacagtgtcgtcagagggtccccagggcattttcatggcaagtacccctctgcccccactccagcagtgcttcccaaagtgtgctctgtcacctgctttgcaatcggcttccattagcgcatgttttattttggtgtgacggtt

SEQ ID NO: 104555 - DNA, 3001 bp, Homo sapiens
  Payload ID: 531
  Gene Symbol: AGK
  Gene Name: acylglycerol kinase
  Uniprot ID: Q53H12
  ENST ID: ENST00000575872
  CDS Start-End: 1-681
ggtgaaaaggaacagcctgtatttgcaatgaccggccttcgatggggatctttcagagatgctggcgtcaaagttagcaagtactggtatcttgggcctctaaaaatcaaagcagcccactttttcagcactcttaaggagtggcctcagactcatcaagcctctatctcatacacgggacctacagagagacctcccaatgaaccagaggagacccctgtacaaaggccttctttgtacaggagaatattacgaaggcttgcgtcctactgggcacaaccacaggatgccctttcccaagaggtgagcccggaggtctggaaagatgtgcagctgtccaccattgaactgtccatcacaacacggaataatcagcttgacccgacaagcaaagaagattttctgaatatctgcattgaacctgacaccatcagcaaaggagactttataactataggaagtcgaaaggtgagaaaccccaagctgcacgtggagggcacggagtgtctccaagccagccagtgcactttgcttatcccggagggagcagggggctcttttagcattgacagtgaggagtatgaagcgatgcctgtggaggtgaaactgctccccaggaagctgcagttcttctgtgatcctaggaagagagaacagatgctcacaagccccacccagtgagcagcagaagacaagcactctgagaccacactttaggccaccggtgggaccaaaagggaacaggtgcctcagccatcccaacagtgtcgtcagagggtccccagggcattttcatggcaagtacccctctgcccccactccagcagtgcttcccaaagtgtgctctgtcacctgctttgcaatcggcttccattagcgcatgttttattttggtgtgacggttggccctcctaaacacggactttcctcaggctggttcaagacggaaaaggactttcttctgttttcttccaaagtgcaaccacagtggagagcccacggtgggcttagcctgcctaggcccttccatttctcttctttgaccgtgctaggaattccaggaaagtgcattcctgccctggtgaccttttcctatgtctaggctcctccacaggtgctgctattttgtgagctccggctcctgtttagcttttatttcagttctaacctcagtccagaaacatatgtgaggttgtttccctcttcagccacggctacaataccggaaaatgctagtttttatttatttttttaagtagtgcttcctaaatggtttgcatgagagccacctggggtacatgttgaaaacttatttggggtctaccccaaacctaataacccaaatttggggatggggcccaggaatatgcatttttaaaaagtcatctgcccttcccaggtgattctgtaagttgtccctcaactgtacttggagaaatcgtgttttaaagcagtagtccacaaagtattctgctcatgtgcccccaaaagtattttgaaaaatcatgtataccctcacccatctaagttgatatctaaaattttatctaagttggtatctaaaatttttcatgggaagttaaatagttgacaaagtatgtatttgctggtgtcgtgtaaatattggtattttaaaataaaaactgttacatcactattttaaacatatccagtacaatttaaatatcacaacaatttgacacccttcattcatttataaaaataaatgagctagttctttagtagttaaacatttcaaattggcttttctccttctgtatttccataccacttttcagccaagaatcctatcataatgtaatctattatgcccgacatcttttaatcattcaccccattacttcttgtcaacaaaaaatataaatggaaattttttttttagctcttgctttaagtgtttgtttgttatctcagtccagaaccaatattatcgtaattaattattggtatataatgaaaacggtattaattcttggatgattaaaagtttttttattagaatgttctttatcctaattagttcatttatccaagaatacatgaatgtgatttacagctgagatggggttcaacctcagctgtattccttgtttctgtatagatgtaagcacataaattcgatggaatagaattacgttaacaatgtttttacagttctttggattcctttggcattttgacaaagatcacagtgctctatcatcaagaattattaatgatgatctatcaactaacaaacaacttgattagattctcctttagtctgttgaaagcagagaactgaaatccacctgatttaccatggctttgccagccagtcattagcaccatttacttttactatcgctgacattttcctttgttcagtggccctgaggttcttacactctagggggcagtgcaccacaggaagatagatcaatgagggaggattgcgagggggaaggggaggaagcagagctggcaggccttagctacaggctctctctcaggcagatcccttttaagatacatacaccatgcccacacatcccatggagagagaccaatgctttagtagattacagaacagctatgaaaagtccatgaatgaagatcacaaaaaggaaggctttcttatttcatactgtattcttcagggtggtaaaatttctgcttttggcaaaaacataacagacggttccaaacatcagcataaagatcactcatcccataccacccacaggtagggaggaaggatgctgtagtatatgaaaacaaaagttttcacctgagctgagagcatttagcatatcgtggttctgtaacaatatcaaggaccagtgcagaatctggctttcttttctgataggctaccagtgtgtgtttatgtgtgctcattttgtggttctaatcataatggtacatataattagggaaggatatggaagccactttagaatcttattcatttttaaatataaatatgccttgtttcaaa

SEQ ID NO: 104556 - DNA, 358 bp, Homo sapiens
  Payload ID: 531
  Gene Symbol: AGK
  Gene Name: acylglycerol kinase
  ENST ID: ENST00000573803
  CDS Start-End: 1-156
ggtgaaaaggaacagcctgtatttgcaatgaccggccttcgatggggatctttcagagatgctggcgtcaaagttagcaagtactggtatcttgggcctctaaaaatcaaagcagcccactttttcagcactcttaagccctttcccaagaggtgagcccggaggtctggaaagatgtgcagctgtccaccattgaactgtccatcacaacacggaataatcagcttgacccgacaagcaaagaagattttctgaatatctgcattgaacctgacaccatcagcaaaggagactttataactataggaagtcgaaaggtgagaaaccccaagctgcacgtggagggcacggagtgtct

SEQ ID NO: 104557 - DNA, 904 bp, Homo sapiens
  Payload ID: 531
  Gene Symbol: AGK
  Gene Name: acylglycerol kinase
  ENST ID: ENST00000573706
  CDS Start-End: 1-681
ggtgaaaaggaacagcctgtatttgcaatgaccggccttcgatggggatctttcagagatgctggcgtcaaagttagcaagtactggtatcttgggcctctaaaaatcaaagcagcccactttttcagcactcttaaggagtggcctcagactcatcaagcctctatctcatacacgggacctacagagagacctcccaatgaaccagaggagacccctgtacaaaggccttctttgtacaggagaatattacgaaggcttgcgtcctactgggcacaaccacaggatgccctttcccaagaggtgagcccggaggtctggaaagatgtgcagctgtccaccattgaactgtccatcacaacacggaataatcagcttgacccgacaagcaaagaagattttctgaatatctgcattgaacctgacaccatcagcaaaggagactttataactataggaagtcgaaaggtgagaaaccccaagctgcacgtggagggcacggagtgtctccaagccagccagtgcactttgcttatcccggagggagcagggggctcttttagcattgacagtgaggagtatgaagcgatgcctgtggaggtgaaactgctccccaggaagctgcagttcttctgtgatcctaggaagagagaacagatgctcacaagccccacccagtgagcagcagaagacaagcactctgagaccacactttaggccaccggtgggaccaaaagggaacaggtgcctcagccatcccaacagtgtcgtcagagggtccccagggcattttcatggcaagtacccctctgcccccactccagcagtgcttcccaaagtgtgctctgtcacctgctttgcaatcggcttccattagcgcatgttttattttggtgtgacggtt

SEQ ID NO: 104558 - DNA, 2765 bp, Homo sapiens
  Payload ID: 531
  Gene Symbol: AGK
  Gene Name: acylglycerol kinase
  ENST ID: ENST00000629555
  CDS Start-End: 172-906
atccgagccggttcccgcccccggcccgaactggcccgcgcgcgctcgcagccccgcggcggaacccgagggcggcggcagcggtttcccttgaacgagccggggaatctggagggagcacacaggaaaggcagagccgcgagctggaccagccgtgcaaatctctagaagatgacggtgttctttaaaacgcttcgaaatcactggaagaaaactacagctgggctctgcctgctgacctggggaggccattggctctatggaaaacactgtgataacctcctaaggagagcagcctgtcaagaagctcaggtgtttggcaatcaactcattcctcccaatgcacaagtgaagaaggccactgtttttctcaatcctgcagcttgcaaagggactctatttgaaaaaaatgctgccccgattttacatttatctggcatggatgtgactattgttaagacagattatgagggacaagccaagaaactcctggaactgatggaaaacacggatgtgatcattgttgcaggaggagatgggacactgcaggaggttgttactggtgttcttcgacgaacagatgaggctaccttcagtaagattcccattggatttatcccactgggagagaccagtagtttgagtcataccctctttgccgaaagtggaaacaaagtccaacatattactgatgccacacttgccattgtgaaaggagagacagttccacttgatgtcttgcagatcaagggtgaaaaggaacagcctgtatttgcaatgaccggccttcgatggggatctttcagagatgctggcgtcaaagttagcaagtactggtatcttgggcctctaaaaatcaaagcagcccactttttcagcactcttaagccctttcccaagaggtgagcccggaggtctggaaagatgtgcagctgtccaccattgaactgtccatcacaacacggaataatcagcttgacccgacaagcaaagaagattttctgaatatctgcattgaacctgacaccatcagcaaaggagactttataactataggaagtcgaaaggtgagaaaccccaagctgcacgtggagggcacggagtgtctccaagccagccagtgcactttgcttatcccggagggagcagggggctcttttagcattgacagtgaggagtatgaagcgatgcctgtggaggtgaaactgctccccaggaagctgcagttcttctgtgatcctaggaagagagaacagatgctcacaagccccacccagtgagcagcagaagacaagcactctgagaccacactttaggccaccggtgggaccaaaagggaacaggtgcctcagccatcccaacagtgtcgtcagagggtccccagggcattttcatggcaagtacccctctgcccccactccagcagtgcttcccaaagtgtgctctgtcacctgctttgcaatcggcttccattagcgcatgttttattttggtgtgacggttggccctcctaaacacggactttcctcaggctggttcaagacggaaaaggactttcttctgttttcttccaaagtgcaaccacagtggagagcccacggtgggcttagcctgcctaggcccttccatttctcttctttgaccgtgctaggaattccaggaaagtgcattcctgccctggtgaccttttcctatgtctaggctcctccacaggtgctgctattttgtgagctccggctcctgtttagcttttatttcagttctaacctcagtccagaaacatatgtgaggttgtttccctcttcagccacggctacaataccggaaaatgctagtttttatttatttttttaagtagtgcttcctaaatggtttgcatgagagccacctggggtacatgttgaaaacttatttggggtctaccccaaacctaataacccaaatttggggatggggcccaggaatatgcatttttaaaaagtcatctgcccttcccaggtgattctgtaagttgtccctcaactgtacttggagaaatcgtgttttaaagcagtagtccacaaagtattctgctcatgtgcccccaaaagtattttgaaaaatcatgtataccctcacccatctaagttgatatctaaaattttatctaagttggtatctaaaatttttcatgggaagttaaatagttgacaaagtatgtatttgctggtgtcgtgtaaatattggtattttaaaataaaaactgttacatcactattttaaacatatccagtacaatttaaatatcacaacaatttgacacccttcattcatttataaaaataaatgagctagttctttagtagttaaacatttcaaattggcttttctccttctgtatttccataccacttttcagccaagaatcctatcataatgtaatctattatgcccgacatcttttaatcattcaccccattacttcttgtcaacaaaaaatataaatggaaattttttttttagctcttgctttaagtgtttgtttgttatctcagtccagaaccaatattatcgtaattaattattggtatataatgaaaacggtattaattcttggatgattaaaagtttttttattagaatgttctttatcctaattagttcatttatccaagaatacatgaatgtgatttacagctgagatggggttcaacctcagctgtattccttgtttctgtatagatgtaagcacataaattcgatggaatagaattacgttaacaatg

SEQ ID NO: 104559 - DNA, 678 bp, Homo sapiens
  Payload ID: 532
  Gene Symbol: AOAH
  Gene Name: acyloxyacyl hydrolase (neutrophil)
  ENST ID: ENST00000435386
  CDS Start-End: 353-678
aacttcactgagccagggagcacggaagttgtgccactgtgcaacttgggttttctttatcctgcagtctttacctcagcagaaccgcacaccacagactccctccagctctttgtgtgtggctctctcagggtccaacaagagcaagctgtgggtctgtgagtgtttatgtgtgcttttattcacttcacacttattgaaaagtgtgtatgtgagagggtggggtgtgtgtgtcaaagagagtgaggaagagaaggagagagagatcaattgattctgcagcctcagctccagcatccctcagttgggagcttccaaagccgggtgatcacttggggtgcatagctcggagatgcagtccccctggaaaatccttacggtggcgcctctattcttgctcctgtctcttcagtcctcggcctctccagccaacgatgaccagtccaggcccagcctctcgaatgggcacacctgtgtagaaaaactgttcttgaaaaccacctgctatttagtcattgacaagtttggatcagacatcataaaactgcttagcgcagatatgaatgctgatgtggtatgtcacactctggagttttgtaaacagaacactggccaaccattgtgtcatctctaccctcttcccaaggagacatggaaatttacactacagaaggcaag

SEQ ID NO: 104560 - DNA, 551 bp, Homo sapiens
  Payload ID: 532
  Gene Symbol: AOAH
  Gene Name: acyloxyacyl hydrolase (neutrophil)
  ENST ID: ENST00000414637
  CDS Start-End: 327-485
agttgtgccactgtgcaacttgggttttctttatcctgcagtctttacctcagcagaaccgcacaccacagactccctccagctctttgtgtgtggctctctcagggtccaacaagagcaagctgtgggtctgtgagtgtttatgtgtgcttttattcacttcacacttattgaaaagtgtgtatgtgagagggtggggtgtgtgtgtcaaagagagtgaggaagagaaggagagagagatcaattgattctgcagcctcagctccagcatccctcagttgggagcttccaaagccgggtgatcacttggggtgcatagctcggagatgcagtccccctggaaaatccttacggtggcgcctctattcttgctcctgtctcttcagtcctcggcctctccagccaacgatgaccagtccaggcccagcctctcgaatgggcacacctgtgtagccagcagtgctgagaagccacaactgtcataagagtccttgatgggatttctctgagtgaaattcagaagaaaagcccatatgtggtgtgtgctggtg

SEQ ID NO: 104561 - DNA, 2398 bp, Homo sapiens
  Payload ID: 532
  Gene Symbol: AOAH
  Gene Name: acyloxyacyl hydrolase (neutrophil)
  ENST ID: ENST00000617267
  CDS Start-End: 302-2368
tttctttatcctgcagtctttacctcagcagaaccgcacaccacagactccctccagctctttgtgtgtggctctctcagggtccaacaagagcaagctgtgggtctgtgagtgtttatgtgtgcttttattcacttcacacttattgaaaagtgtgtatgtgagagggtggggtgtgtgtgtcaaagagagtgaggaagagaaggagagagagatcaattgattctgcagcctcagctccagcatccctcagttgggagcttccaaagccgggtgatcacttggggtgcatagctcggagatgcagtccccctggaaaatccttacggtggcgcctctattcttgctcctgtctcttcagtcctcggcctctccagccaacgatgaccagtccaggcccagcctctcgaatgggcacacctgtgtagggtgtgtgctggtggtgtctgtaatagaacagcttgctcaagttcacaactcgacggtccaggcctcgatggagagactgtgcagctacctgcctgaaaaactgttcttgaaaaccacctgctatttagtcattgacaagtttggatcagacatcataaaactgcttagcgcagatatgaatgctgatgtggtatgtcacactctggagttttgtaaacagaacactggccaaccattgtgtcatctctaccctcttcccaaggagacatggaaatttacactacagaaggcaagacaaattgtcaagaagtccccgattctgaaatattctagaagtggttctgacatttgttcactcccggttttggccaagatctgccagaaaattaaattagctatggaacagtctgtgccattcaaagatgtggattcagacaaatacagcgttttcccaacactgcggggctatcactggcgggggagagactgtaatgacagcgacgagtcagtgtacccaggtagaaggccgaacaactgggatgtccatcaggattcaaactgtaatggcatttggggtgtcgatccaaaagatggagttccatatgagaagaaattctgtgaaggttcacagcccaggggaatcattttgctgggagactcagctggggctcattttcacatctctcctgaatggatcacagcgtcgcagatgtctttgaactctttcatcaatctaccaacagcccttaccaacgagcttgactggccccaactctctggtgctacaggatttctggactccactgttggaattaaagaaaaatctatttaccttcgcttatggaaaagaaaccactgtaatcacagggactaccagaatatttcaagaaatggtgcatcttcccgaaacctgaagaaatttatagaaagcttgtctagaaacaaggtgttggactatcccgccatcgttatatatgccatgattggaaatgatgtctgcagtgggaagagtgacccagtcccagccatgaccactcctgagaaactctactccaacgtcatgcagactctgaagcatctaaattcccacctgcccaatggcagccatgttattttgtatggcttaccagatggaacctttctctgggataatttgcacaacagatatcatcctctcggccagctaaataaagacatgacctatgcgcagttgtactccttcctgaactgcctccaggtcagcccctgccacggctggatgtcttccaacaagacgttgcggactctcacttcagagagagcagagcaactctccaacacactgaaaaaaattgcagccagtgagaaatttacaaacttcaatcttttctacatggattttgccttccatgaaatcatacaggagtggcagaagagaggcggacagccctggcagctcatcgagcccgtggatggattccaccccaacgagagaaagagcatcctcctcaaaggcatattaatgacaagccagacactggacaaccaagaatggacccagctaacatcatggataaagggaaacctgacatgcgacagcagaaccagagagtggctttgctgttgttggcggatcatttctggaaaaaggtgcagctccagtggccccaaatcctgggaaaggagaatccgttcaacccccagattaaacaggtgtttggagaccaaggcgggcactgagcctctcaggagcatgcacccctggggagcacagggaggcagaggcttgggtaaactcattccacaaaccctatgggggctgccacgtcacaggcccaaaggactcttcttcagcagcatctttgcaaaatgtctttctctcaatgaagagcatatctggacgactgtgcaatgctgtgtgctcccgggatcagtaacccttccgctgttcctgaaataacctttcataaagtgctttgggtgccattcc

SEQ ID NO: 104562 - DNA, 2381 bp, Homo sapiens
  Payload ID: 532
  Gene Symbol: AOAH
  Gene Name: acyloxyacyl hydrolase (neutrophil)
  Uniprot ID: P28039
  ENST ID: ENST00000617537
  CDS Start-End: 401-2128
acagatcagttccggcaagcctcgaggctcacggggtttatgcacactaacttcactgagccagggagcacggaagttgtgccactgtgcaacttgggttttctttatcctgcagtctttacctcagcagaaccgcacaccacagactccctccagctctttgtgtgtggctctctcagggtccaacaagagcaagctgtgggtctgtgagtgtttatgtgtgcttttattcacttcacacttattgaaaagtgtgtatgtgagagggtggggtgtgtgtgtcaaagagagtgaggaagagaaggagagagagatcaattgattctgcagcctcagctccagcatccctcagttgggagcttccaaagccgggtgatcacttggggtgcatagctcggagatgcagtccccctggaaaatccttacggtggcgcctctattcttgctcctgtctcttcagtcctcggcctctccagccaacgatgaccagtccaggcccagcctctcgaatgggcacacctgtgtagggtgtgtgctggtggtgtctgtaatagaacagcttgctcaagttcacaactcgacggtccaggcctcgatggagagactgtgcagctacctgcctgaaaaactgttcttgaaaaccacctgctatttagtcattgacaagtttggatcagacatcataaaactgcttagcgcagatatgaatgctgatgtggtatgtcacactctggagttttgtaaacagaacactggccaaccattgtgtcatctctaccctcttcccaaggagacatggaaatttacactacagaaggcaagacaaattgtcaagaagtccccgattctgaaatattctagaagtggttctgacatttgttcactcccggttttggccaagatctgccagaaaattaaattagctatggaacagtctgtgccattcaaagatgtggattcagacaaatacagcgttttcccaacactgcggggctatcactggcgggggagagactgtaatgacagcgacgagtcagtgtacccaggtagaaggccgaacaactgggatgtccatcaggattcaaactgtaatggcatttggggtgtcgatccaaaagatggagttccatatgagaagaaattctgtgaaggttcacagcccaggggaatcattttgctgggagactcagctggggctcattttcacatctctcctgaatggatcacagcgtcgcagatgtctttgaactctttcatcaatctaccaacagcccttaccaacgagcttgactggccccaactctctggtgctacaggatttctggactccactgttggaattaaagaaaaatctatttaccttcgcttatggaaaagaaaccactgtaatcacagggactaccagaatatttcaagaaatggtgcatcttcccgaaacctgaagaaatttatagaaagcttgtctagaaacaaggtgttggactatcccgccatcgttatatatgccatgattggaaatgatgtctgcagtgggaagagtgacccagtcccagccatgaccactcctgagaaactctactccaacgtcatgcagactctgaagcatctaaattcccacctgcccaatggcagccatgttattttgtatggcttaccagatggaacctttctctgggataatttgcacaacagatatcatcctctcggccagctaaataaagacatgacctatgcgcagttgtactccttcctgaactgcctccaggtcagcccctgccacggctggatgtcttccaacaagacgttgcggactctcacttcagagagagcagagcaactctccaacacactgaaaaaaattgcagccagtgagaaatttacaaacttcaatcttttctacatggattttgccttccatgaaatcatacaggagtggcagaagagaggcggacagccctggcagctcatcgagcccgtggatggattccaccccaacgaggtggctttgctgttgttggcggatcatttctggaaaaaggtgcagctccagtggccccaaatcctgggaaaggagaatccgttcaacccccagattaaacaggtgtttggagaccaaggcgggcactgagcctctcaggagcatgcacccctggggagcacagggaggcagaggcttgggtaaactcattccacaaaccctatgggggctgccacgtcacaggcccaaaggactcttcttcagcagcatctttgcaaaatgtctttctctcaatgaagagcatatctggacgactgtgcaatgctgtgtgctcccgggatcagtaacccttccgctgttcctgaaataacctttcataaagtgctttgggtgccattccaaa

SEQ ID NO: 104563 - DNA, 2336 bp, Homo sapiens
  Payload ID: 532
  Gene Symbol: AOAH
  Gene Name: acyloxyacyl hydrolase (neutrophil)
  Uniprot ID: P28039
  ENST ID: ENST00000612871
  CDS Start-End: 402-2033
aacagatcagttccggcaagcctcgaggctcacggggtttatgcacactaacttcactgagccagggagcacggaagttgtgccactgtgcaacttgggttttctttatcctgcagtctttacctcagcagaaccgcacaccacagactccctccagctctttgtgtgtggctctctcagggtccaacaagagcaagctgtgggtctgtgagtgtttatgtgtgcttttattcacttcacacttattgaaaagtgtgtatgtgagagggtggggtgtgtgtgtcaaagagagtgaggaagagaaggagagagagatcaattgattctgcagcctcagctccagcatccctcagttgggagcttccaaagccgggtgatcacttggggtgcatagctcggagatgcagtccccctggaaaatccttacggtggcgcctctattcttgctcctgtctcttcagtcctcggcctctccagccaacgatgaccagtccaggcccagcctctcgaatgggcacacctgtgtagaaaaactgttcttgaaaaccacctgctatttagtcattgacaagtttggatcagacatcataaaactgcttagcgcagatatgaatgctgatgtggtatgtcacactctggagttttgtaaacagaacactggccaaccattgtgtcatctctaccctcttcccaaggagacatggaaatttacactacagaaggcaagacaaattgtcaagaagtccccgattctgaaatattctagaagtggttctgacatttgttcactcccggttttggccaagatctgccagaaaattaaattagctatggaacagtctgtgccattcaaagatgtggattcagacaaatacagcgttttcccaacactgcggggctatcactggcgggggagagactgtaatgacagcgacgagtcagtgtacccaggtagaaggccgaacaactgggatgtccatcaggattcaaactgtaatggcatttggggtgtcgatccaaaagatggagttccatatgagaagaaattctgtgaaggttcacagcccaggggaatcattttgctgggagactcagctggggctcattttcacatctctcctgaatggatcacagcgtcgcagatgtctttgaactctttcatcaatctaccaacagcccttaccaacgagcttgactggccccaactctctggtgctacaggatttctggactccactgttggaattaaagaaaaatctatttaccttcgcttatggaaaagaaaccactgtaatcacagggactaccagaatatttcaagaaatggtgcatcttcccgaaacctgaagaaatttatagaaagcttgtctagaaacaaggtgttggactatcccgccatcgttatatatgccatgattggaaatgatgtctgcagtgggaagagtgacccagtcccagccatgaccactcctgagaaactctactccaacgtcatgcagactctgaagcatctaaattcccacctgcccaatggcagccatgttattttgtatggcttaccagatggaacctttctctgggataatttgcacaacagatatcatcctctcggccagctaaataaagacatgacctatgcgcagttgtactccttcctgaactgcctccaggtcagcccctgccacggctggatgtcttccaacaagacgttgcggactctcacttcagagagagcagagcaactctccaacacactgaaaaaaattgcagccagtgagaaatttacaaacttcaatcttttctacatggattttgccttccatgaaatcatacaggagtggcagaagagaggcggacagccctggcagctcatcgagcccgtggatggattccaccccaacgaggtggctttgctgttgttggcggatcatttctggaaaaaggtgcagctccagtggccccaaatcctgggaaaggagaatccgttcaacccccagattaaacaggtgtttggagaccaaggcgggcactgagcctctcaggagcatgcacccctggggagcacagggaggcagaggcttgggtaaactcattccacaaaccctatgggggctgccacgtcacaggcccaaaggactcttcttcagcagcatctttgcaaaatgtctttctctcaatgaagagcatatctggacgactgtgcaatgctgtgtgctcccgggatcagtaacccttccgctgttcctgaaataacctttcataaagtgctttgggtgccattccaaacaagagagtatctgtgccctttacagctaattgttctaaaaggagtttct

SEQ ID NO: 104564 - DNA, 627 bp, Homo sapiens
  Payload ID: 533
  Gene Symbol: ACYP1
  Gene Name: acylphosphatase 1, erythrocyte (common) type
  Uniprot ID: P07311
  ENST ID: ENST00000238618
  CDS Start-End: 105-404
actaaacttccgggcgcggaggtttgcgcgccttggtgagccgttggcgtggtggtcccggagtgatcctggcagccggtggggaagacaaggagggtttgagcatggcagaaggaaacaccctgatatcagtggattatgaaatttttgggaaggtgcaaggggtgtttttccgtaagcatactcaggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttctgcttagagtacttttaaaaaa

SEQ ID NO: 104565 - DNA, 650 bp, Homo sapiens
  Payload ID: 533
  Gene Symbol: ACYP1
  Gene Name: acylphosphatase 1, erythrocyte (common) type
  Uniprot ID: P07311
  ENST ID: ENST00000357971
  CDS Start-End: 71-238
ggtgagccgttggcgtggtggtcccggagtgatcctggcagccggtggggaagacaaggagggtttgagcatggcagaaggaaacaccctgatatcagtggattatgaaatttttgggaaggtgcaaggggtgtttttccgtaagcatactcaggaaatgactgttgaaaacagaattgctgaaactcacagcaagagctgtgttccagttagctttgctaccagttatgcaggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttc

SEQ ID NO: 104566 - DNA, 789 bp, Homo sapiens
  Payload ID: 533
  Gene Symbol: ACYP1
  Gene Name: acylphosphatase 1, erythrocyte (common) type
  ENST ID: ENST00000555463
  CDS Start-End: 193-582
gtccggccaactctgcagctcggtccagccctgcccttggggagccggggaggggcgggagaggcttttctggagctccttcaaagaagaacttgtacttttctgagaacgacgctcccagaccttggggtgtgcccttgtctggcaaagggcggaggccctggctgtgcctccgcgtgcttccgccgcaggatgccggcgtccgcccgcctggcgggagcggggctgctgctggcctttctccgcgcgctcggctgcgctgggcgggccccaggtttgagcatggcagaaggaaacaccctgatatcagtggattatgaaatttttgggaaggtgcaaggggtgtttttccgtaagcatactcaggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttctgctta

SEQ ID NO: 104567 - DNA, 606 bp, Homo sapiens
  Payload ID: 533
  Gene Symbol: ACYP1
  Gene Name: acylphosphatase 1, erythrocyte (common) type
  ENST ID: ENST00000553302
  CDS Start-End: 76-189
gccttggtgagccgttggcgtggtggtcccggagtgatcctggcagccggtggggaagacaaggagggtttgagcatggcagaaggaaacaccctgatatcagtggattatgaaatttttgggaaggtgcaaggggtgtttttccgtaagcatactcaggtatgtggcctgcaggctttggggtggtaacctaggttgtgggcataggaacaagggacgtgttcttgacaaatgtgaactagaagccgctggctatttggtagctgcatggcaaagaggtagtttgtagagcaatgagtatgaaaatgctgtgcaatcggtaaaacatggtgtaaatggaagatcaccctgctgttattattagtcagtggtgcctgagcatctagatacacatattaatgagcttctctcttccaagggaaatagagggcttccccagtgctcgccgttgtggcatcatcaaaccaagtcaggtttcttatagaaaggctaacattgattgaagagctggcatttagatgacctgatgtcatgtatataacatatataaatgcttcctctgcagctgctgcactttcttcagacctctttctccaagcttccctc

SEQ ID NO: 104568 - DNA, 565 bp, Homo sapiens
  Payload ID: 533
  Gene Symbol: ACYP1
  Gene Name: acylphosphatase 1, erythrocyte (common) type
  Uniprot ID: P07311
  ENST ID: ENST00000555694
  CDS Start-End: 65-364
tttgcgcgccttggtgagccgttggcgtggtggtcccggagtgatcctggcagccggtttgagcatggcagaaggaaacaccctgatatcagtggattatgaaatttttgggaaggtgcaaggggtgtttttccgtaagcatactcaggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttc

SEQ ID NO: 104569 - DNA, 639 bp, Homo sapiens
  Payload ID: 533
  Gene Symbol: ACYP1
  Gene Name: acylphosphatase 1, erythrocyte (common) type
  ENST ID: ENST00000555135
  CDS Start-End: 63-251
gttggcgtggtggtcccggagtgatcctggcagccggtggggaagacaaggagggtttgagcatggcagaaggaaacaccctgatatcagtggattatgaaatttttgggaaggtgcaaggggtgtttttccgtaagcatactcaggaaatgactgttgaaaacagaattgctgaaactcacagcaagagctgtgttccagttagctttgctaccagttatgcaggtattaatgaatttaaaaggatttaaatcaaggaatgttctccaactacagtggaactaaaccacattaaaaaaataaaaaggataactggaaaatcccaaaatatttggaaaccatatagcacacttacttctaaaattgtggtagaatacatataacatagaaattattgttctaaccatttttaaatgtacaattcagtggtcttaagcacattcacattgttctgtttatctacagaacgcttttcatcttgcaaaactgaaactctgtattcattaaacactaactccccattttctccttcccccatgcccctgacaatcataaatctacattctattaattcaactgctctagttacctcatataagtggaattttacagtatttgtccttttgtggctggcttatt

SEQ ID NO: 104570 - DNA, 789 bp, Homo sapiens
  Payload ID: 534
  Gene Symbol: ACYP2
  Gene Name: acylphosphatase 2, muscle type
  ENST ID: ENST00000303536
  CDS Start-End: 112-408
cggctgccctcgctcccaggccccgcagtctcatttgccgcttccgacgcgtgaccccggcgcgctagcgtccgggaccggtgacaggcgcggggtgcgccaagcagtcccatgtgtcccctccctctcgcagccgccgcagtcgctgcgccccgagcccctctccggctcctcaacagagggctcgccgccgccatgtctaccgcccagtcactcaaatccgtggactacgaggtgttcggaagagtgcagggtgtttgcttcagaatgtatacagaagatgaagctaggaaaataggagtggttggctgggtgaagaataccagcaaaggcaccgtgacaggccaagtgcaggggccagaagacaaagtcaattccatgaattcatcagctccggaagctgggtgaagaaaagaaacaagatagggcaacagctagaggagaattcaggaagtcctggctgagcaaggttggaagccctagttctcgcattgaccgcacaaacttttctaatgaaaaaaccatctctaagcttgaatactctaattttagtattagatactaatagaagagaaaaattgtaacacactgaacaatagatactgtatgttcttaagactatgtatactagaataatagtagcagagtagggtgaaaaggaactttctgttctgaaagctaagcgactgtacgtgctactaaaaatgtctgacactgaaataattttactcaactatgttttcaacaagcaaaaatatagtattctaagattaaaatgtcattacaaaa

SEQ ID NO: 104571 - DNA, 993 bp, Homo sapiens
  Payload ID: 534
  Gene Symbol: ACYP2
  Gene Name: acylphosphatase 2, muscle type
  Uniprot ID: P14621
  ENST ID: ENST00000394666
  CDS Start-End: 196-495
cggctgccctcgctcccaggccccgcagtctcatttgccgcttccgacgcgtgaccccggcgcgctagcgtccgggaccggtgacaggcgcggggtgcgccaagcagtcccatgtgtcccctccctctcgcagccgccgcagtcgctgcgccccgagcccctctccggctcctcaacagagggctcgccgccgccatgtctaccgcccagtcactcaaatccgtggactacgaggtgttcggaagagtgcagggtgtttgcttcagaatgtatacagaagatgaagctaggaaaataggagtggttggctgggtgaagaataccagcaaaggcaccgtgacaggccaagtgcaggggccagaagacaaagtcaattccatgaagtcctggctgagcaaggttggaagccctagttctcgcattgaccgcacaaacttttctaatgaaaaaaccatctctaagcttgaatactctaattttagtattagatactaatagaagagaaaaattgtaacacactgaacaatagatactgtatgttcttaagactatgtatactagaataatagtagcagagtagggtgaaaaggaactttctgttctgaaagctaagcgactgtacgtgctactaaaaatgtctgacactgaaataattttactcaactatgttttcaacaagcaaaaatatagtattctaagattaaaatgtcattacaaaatatttagtgtgaacatttaatttaaacttgtctcatggaatctttaatttcaatgaacattacagcatatatatgttatttggcgagacatcaaataaagttaaccatttaaaaattattttcatatactgttgtctatgttgaattataaaatcctctgaataatttgttactacggttatttgttattaaactcttcaaaaagaaccagtgattagaaataaatgtgatgatcaatataaccataaaatattatcaacaaagagttttaaaa

SEQ ID NO: 104572 - DNA, 1913 bp, Homo sapiens
  Payload ID: 534
  Gene Symbol: ACYP2
  Gene Name: acylphosphatase 2, muscle type
  ENST ID: ENST00000406041
  CDS Start-End: 213-506
attaaatggtagggagcgctgtggagacagcatcctccccagtccgggaagagaggcctaggatgcctggggcccagcggcctcttccctcctggcgtccccggctgccctcgctcccaggccccgcagtctcatttgccgcttccgacgcgtgaccccggcgcgctagcgtccgggaccggtgacaggcgcggggtgcgccaagcagtcccatgtgtcccctccctctcgcagccgccgcagtcgctgcgccccgagcccctctccggctcctcaacagagggctcgccgccgccatgtctaccgcccagtcactcaaatccgtggactacgaggtgttcggaagagtgcagggtgtttgcttcagaatgtatacagaagatgaagctaggaaaataggagtggttggctgggtgaagaataccagcaaaggcaccgtgacaggccaagtgcaggggccagaagacaaagtcaattccatgctggagtgcagtggtctgatctagactcactgcagccttgaccttctgggctcaagtgatcttcccacgtcaacctcctgagtgcacatgctggctaatttgtgtgtgtgtgtgtgtgtgtgtgtgtgtatattttgttgttgttgttgttgttgttgttgttgttgctttgtagagatagtgtctcactatgttgctcaggctggtataggactcttggcttcaaatgactttcctgcctcagcctcccaaagtgctgggattacaaaaataaactttatttttgagaacagttttatatttacagaaaaattgtgaagatagtacagagactttccatatactccccacacagttttcctcctattaacattttacattaatatgatacgtatgttaacaattaatggaccaatatggatacattagtattaactaaaatccctatttatttagatttcaatttttacctaatgtccattttatgtcttaggatcccattattgtatttgctttttaattgggcattctcttgaaattaagagaagtgacattttggctgggtgcagtggctcatgcctgtaatcccagcacttcgggaggctgaggcgggcggatcacttgaggtcaggagttcaagaccagcctgtccaacacagcgagatcgtgtctctacaaaaaatacaaaaactagctggggttggtggcacacgcctgttgtcccagctacttgggaggctgaggcaagagaatcgcttgagtctgggaggcagaggttgcaatgagatgagattgcaccaccgcactccagtctgggcaatgggagtagcctgtcccaaaaaaaataaaataaaataaaaataaagacagaagtgacatttttatgatattaaatcttcccatttaagaacacacagatgttgttccatttgcttagattttaaaatttatccttcagtatgattttatggttttctttatataggtttttgtacttttcttgctaagttatttctaagtatcttaatgactttttcactattgcatatggatttctttcccatttatgcttctagttgttcatgcttaaatatggaatatctaatgacttttgtgtattaattagatatcatagtattaccttatcagatattcttattaattctatcagttttttaaaaaactatagtctattgggtttttaaaaaatacagttatgcaattagtaaaaatggtgtatctttgtttcagtgacttcatttgtcagacctgccatgacaatgttgaataataatagccatagcaggcatgcctgtttggtttctgactttatttaaaatagttttattgtttcacctagtaaaaagatgtttgctgttggttttaggtaaatatactttatcacaataaattttacttttgcattccttg

SEQ ID NO: 104573 - DNA, 829 bp, Homo sapiens
  Payload ID: 534
  Gene Symbol: ACYP2
  Gene Name: acylphosphatase 2, muscle type
  ENST ID: ENST00000494922
  CDS Start-End: 1-200
ccgcccagtcactcaaatccgtggactacgaggtgttcggaagagtgcagggtgtttgcttcagaatgtatacagaagatgaagctaggaaaataggagtggttggctgggtgaagaataccagcaaaggcaccgtgacaggccaagtgcaggggccagaagacaaagtcaattccatattagcttttcccttctattgaagccttgatagcccagatacccaacaactttggagtcatgcctctaccctcaagctggagtgtcagaagtcctggctgagcaaggttggaagccctagttctcgcattgaccgcacaaacttttctaatgaaaaaaccatctctaagcttgaatactctaattttagtattagatactaatagaagagaaaaattgtaacacactgaacaatagatactgtatgttcttaagactatgtatactagaataatagtagcagagtagggtgaaaaggaactttctgttctgaaagctaagcgactgtacgtgctactaaaaatgtctgacactgaaataattttactcaactatgttttcaacaagcaaaaatatagtattctaagattaaaatgtcattacaaaatatttagtgtgaacatttaatttaaacttgtctcatggaatctttaatttcaatgaacattacagcatatatatgttatttggcgagacatcaaataaagttaaccatttaaaaattattttcatatactgttgtctatgttgaattataaaatcctctgaataatttgttactacggttatttgttattaaactcttcaaaaagaaccagtgattagaaataaa

SEQ ID NO: 104574 - DNA, 674 bp, Homo sapiens
  Payload ID: 534
  Gene Symbol: ACYP2
  Gene Name: acylphosphatase 2, muscle type
  ENST ID: ENST00000606865
  CDS Start-End: 206-457
acacactaatgatacgcctcctcacagaaggaatttccgctagagagaaagatgctttctcctgcagaaataagttataaaatctagagagagctcagtcatttagttctacttgccgtacttcaagaggatcttcactgcagttgttttggtatggagtgataggaaaaagtcagggaggttgtacggtaagcaaaattggagaatgactgcccttgttctacaaatagagtatacagaagatgaagctaggaaaataggagtggttggctgggtgaagaataccagcaaaggcaccgtgacaggccaagtgcaggggccagaagacaaagtcaattccatgaagtcctggctgagcaaggttggaagccctagttctcgcattgaccgcacaaacttttctaatgaaaaaaccatctctaagcttgaatactctaattttagtattagatactaatagaagagaaaaattgtaacacactgaacaatagatactgtatgttcttaagactatgtatactagaataatagtagcagagtagggtgaaaaggaactttctgttctgaaagctaagcgactgtacgtgctactaaaaatgtctgacactgaaataattttactcaactatgttttcaacaagcaaaaatatagtattctaagattaaaatgtcat

SEQ ID NO: 104575 - DNA, 713 bp, Homo sapiens
  Payload ID: 534
  Gene Symbol: ACYP2
  Gene Name: acylphosphatase 2, muscle type
  ENST ID: ENST00000606082
  CDS Start-End: 521-643
acccctctccgggctccgcctcctccgcgtcttcgtcgccctgcggccgctggcggcccgtcgccctcggaccgatcgctaggcccccttccctggccggcgtgctgctgggccccacgcggctctcagttcgttggcggcggcagcggccgctctgcccgccccgcaccggctctgctggtgacgctgcagccgccgggcccagaggttccggaccggcctcaagtcacttccggggcggggcggggcggagcgacggcgtcgggggaggcggtggtggcggcagctggagcccaacgggctgcgccttcttcgccgtgggcccggctcggagcccccaccccaggcctcaccggcccagcgcgaggctgcctcaccggaaacacgaggccgaattccaagctattgtcctgcttcgccgggggtcgcgcactccaagcggcagcccactggagtcccagtcgccacgacaggcggcagccagactcagcctgcctgcacccaggtgaaataaacagccatgttgctcacacaaagcctgtttggtggtctcttcccacggacgcgcgagacaatgaggagagaagcagttccagatgacaatgagctccctagaaacaaacatctgaactggaaaagttgaagaatttacgggagcaagcaaaataaggtctcttcctcttattctaaataaagtttcatggagaacacta

SEQ ID NO: 104576 - DNA, 1115 bp, Homo sapiens
  Payload ID: 534
  Gene Symbol: ACYP2
  Gene Name: acylphosphatase 2, muscle type
  ENST ID: ENST00000422521
  CDS Start-End: 251-601
gcggtggtggcggcagctggagcccaacgggctgcgccttcttcgccgtgggcccggctcggagcccccaccccaggcctcaccggcccagcgcgaggctgcctcaccggaaacacgaggccgaattccaagctattgtcctgcttcgccgggggtcgcgcactccaagcggcagcccactggagtcccagtcgccacgacaggcggcagccagactcagcctgcctgcacccaggtgaaataaacagccatgttgctcacacaaagcctgtttggtggtctcttcccacggacgcgcgagacaatgaggagatacaaggtctcgctgttctacctaggctgttctagaactcctaatgtcaagctatcctcctgcctcggcctcccatgctgttgggattacagctataaattcatacaattatcagagtttggttttggtcaagtcataattgtgagtgaagaaccatggaaggagaacatttcttgctcatcaactactttcataaaatcaacaatttgcttaaatccagactctgaattcagaccatgtttcaatgcttggctatccctgatcagggaaaatgcagttggtctctgagtcacactgtgaaatagtattcagagctgaggcttcatctgcagtgcttgattcaacagatccctgggctggtgtgagtaagtggaaagccattttagagaagccagaattgggttgccatctgtcacgcatgggctttgctccttacacatattggtgaataaaatgtttaacaggctgtagccggaaagtgatatgaagcatctcattcatgaggaaactctacattttgctttctatttaagagcattgtttaaatgtcctctgggctgtgtttatgcatgctcagctgaatagattcttgcctaaagtccactatcatcagcacttacaagatggaacaagaggaaattgtaaaactaatacgtgctgcttaccggtgttcagagcctcttctttcaaacatgacttatttacaaatttctccaactgaagtcatgcaatttttatttgttgtgcacttattttgtaccaatcactcttccaaccactaataaatatgtatttatacaca

SEQ ID NO: 104577 - DNA, 831 bp, Homo sapiens
  Payload ID: 534
  Gene Symbol: ACYP2
  Gene Name: acylphosphatase 2, muscle type
  ENST ID: ENST00000607452
  CDS Start-End: 256-774
gggaggcggtggtggcggcagctggagcccaacgggctgcgccttcttcgccgtgggcccggctcggagcccccaccccaggcctcaccggcccagcgcgaggctgcctcaccggaaacacgaggccgaattccaagctattgtcctgcttcgccgggggtcgcgcactccaagcggcagcccactggagtcccagtcgccacgacaggcggcagccagactcagcctgcctgcacccaggtgaaataaacagccatgttgctcacacaaagcctgtttggtggtctcttcccacggacgcgcgagacaatgaggagatacaaggtctcgctgttctacctaggctgttctagaactcctaatgtcaagctatcctcctgcctcggcctcccatgctgttgggattacagctataaattcatacaattatcagagtttggttttggtcaagtcataattgtgagtgaagaaccatggaaggagaacatttcttgctcatcaactactttcataaaatcaacaatttgcttaagtgtttgcttcagaatgtatacagaagatgaagctaggaaaataggagtggttggctgggtgaagaataccagcaaaggcaccgtgacaggccaagtgcaggggccagaagacaaagtcaattccatgaagtcctggctgagcaaggttggaagccctagttctcgcattgaccgcacaaacttttctaatgaaaaaaccatctctaagcttgaatactctaattttagtattagatactaatagaagagaaaaattgtaacacactgaacaatagatactgtatgttcttaagactat

SEQ ID NO: 104578 - DNA, 1925 bp, Homo sapiens
  Payload ID: 535
  Gene Symbol:
  Gene Name: AD000671.6
  ENST ID: ENST00000589807
  CDS Start-End: 42-335
agtgacgtaagagcagccagacctggagggcttgggtaaaaatggctgaatatttagcttcgatattcgggactgagaaggacaaggttaactgctctttttactttaagatcggggtctgccggcacggggaccggtgctcccggcttcacaacaagccgacattcagccagccctgccctctgagctcaggccccgccccttttaaattctgtgcagaccatagtgctgctcaacctgtaccggaatccacagaacacagcccaaactgcagacggatcacactgaggtgttcacagaactgcaggagaagtatggggagattgaagagatgaatgtgtgcgacaaccttggggaccacctcgtgggcaacgtctatgtcaagttccggagggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggctcccgggctccataatgtaatctgttcagcatggagaccttcttctaccgcccctgtcttaataaagctgcgtgtttcacttcggcatcaacttgcttttgctgtggtttggcatttccctccacccacacatgtgacgaaaaggggaaacaagactgggtcctggccacaacttcagctgaggaacttggcacggccagcttgggacccaggaccctaacgtgtagcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccggactatgagttccgggaaaactgcggactcaatgaccacggcgatttcgtaacgcccccgttccgaaagtgttcttctgggcagtgcaaccccgacggcgcggagctatgtagcccctgcggcggcggagccgtgacccctactcccgccgcgggcgggggcagaaccccgtggcgctgcagagagaggccggtccctgccaaggggcactgccccctcacacctggaaacccaggcgcccctagctcccaggagcgcagctcaccagcaagttccattgcctggaggacccctgagcctgtccctcagcaggcctggccgaatttccttccgctcgtggtgctggtcctgctcctgaccttggcggtgatagcgatcctcctgtttattctgctctggcatctctgctggcccaaggagaaagccgacccctatccctatcctggcttggtctgcggagtccccaacacccacaccccttcctcctcgcatctgtcctccccaggcgccctggagacaggggacacatggaaggaggcctcactacttccactcctgagcagggaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgactact

SEQ ID NO: 104579 - DNA, 11431 bp, Homo sapiens
  Payload ID: 536
  Gene Symbol: ADAM10
  Gene Name: ADAM metallopeptidase domain 10
  Uniprot ID: O14672
  ENST ID: ENST00000260408
  CDS Start-End: 445-2691
gcggcggcaggcctagcagcacgggaaccgtcccccgcgcgcatgcgcgcgcccctgaagcgcctgggggacgggtaggggcgggaggtaggggcgcggctccgcgtgccagttgggtgcccgcgcgtcacgtggtgaggaaggaggcggaggtctgagtttcgaaggagggggggagagaagagggaacgagcaagggaaggaaagcggggaaaggaggaaggaaacgaacgagggggagggaggtccctgttttggaggagctaggagcgttgccggcccctgaagtggagcgagagggaggtgcttcgccgtttctcctgccaggggaggtcccggcttcccgtggaggctccggaccaagccccttcagcttctccctccggatcgatgtgctgctgttaacccgtgaggaggcggcggcggcggcagcggcagcggaagatggtgttgctgagagtgttaattctgctcctctcctgggcggcggggatgggaggtcagtatgggaatcctttaaataaatatatcagacattatgaaggattatcttacaatgtggattcattacaccaaaaacaccagcgtgccaaaagagcagtctcacatgaagaccaatttttacgtctagatttccatgcccatggaagacatttcaacctacgaatgaagagggacacttcccttttcagtgatgaatttaaagtagaaacatcaaataaagtacttgattatgatacctctcatatttacactggacatatttatggtgaagaaggaagttttagccatgggtctgttattgatggaagatttgaaggattcatccagactcgtggtggcacattttatgttgagccagcagagagatatattaaagaccgaactctgccatttcactctgtcatttatcatgaagatgatattaactatccccataaatacggtcctcaggggggctgtgcagatcattcagtatttgaaagaatgaggaaataccagatgactggtgtagaggaagtaacacagatacctcaagaagaacatgctgctaatggtccagaacttctgaggaaaaaacgtacaacttcagctgaaaaaaatacttgtcagctttatattcagactgatcatttgttctttaaatattacggaacacgagaagctgtgattgcccagatatccagtcatgttaaagcgattgatacaatttaccagaccacagacttctccggaatccgtaacatcagtttcatggtgaaacgcataagaatcaatacaactgctgatgagaaggaccctacaaatcctttccgtttcccaaatattggtgtggagaagtttctggaattgaattctgagcagaatcatgatgactactgtttggcctatgtcttcacagaccgagattttgatgatggcgtacttggtctggcttgggttggagcaccttcaggaagctctggaggaatatgtgaaaaaagtaaactctattcagatggtaagaagaagtccttaaacactggaattattactgttcagaactatgggtctcatgtacctcccaaagtctctcacattacttttgctcacgaagttggacataactttggatccccacatgattctggaacagagtgcacaccaggagaatctaagaatttgggtcaaaaagaaaatggcaattacatcatgtatgcaagagcaacatctggggacaaacttaacaacaataaattctcactctgtagtattagaaatataagccaagttcttgagaagaagagaaacaactgttttgttgaatctggccaacctatttgtggaaatggaatggtagaacaaggtgaagaatgtgattgtggctatagtgaccagtgtaaagatgaatgctgcttcgatgcaaatcaaccagagggaagaaaatgcaaactgaaacctgggaaacagtgcagtccaagtcaaggtccttgttgtacagcacagtgtgcattcaagtcaaagtctgagaagtgtcgggatgattcagactgtgcaagggaaggaatatgtaatggcttcacagctctctgcccagcatctgaccctaaaccaaacttcacagactgtaataggcatacacaagtgtgcattaatgggcaatgtgcaggttctatctgtgagaaatatggcttagaggagtgtacgtgtgccagttctgatggcaaagatgataaagaattatgccatgtatgctgtatgaagaaaatggacccatcaacttgtgccagtacagggtctgtgcagtggagtaggcacttcagtggtcgaaccatcaccctgcaacctggatccccttgcaacgattttagaggttactgtgatgttttcatgcggtgcagattagtagatgctgatggtcctctagctaggcttaaaaaagcaatttttagtccagagctctatgaaaacattgctgaatggattgtggctcattggtgggcagtattacttatgggaattgctctgatcatgctaatggctggatttattaagatatgcagtgttcatactccaagtagtaatccaaagttgcctcctcctaaaccacttccaggcactttaaagaggaggagacctccacagcccattcagcaaccccagcgtcagcggccccgagagagttatcaaatgggacacatgagacgctaactgcagcttttgccttggttcttcctagtgcctacaatgggaaaacttcactccaaagagaaacctattaagtcatcatctccaaactaaaccctcacaagtaacagttgaagaaaaaatggcaagagatcatatcctcagaccaggtggaattacttaaattttaaagcctgaaaattccaatttgggggtgggaggtggaaaaggaacccaattttcttatgaacagatatttttaacttaatggcacaaagtcttagaatattattatgtgccccgtgttccctgttcttcgttgctgcattttcttcacttgcaggcaaacttggctctcaataaacttttaccacaaattgaaataaatatatttttttcaactgccaatcaaggctaggaggctcgaccacctcaacattggagacatcacttgccaatgtacataccttgttatatgcagacatgtatttcttacgtacactgtacttctgtgtgcaattgtaaacagaaattgcaatatggatgtttctttgtattataaaatttttccgctcttaattaaaaattactgtttaattgacatactcaggataacagagaatggtggtattcagtggtccaggattctgtaatgctttacacaggcagttttgaaatgaaaatcaatttacctttctgttacgatggagttggttttgatactcattttttctttatcacatggctgctacgggcacaagtgactatactgaagaacacagttaagtgttgtgcaaactggacatagcagcacatactacttcagagttcatgatgtagatgtctggtttctgcttacgtcttttaaactttctaattcaattccatttttcaattaataggtgaaattttattcatgctttgatagaaattatgtcaatgaaatgattctttttatttgtagcctacttatttgtgtttttcatatatctgaaatatgctaattatgttttctgtctgatatggaaaagaaaagctgtgtctttatcaaaatatttaaacggttttttcagcatatcatcactgatcattggtaaccactaaagatgagtaatttgcttaagtagtagttaaaattgtagataggccttctgacattttttttcctaaaatttttaacagcattgaaggtgaaacagcacaatgtcccattccaaatttatttttgaaacagatgtaaataattggcattttaaagagaaagcaaaaacatttaatgtattaacaggcttattgctatgcaggaaatagaaggggcattacaaaaattgaagcttgtgacatatttattgcttctgttttccaactacatcacttcaactagaagtaaagctatgattttcctgacttcacataggaggcaaatttagagaaagttgtaaagatttctatgttttgggtttttttttttcctttttttttttaagagtataaggtttacacaatcattctcataatgtgacgcaagccagcaaggccaaaaatgctagagaaaataacgggatctcttccttgtaaacttgtacagtatgtggtgactttttcaaaatacagctttttgtacatgatttagagacaaattttgtacatgaaaccccagatagactataaataattctaaacaaacaagtaggtagatatgtatgtaattgcttttaaatcatttaaatgcctttgtttttggactgtgcaaaggttggaagtgggtttgcatttctaaaatggtgacttttattctgcaagagttcttagtaacttcttgagtgtggtagactttggaacatgtaaattttttgcttgtaatgttatcctgtggtaggattttggcaggtacacacactgccctattttattttgagtctaagttaaatgttttctgaaaagagatacatgcactgaactctttccactgcgaatcaagatgtggtaatataaaaggatcaagacaaatgagatctaatactactgtcagttttaatgtccactgtgttttatacagtatctttttttgttcactttggaaatttttactaaaaattgcaaaaaataaagtattgtgcaaagatgtaaggttttttgaaacttgaaatgcattaataaatagacgattaaatcaacttgaaggttctatactctttgaactctgagaactatcacaagaagcttcccacaaggcagtgttttcttacagttgtctcttcctacaaaagtatagattatctttattcttaatactttggaatccatgtagaaaatttccagttagatactctgcgtacacacaataaacctttttaaaacacccaactaatctcaactgcattacattgtttctaatcaatattcagtgcttgtcttggtggaagaggtgagtcattttgaaaacttatggtcttgtttttatgtgtttttcaaagttttgaatgctaagtacctcatttattttaaaaagcctagtttaatgataagtttgtttaaaattttgagccatcatttttctcttcatagcaaataaggagagaattgacatttcagtgttacctagaaaaggaattgtaagcccagaataattccctgcatgaggtaatctgcttcaaattctttttttagtcaaggttagctataagtaatacttgttaaatgagtaaatatgtaatactttgtgaattactttgttaatttaggagcatcaaatgtatattatgtttagttatttatgaaactctcaatattgattgatttgggtaattataaattagttatttttacttgtaattgaatgcttaaattctgtttacagtccgtcctctctccctccatccctccctccccagttttataaattcaggtaccaattcacaaacaaaatcagaaataaaataaatttattgactgcttctggatttagcattccctgtagtgtcaagcaatgtcatgcagtttggggaagcatttatttaaggaaatgacaactttctctgatcagtcttgttttgtgaggtgtcttcaacactttatgctttgggtacttcgtgtttgtcacagtcttaggatagtgaaatctgatttgtccaagcggagcaaactactcgaccctcagtccttgtatttgtccctgtagtaagacctaattattattatttcttaaagatgggattggtgtccttggcaactatgaaatttcggggcttgtgcatgagaaggcatttcttattaagtatttctaattgaaggtatcagagtgtcaagcattacaaacctggacagttcacctggaggagtacaagaagagatattcattatccatatttaaagggtcaaggtttcccaaaaccagggtgcaagccagatgtagttttaaagcagctgccagggacagttcatctttagagaagtcactaaagttgtaagaaattttagtttccccaaaaccactttcaacttcttagaaactagaaagacaattggtttgccccacagaggacaacttcagtttcagcatctctcatgttgtgttcttgattaaaaacaacttccatttgatatacttttccgtttattaccagtttagttttttcactattgtttctgtattcaactctttatatgattaggatagaaatttagcccttctgttttatattactatattgtttgtgtgtcttagatatatacatgtatgtactattttcagtagaaattcatgtattttataattggtaagttcttcagagcatctcttctataaaaagcaacaggatgctaggtaaaacggagcattgagcaaaatactgattagtttttgctttttcctgaaatctacactaaagtgatagggtgtggggtaatccaacaaggacaaggtgaattgaacaagaacgaaatctggaagcagatgaaggagtactattgattgggcagacccagggaagtcaaatcctaaaccagcagtgggaacacaacagaatggtgtagtttgcactggtaagatttgggtacctggcagggctgggtgcggtggctcacacctgtaatcccagcactttgggaggccaaggcgggtggatcacttgaggtcaggagttcgagaccaccctggccaacatggtgaaaccccgtctctactaaaaatacagctgggcgtggtggcacatgcttgtaatcccagctactcgggaggcagaggcaggagatttgcttgaacccgggaggcagaggcaggagatttgcttgaacccaggaggcagaggctgcagtgagccgcgattgcgccattgcactccagcctgggtgacagagcgagactctgtctcaaaaaaaaaaaaaaaaaaaaaaaaaaaaaaaaaaaaaaaaaaaaaaaatttgagtacctggcctttgttactttttttctatgtgtgtgacaaaaacataatatgcacacttttgtaacccacctttctcatttaatggtacattgataatgtatatcacattaactactctaaatatttctgtggatgtatgtttttttttttcttaaccaatttcccattgtttggacatgtaggttccacattgtttattattttaaacaattctaaagaattttaaacaattcttaggaaaatcctcagcctaataatgaaattaattcctaaaagtggaattgttggggtaaaggttttttgagggacattgataaaaattatggtactgtctcccagatagatgtaccaagttatactaccacgatttaatatatatatatatatatattaaatcagagtcccatccttagaaatccacatatatgcagccacatgaatgtattagaaacaataatagaagactcatgcttaattcagttgattagctttagacataattcaaatgcaagtcaaattgagtgccctaattgtggtctcttaagtaccatttttcttcaagggaaccagactcctttggataaatcactaattccacctgtaagaaagaaatgtacaagaagaacctaggaaacattgttttgtaccagatcagaaagattcaggaggcaccttagaagttaccactggccaaggctgagataactttagcatcagcaaggataatatctgcaagagattgaaactcatagtattgtatttaactctgtgagttaatgatggtagtggacagaattatagttacctttgggatacgcttttaaagaaattccaggtaataagagaaatgatagaattaggatatcaccattttacccccccaacaatttatggatctagacaataatcgccagtgactgctaacctcacaaagtgagagcaatcagattttgtgcctcctaatggaagtacatataccacctatgaagcagttctgccaaaagtcacatctcatcatgatgaagcctcctgatctaactaccccttcattagaaatacaggggacagagggacaaataatatacaagggactcaatcagcaaaatccagactctggaaaactacaagacatatggtcctgcttcaacaacagaaatgcaaagagaaaagacaacgatgggttaaaggagacttaagagctacatctatcaagacaatttatggacttatttggatactgatttgaacaaactgttgagaccattggaaaaatgtgaaaagtggatatttgatattaaggtttttaattatttttaggtgtgataatggtattgttacattttttaaaggaccccttttagagatgcaaattgaaacacttaaaaaatgaaatgatacgatgtataagtttttgcttaaaaataaggattgaagttggctggtgtgtgtggatatagttgaaacaagattggctgtgagttgataattattgaagctgggtgatgggcacttggggatttattatactattttctctacctgtgtttatatttgaaatttttcatagaagttttaaaatgtggccagttgtgatggctcatacctgtaatcccaacactttgggaggccaaggtgggaggatcacttgagctcaggagttagagaccagcctgggcaaaatagtgagactccatctcaaagaaaaaaaaaaagtgttttaaatgtgaatcaaattcctatagaagctgattcattactgtttttattttagcagtaattcatgataatgacctgtattcataatgattttcataatgattgttttagtggaattaaacttgaaccagtcaagctaacataattatattctgctccagttacaatgaataattaattgatttcaactgctagggtgaactcttgaagctatcagtcatccagcaatcttagcaagcaggccattgggtccctgtttgctctgtctctctctctctctctcactgttgaagggcttagctaactacttaagtaaaatatttgttctctgttaaacatgtcaaggagtatggtcagcttatccacattaagcctgtgtgtcccacgttggagtaaatgttaagtagctcactacaataaactagattcttctgccctctcttgtttaaatgatcatgttccctggaggtggaaatagatctttaaaaagatattctgtagttgtttgttctcagtgtaaaaaaatgagaataatttgataagagtgtaggttgtcttatataaaaagtggttccatttgcatgaattttagaaaaatcattttggaaaaatgaaggctatgtggttatactgaacacattaagcaattttattctttattttaaatgaatattttattatcgttttcttcccttgccctttgggtatgggagttagcctttgtgtttctaaatacaacaggccggtttttataaattaaggtgtcaatatattcttcattatttagttttgtgattgtggttagttttcatttttcttaagtatctgctagtagcatctgtaattaagtgaagtgacctgttaaccattttcctctttctcctcctttcctcctccttgaaacatatcagagcatgtttgaaattctttggcttttatggtatgcatttgctgatatgcattgaccagttaccttactcacagatacttcttaggcacttgattgtgccagggccttggctagatgataagaatacagtagtgaacttaacagtttccctgccctggtgaagcgtatggtcttgtaggtgagatagatatcagataatcatgtgaataaatgtacaattccagctgtgatacatgctgaggaggaggtttttggtgatccaagagctgatcatgcagagataggactgagaaaggagggtgggacgttgtcacagctgataatgcagagataggactgagaaaggagggtgggacatcaggaaggtcagagaattccttatgaaagtgatgcttgagtcaaaatatgatggatgaagagagtttaaatagattacatagaatttttaataatgtcgattggttatatactgggcactgatagctgatttttctttggggaaaggtatgtcagcctagtcattcagattcctttatttttttaaatgttttttcattttttgctttgcattgcattcatttgctgaagagctggcttgtactttggcaggtgtcatacttggttattctccttaggatattggcccaacaatctgggagttgtgaaaggcgcttcgcttttcagacctgggcgtctgtatcatgactatcataaatttaggattaagacacctagcctcctaccaggatgaatgaggtgtccatgtgacctgctgtgccctggaattttatacatctttctctcatagcacacaccatattacaatataatcctgcctcatctaagccaaactttcgagagaatcatttacactcagtggctacttcagctcccattcacttatcaacctgctgcaatttttcacagcccccaaaggactgcagtctgtgccttcagggagctgagggtctagcggaaggaaagaaaccagcagttacagtacagaggggtttgtgttggaaactctacaaacacaggatgccctggtagctcagaggaagtgcatatcgagcatggtaggtaggtagtgggaagagccaagatgacttcccagaggagaaaagctggacctgagttttggagtttcggtaaaagtttgctctaactagtccaagctgctgtcacaagcttttagaaatgatgtaaccatggggcagttgactgtcgtcatgttctttgctattttcatgactctggatgtgcttttcctattccctggattgccctttccctcgattcctctgcaggactgggctttattaatctccatttccttgagcttggctatagtaggtgttcaataaacatttgttttgttgtgtgctttgtaaataggcaatgaagctgatttcacaagataggcacaaaagttagtttcattacaacacattaccaacagctgtatttttaacttttaacatatctcattctaaatcctgtggcagcacaacctccttccgtcatacctggagataaattttctttcaaaatctaatatgcactgtatttatagaatatgaaacataccgaccatgttttgcaaaaatgggaaaggcataacttagctttggggcatgtaagtaacaactcctgataggagaagaaatgtattcagaaagctcaaattagaaataaaatgggagactctaga

SEQ ID NO: 104580 - DNA, 861 bp, Homo sapiens
  Payload ID: 536
  Gene Symbol: ADAM10
  Gene Name: ADAM metallopeptidase domain 10
  ENST ID: ENST00000402627
  CDS Start-End: 61-276
ggatcgatgtgctgctgttaacccgtgaggaggcggcggcggcggcagcggcagcggaagatggtgttgctgagagtgttaattctgctcctctcctgggcggcggggatgggagaccgagattttgatgatggcgtacttggtctggcttgggttggagcaccttcaggaagctctggaggaatatgtgaaaaaagtaaactctattcagatgtgcctacaatgggaaaacttcactccaaagagaaacctattaagtcatcatctccaaactaaaccctcacaagtaacagttgaagaaaaaatggcaagagatcatatcctcagaccaggtggaattacttaaattttaaagcctgaaaattccaatttgggggtgggaggtggaaaaggaacccaattttcttatgaacagatatttttaacttaatggcacaaagtcttagaatattattatgtgccccgtgttccctgttcttcgttgctgcattttcttcacttgcaggcaaacttggctctcaataaacttttaccacaaattgaaataaatatatttttttcaactgccaatcaaggctaggaggctcgaccacctcaacattggagacatcacttgccaatgtacataccttgttatatgcagacatgtatttcttacgtacactgtacttctgtgtgcaattgtaaacagaaattgcaatatggatgtttctttgtattataaaatttttccgctcttaattaaaaattactgtttaattgacatactcaggataacagagaatggtggtattcagtggtccaggattctgtaatgctttacacaggcagttttgaaatgaaaatcaatttacctttctg

SEQ ID NO: 104581 - DNA, 601 bp, Homo sapiens
  Payload ID: 536
  Gene Symbol: ADAM10
  Gene Name: ADAM metallopeptidase domain 10
  ENST ID: ENST00000439637
  CDS Start-End: 225-601
aaggaaacgaacgagggggagggaggtccctgttttggaggagctaggagcgttgccggcccctgaagtggagcgagagggaggtgcttcgccgtttctcctgccaggggaggtcccggcttcccgtggaggctccggaccaagccccttcagcttctccctccggatcgatgtgctgctgttaacccgtgaggaggcggcggcggcggcagcggcagcggaagatggtgttgctgagagtgttaattctgctcctctcctgggcggcggggatgggaggtcagtatgggaatcctttaaataaatatatcagacattatgaaggattatcttacaatgtggattcattacaccaaaaacaccagcgtgccaaaagagcagtctcacatgaagaccaatttttacgtctagatttccatgcccatggaagacatttcaacctacgaatgaagagggacacttcccttttcagtgatgaatttaaagtagaaacatcaaataaagtacttgattatgatacctctcatatttacactggacatatttatgactatccccataaatacggtcctcaggggggctgtgcagatcattcagtatt

SEQ ID NO: 104582 - DNA, 583 bp, Homo sapiens
  Payload ID: 536
  Gene Symbol: ADAM10
  Gene Name: ADAM metallopeptidase domain 10
  ENST ID: ENST00000561288
  CDS Start-End: 174-290
gttgccggcccctgaagtggagcgagagggaggtgcttcgccgtttctcctgccaggggaggtcccggcttcccgtggaggctccggaccaagccccttcagcttctccctccggatcgatgtgctgctgttaacccgtgaggaggcggcggcggcggcagcggcagcggaagatggtgttgctgagagtgttaattctgctcctctcctgggcggcggggatgggagtgcctacaatgggaaaacttcactccaaagagaaacctattaagtcatcatctccaaactaaaccctcacaagtaacagttgaagaaaaaatggcaagagatcatatcctcagaccaggtggaattacttaaattttaaagcctgaaaattccaatttgggggtgggaggtggaaaaggaacccaattttcttatgaacagatatttttaacttaatggcacaaagtcttagaatattattatgtgccccgtgttccctgttcttcgttgctgcattttcttcacttgcaggcaaacttggctctcaataaacttttaccacaaattgaaataaatatatttttttcaactgcca

SEQ ID NO: 104583 - DNA, 587 bp, Homo sapiens
  Payload ID: 536
  Gene Symbol: ADAM10
  Gene Name: ADAM metallopeptidase domain 10
  ENST ID: ENST00000558004
  CDS Start-End: 241-587
aagcggggaaaggaggaaggaaacgaacgagggggagggaggtccctgttttggaggagctaggagcgttgccggcccctgaagtggagcgagagggaggtgcttcgccgtttctcctgccaggggaggtcccggcttcccgtggaggctccggaccaagccccttcagcttctccctccggatcgatgtgctgctgttaacccgtgaggaggcggcggcggcggcagcggcagcggaagatggtgttgctgagagtgttaattctgctcctctcctgggcggcggggatgggaggtcagtatgggaatcctttaaataaatatatcagacattatgaaggattatcttacaatgtggattcattacaccaaaaacaccagcgtgccaaaagagcagtctcacatgaagaccaatttttacgtctagatttccatgcccatggaagagatggggttttgccgtgttgcccaggctggtctcaaactcctgggttgaaacgatccacctgcctcagcctcccacagtgctgggattacagatgtgagcctagccctatgatatctgtctttgactatccccataaata

SEQ ID NO: 104584 - DNA, 541 bp, Homo sapiens
  Payload ID: 536
  Gene Symbol: ADAM10
  Gene Name: ADAM metallopeptidase domain 10
  ENST ID: ENST00000559053
  CDS Start-End: 97-541
gaggctccggaccaagccccttcagcttctccctccggatcgatgtgctgctgttaacccgtgaggaggcggcggcggcggcagcggcagcggaagatggtgttgctgagagtgttaattctgctcctctcctgggcggcggggatgggagaccgagattttgatgatggcgtacttggtctggcttgggttggagcaccttcaggaagctctggaggaatatgtgaaaaaagtaaactctattcagatggtaagaagaagtccttaaacactggaattattactgttcagaactatgggtctcatgtacctcccaaagtctctcacattacttttgctcacgaagttggacataactttggatccccacatgattctggaacagagtgcacaccaggagaatctaagaatttgggtcaaaaagaaaatggcaattacatcatgtatgcaagagcaacatctggggacaaacttaacaacaataaattctcactctgtagtattagaaatataagccaagttcttgagaagaagagaaaca

SEQ ID NO: 104585 - DNA, 2418 bp, Homo sapiens
  Payload ID: 536
  Gene Symbol: ADAM10
  Gene Name: ADAM metallopeptidase domain 10
  ENST ID: ENST00000396136
  CDS Start-End: 1-176
gtgaagaaggaagttttagccatgggtctgttattgatggaagatttgaaggattcatccagactcgtggtggcacattttatgttgagccagcagagagatatattaaagaccgaactctgccatttcactctgtcatttatcatgaagatgatattagtgaaggcttaaactgaggcttagaaaacttatgtcacttgattgtggacctcctgttctttaccctgtgctcttctgcttcactcatggaagaaagctgtaaattctcactgcctttacttcaaggatttctggggcttttctgaaatctactatccccataaatacggtcctcaggggggctgtgcagatcattcagtatttgaaagaatgaggaaataccagatgactggtgtagaggaagtaacacagatacctcaagaagaacatgctgctaatggtccagaacttctgaggaaaaaacgtacaacttcagctgaaaaaaatacttgtcagctttatattcagactgatcatttgttctttaaatattacggaacacgagaagctgtgattgcccagatatccagtcatgttaaagcgattgatacaatttaccagaccacagacttctccggaatccgtaacatcagtttcatggtgaaacgcataagaatcaatacaactgctgatgagaaggaccctacaaatcctttccgtttcccaaatattggtgtggagaagtttctggaattgaattctgagcagaatcatgatgactactgtttggcctatgtcttcacagaccgagattttgatgatggcgtacttggtctggcttgggttggagcaccttcaggaagctctggaggaatatgtgaaaaaagtaaactctattcagatggtaagaagaagtccttaaacactggaattattactgttcagaactatgggtctcatgtacctcccaaagtctctcacattacttttgctcacgaagttggacataactttggatccccacatgattctggaacagagtgcacaccaggagaatctaagaatttgggtcaaaaagaaaatggcaattacatcatgtatgcaagagcaacatctggggacaaacttaacaacaataaattctcactctgtagtattagaaatataagccaagttcttgagaagaagagaaacaactgttttgttgaatctggccaacctatttgtggaaatggaatggtagaacaaggtgaagaatgtgattgtggctatagtgaccagtgtaaagatgaatgctgcttcgatgcaaatcaaccagagggaagaaaatgcaaactgaaacctgggaaacagtgcagtccaagtcaaggtccttgttgtacagcacagtgtgcattcaagtcaaagtctgagaagtgtcgggatgattcagactgtgcaagggaaggaatatgtaatggcttcacagctctctgcccagcatctgaccctaaaccaaacttcacagactgtaataggcatacacaagtgtgcattaatgggcaatgtgcaggttctatctgtgagaaatatggcttagaggagtgtacgtgtgccagttctgatggcaaagatgataaagaattatgccatgtatgctgtatgaagaaaatggacccatcaacttgtgccagtacagggtctgtgcagtggagtaggcacttcagtggtcgaaccatcaccctgcaacctggatccccttgcaacgattttagaggttactgtgatgttttcatgcggtgcagattagtagatgctgatggtcctctagctaggcttaaaaaagcaatttttagtccagagctctatgaaaacattgctgaatggattgtggctcattggtgggcagtattacttatgggaattgctctgatcatgctaatggctggatttattaagatatgcagtgttcatactccaagtagtaatccaaagttgcctcctcctaaaccacttccaggcactttaaagaggaggagacctccacagcccattcagcaaccccagcgtcagcggccccgagagagttatcaaatgggacacatgagacgctaactgcagcttttgccttggttcttcctagtgcctacaatgggaaaacttcactccaaagagaaacctattaagtcatcatctccaaactaaaccctcacaagtaacagttgaagaaaaaatggcaagagatcatatcctcagaccaggtggaattacttaaattttaaagcctgaaaattccaatttgggggtgggaggtggaaaaggaacccaattttcttatgaacagatatttttaacttaatggcacaaagtcttagaatattattatgtgccccgtgttccctgttcttcgttgctgcattttcttcacttgcaggcaaacttggctctcaataaactttt

SEQ ID NO: 104586 - DNA, 1932 bp, Homo sapiens
  Payload ID: 536
  Gene Symbol: ADAM10
  Gene Name: ADAM metallopeptidase domain 10
  ENST ID: ENST00000461408
  CDS Start-End: 186-365
ggagctaggagcgttgccggcccctgaagtggagcgagagggaggtgcttcgccgtttctcctgccaggggaggtcccggcttcccgtggaggctccggaccaagccccttcagcttctccctccggatcgatgtgctgctgttaacccgtgaggaggcggcggcggcggcagcggcagcggaagatggtgttgctgagagtgttaattctgctcctctcctgggcggcggggatgggagcccctgcccggtggcggattccgaagtcctctccgccgccgagacccgccgcgcagactcgtgggaagttgtgttgtttgcagctgggctcgtgtattgttctttacccggcgcgccggtcctgaccgaccccattctgcagaggggccgcccgtggagtggcagcagtcatcacccgcttatctgagactagtggcctcggttcttcctgtgtcctgtgtttggagagagatcacaggagggtgtgttggtgttcttgaaaacattctgtcgcccaggggaaagggtttggtcgggagaagggtaaaccatttggggatgttctttgatttgtaggctggattgggtctcttagagtagaagttcggtccctgggtgacccaacttgaagagtttcgttaaactttcaggtggagtagatgtacagtgtagttagtggattgtcaaaacagtgccccctcccccctgcacatgaaagtcaaatttgctaaaagcatgtcatttcttgtttcgggttttgaagacaacgatttttatttccggtgtgttctaggaccagctgcatcattttattcttgcttaaagtgctttattttaggtaagctttttgacttgccccagagtaaacttaaaaacctcaaggtgtgcctaaaagcaacgattgaaaaaatttgaggaatgctttggatgagtgtctgtagcctttgataatttagaaaatatctatttcatgtaatgtattgtttctgtttttttctttgccactttgacttatgactgcaggaccaagtgtatttctgtcctgtattctaccgagtccgagggtggtactgcgtaggcagacttctgttatagtttgtagtgttcatttttttgttacacgttttatttaatttttttcaatccaattcatcaagcaagacacacattatagattaagagctgataatagatgtttagttttaaaaaggattatgtgcgggagactctctgttagaggagcctttttcatctgacatttgttatttctgttctaaacgtggctttcaacaaatcgttttcctatcttttttcactttttgtgattaaattcaggagttaagacactgttctctataaggtaataaaaagtaagacaaacacatgaggcactttactgagtagtagtatactaaatgttcttttaaaaataatgaaaacagtaagaaactgatgtagtcttatatttgaagaaaaaacaattgaataacatgtttgtgggttaaaactcttatacaaaaattttctaaattcatatttccagagtcctttattgcattaagcattggttaaaaggctaatttttggtgtttttgttaagcagaactttttcaaaaaacataagacaagttttattagttttattttaaaattagtatcaagattctagcttttgggtacttggagatacttgtaattttattgtaactatggggtatttttatctactaatctgagctatttttggtcacttgtaagatctttgtatgatgatttgtagacttcagcacattgagattgaatgtatttgttttagcatatgagagaaaggagaaatttgtgtagattagaagttgtggtggaaatttaacttaaaatgtaaatcattttcaggtagttaataaatcctttttgttgcttccacctccccaa

SEQ ID NO: 104587 - DNA, 4571 bp, Homo sapiens
  Payload ID: 537
  Gene Symbol: ADAM11
  Gene Name: ADAM metallopeptidase domain 11
  Uniprot ID: O75078
  ENST ID: ENST00000200557
  CDS Start-End: 170-2479
cgctgagccccggcgccgtccctgccgcccccacctctccgcgacccccgcccggccccgcgcccccgccccggctccgcagctggcgcctccccacccccgtccctgctcccgccctccccgcgccgctggcagccgcagcccccggaccgggaggaatgagcgagccatgaggctgctgcggcgctgggcgttcgcggctctgctgctgtcgctgctccccacgcccggtcttgggacccaaggtcctgctggagctctgcgatgggggggcttaccccagctgggaggcccaggagcccctgaggtcacggaacccagccgtctggttagggagagctccgggggagaggtccgaaagcagcagctggacacaagggtccgccaggagccaccagggggcccgcctgtccatctggcccaggtgagtttcgtcatcccagccttcaactcaaacttcaccctggacctggagctgaaccaccacctcctctcctcgcaatacgtggagcgccacttcagccgggaggggacaacccagcacagcaccggggctggagaccactgctactaccaggggaagctccgggggaacccgcactccttcgccgccctctccacctgccaggggctgcatggggtcttctctgatgggaacttgacttacatcgtggagccccaagaggtggctggaccttggggagcccctcagggaccccttccccacctcatttaccggacccctctcctcccagatcccctcggatgcagggaaccaggctgcctgtttgctgtgcctgcccagtcggctcctccaaaccggccgaggctgagaaggaaaaggcaggtccgccggggccaccctacagtgcacagtgaaaccaagtatgtggagctaattgtgatcaacgaccaccagctgttcgagcagatgcgacagtcggtggtcctcaccagcaactttgccaagtccgtggtgaacctggccgatgtgatatacaaggagcagctcaacactcgcatcgtcctggttgccatggaaacatgggcagatggggacaagatccaggtgcaggatgacctcctggagaccctggcccggctcatggtctaccgacgggagggtctgcctgagcccagtgatgccacccacctcttctcgggcaggaccttccagagcacgagcagcggggcagcctacgtggggggcatatgctccctgtcccacggcgggggtgtgaacgagtacggcaacatgggggcgatggccgtgacccttgcccagacgctgggacagaacctgggcatgatgtggaacaaacaccggagctcggcaggggactgcaagtgtccagacatctggctgggctgcatcatggaggacactgggttctacctgccccgcaagttctcgcgctgtagcatcgacgagtacaaccagtttctgcaggagggtggtggcagctgcctcttcaacaagcccctcaagctcctggaccccccagagtgcgggaacggcttcgtggaggcaggggaggagtgcgactgcggctcggtgcaggagtgcagccgcgcaggtggcaactgctgcaagaaatgcaccctgactcacgacgccatgtgcagcgacgggctctgctgtcgccgctgcaagtacgaaccacggggtgtgtcctgccgagaggccgtgaacgagtgcgacatcgcggagacctgcaccggggactctagccagtgcccgcctaacctgcacaagctggacggttactactgtgaccatgagcagggccgctgctacggaggtcgctgcaaaacccgggaccggcagtgccaggttctttggggccatgcggctgctgatcgcttctgctacgagaagctgaatgtggaggggacggagcgtgggagctgtgggcgcaagggatctggctgggtccagtgcagtaagcaggacgtgctgtgtggcttcctcctctgtgtcaacatctctggagctcctcggctaggggacctggtgggagacatcagtagtgtcaccttctaccaccagggcaaggagctggactgcaggggaggccacgtgcagctggcggacggctctgacctgagctatgtggaggatggcacagcctgcgggcctaacatgttgtgcctggaccatcgctgcctgccagcttctgccttcaacttcagcacctgccccggcagtggggagcgccggatttgctcccaccacggggtctgcagcaatgaagggaagtgcatctgtcagccagactggacaggcaaagactgcagtatccataaccccctgcccacgtccccacccacgggggagacggagagatataaaggtcccagcggcaccaacatcatcattggctccattgctggggctgtcctggttgcagccatcgtcctgggcggcacgggctggggatttaaaaacattcgccgaggaaggtccggaggggcctaagtgccaccctcctccctccaagcctggcacccaccgtctcggccctgaaccacgaggctgcccccatccagccacggagggaggcaccatgcaaatgtcttccaggtccaaacccttcaactcctggctccgcaggggtttgggtgggggctgtggccctgcccttggcaccaccagggtggaccaggcctggagggcacttcctccacagtcccccacccacctcctgcggctcagccttgcacacccactgccccgtgtgaatgtagcttccacctcatggattgccacagctcaactcgggggcgcctggagggatgcccccaggcagccaccagtggacctagcctggatggcccctccttgcaaccaggcagctgagaccagggtcttacctctctgggacctagggggacggggctgacatctacattttttaaaactgaatcttaatcgatgaatgtaaactcgggggtgctggggccagggcagatgtggggatgttttgacatttacaggagggcccggagaaactgaggtatggccatgccctagaccctccccaaggatgaccacacccgaagtcctgtcactgagcacagtcaggggctgggcatcccagcttgcccccgcttagccccgctgagcttggaggaagtatgagtgctgattcaaaccaaagctgcctgtgccatgcccaaggcctaggttatgggtacggcaaccacatgtcccagatcgtctccaattcgaaaacaaccgtcctgctgtccctgtcaggacacatggattttggcagggcggggggggttctagaaaatatagttcctataataaaatggcaccttccccctttcaagaagggtgattctggggccgactcagggtttaggtgccccctggtgtggcctagatgtccccacctgggccatctttctggggaggactctcccaggtagggaaggccagaggtggcccagtgcctggagggttagggtctctgcctgggatatgcaagaggaagtaggaaagggaggtctcatggatgatcctaggctgctagaagtccttaaggccccatctagtccattccactccctacccccattccagagccgagtagtaagtttacagatgtttcccccattacgtacccccacccatccctgctgcagcgagcctgagagccaggtagagccaggcacagctcctcagtcttctcacacagtcctgccggtggccttccctcatgacccttgcttgggagggtggagcactggctccttgaccctaaaaggtagctggcaggggcaagatgggggccagctacctaatggatgaaagccacaagtgaatacagttcttgtcaccagggttgccctgccctcactcggcagggagttctgacaccccagggcccgtgagctacctgcttgagcccctgtttctggggcaccttcgaggaggcgttgtggagggcatcgccccctgtttattcacaacaccctcaggggcaaacaggcctgggacccgctgacaccattttgggtagctggatgcacccgacagcagtggggtccacacactgagctccagctggcactgcccactcaagggctgagtggaggggcccctccggccagctctgctccaccagccctgcaagctgatgcagggcgggggaagggctgggtgttgcactattgctgcgctgccttaaggcatctgtcctctggtggtgcacccgtgcacacaggtacagtgcatctgggcacagcttttggatccacacctctgcacaagtgtgaatacctctgcacatatgggcgtatctgtgtgtgctcgtgtatatggggtggggaacatgagacttcctgtgaccagtccaccctggctcccagctgtctgtatcctcctgccccgccctggcgagtgcctaccctggcagaacccagggaggagtggaggctgcctctgcctgggcctccacacagcatcctgtacatacgccacctgggctgggggtggggaggcagggccaggagcatcgattaaagatcacatcctggggcttccagggagctcacaccaa

SEQ ID NO: 104588 - DNA, 4220 bp, Homo sapiens
  Payload ID: 537
  Gene Symbol: ADAM11
  Gene Name: ADAM metallopeptidase domain 11
  ENST ID: ENST00000355638
  CDS Start-End: 22-747
accgggaggaatgagcgagccatgaggctgctgcggcgctgggcgttcgcggctctgctgctgtcgctgctccccacgcccggtcttgggacccaaggtcctgctggagctctgcgatgggggggcttaccccagctgggaggcccaggagcccctgaggtcacggaacccagccgtctggttagggagagctccgggggagaggtccgaaagcagcagctggacacaagggtccgccaggagccaccagggggcccgcctgtccatctggcccaggtgagtttcgtcatcccagccttcaactcaaacttcaccctggacctggagctgaaccaccacctcctctcctcgcaatacgtggagcgccacttcagccgggaggggacaacccagcacagcaccggggctggagaccactgctactaccaggggaagctccgggggaacccgcactccttcgccgccctctccacctgccaggggctgcatggggtcttctctgatgggaacttgacttacatcgtggagccccaagaggtggctggaccttggggagcccctcagggaccccttccccacctcatttaccggacccctctcctcccagatcccctcggatgcagggaaccaggctgcctgtttgctgtgcctgcccagtcggctcctccaaaccggccgaggctgagaaggaaaaggtccgccggggccaccctacagtgcacagtgaaaccaagtatgtggagctaattgtgatcaacgaccaccagctgttcgagcagatgcgacagtcggtggtcctcaccagcaactttgccaagtccgtggtgaacctggccgatgtgatatacaaggagcagctcaacactcgcatcgtcctggttgccatggaaacatgggcagatggggacaagatccaggtgcaggatgacctcctggagaccctggcccggctcatggtctaccgacgggagggtctgcctgagcccagtgatgccacccacctcttctcgggcaggaccttccagagcacgagcagcggggcagcctacgtggggggcatatgctccctgtcccacggcgggggtgtgaacgagtacggcaacatgggggcgatggccgtgacccttgcccagacgctgggacagaacctgggcatgatgtggaacaaacaccggagctcggcaggggactgcaagtgtccagacatctggctgggctgcatcatggaggacactgggttctacctgccccgcaagttctcgcgctgtagcatcgacgagtacaaccagtttctgcaggagggtggtggcagctgcctcttcaacaagcccctcaagctcctggaccccccagagtgcgggaacggcttcgtggaggcaggggaggagtgcgactgcggctcggtgcaggagtgcagccgcgcaggtggcaactgctgcaagaaatgcaccctgactcacgacgccatgtgcagcgacgggctctgctgtcgccgctgcaagtacgaaccacggggtgtgtcctgccgagaggccgtgaacgagtgcgacatcgcggagacctgcaccggggactctagccagtgcccgcctaacctgcacaagctggacggttactactgtgaccatgagcagggccgctgctacggaggtcgctgcaaaacccgggaccggcagtgccaggttctttggggccatgcggctgctgatcgcttctgctacgagaagctgaatgtggaggggacggagcgtgggagctgtgggcgcaagggatctggctgggtccagtgcagtaagcaggacgtgctgtgtggcttcctcctctgtgtcaacatctctggagctcctcggctaggggacctggtgggagacatcagtagtgtcaccttctaccaccagggcaaggagctggactgcaggggaggccacgtgcagctggcggacggctctgacctgagctatgtggaggatggcacagcctgcgggcctaacatgttgtgcctggaccatcgctgcctgccagcttctgccttcaacttcagcacctgccccggcagtggggagcgccggatttgctcccaccacggggtctgcagcaatgaagggaagtgcatctgtcagccagactggacaggcaaagactgcagtatccataaccccctgcccacgtccccacccacgggggagacggagagatataaaggtcccagcggcaccaacatcatcattggctccattgctggggctgtcctggttgcagccatcgtcctgggcggcacgggctggggatttaaaaacattcgccgaggaaggtccggaggggcctaagtgccaccctcctccctccaagcctggcacccaccgtctcggccctgaaccacgaggctgcccccatccagccacggagggaggcaccatgcaaatgtcttccaggtccaaacccttcaactcctggctccgcaggggtttgggtgggggctgtggccctgcccttggcaccaccagggtggaccaggcctggagggcacttcctccacagtcccccacccacctcctgcggctcagccttgcacacccactgccccgtgtgaatgtagcttccacctcatggattgccacagctcaactcgggggcgcctggagggatgcccccaggcagccaccagtggacctagcctggatggcccctccttgcaaccaggcagctgagaccagggtcttacctctctgggacctagggggacggggctgacatctacattttttaaaactgaatcttaatcgatgaatgtaaactcgggggtgctggggccagggcagatgtggggatgttttgacatttacaggagggcccggagaaactgaggtatggccatgccctagaccctccccaaggatgaccacacccgaagtcctgtcactgagcacagtcaggggctgggcatcccagcttgcccccgcttagccccgctgagcttggaggaagtatgagtgctgattcaaaccaaagctgcctgtgccatgcccaaggcctaggttatgggtacggcaaccacatgtcccagatcgtctccaattcgaaaacaaccgtcctgctgtccctgtcaggacacatggattttggcagggcggggggggttctagaaaatatagttcctataataaaatggcaccttccccctttcaagaagggtgattctggggccgactcagggtttaggtgccccctggtgtggcctagatgtccccacctgggccatctttctggggaggactctcccaggtagggaaggccagaggtggcccagtgcctggagggttagggtctctgcctgggatatgcaagaggaagtaggaaagggaggtctcatggatgatcctaggctgctagaagtccttaaggccccatctagtccattccactccctacccccattccagagccgagtagtaagtttacagatgtttcccccattacgtacccccacccatccctgctgcagcgagcctgagagccaggtagagccaggcacagctcctcagtcttctcacacagtcctgccggtggccttccctcatgacccttgcttgggagggtggagcactggctccttgaccctaaaaggtagctggcaggggcaagatgggggccagctacctaatggatgaaagccacaagtgaatacagttcttgtcaccagggttgccctgccctcactcggcagggagttctgacaccccagggcccgtgagctacctgcttgagcccctgtttctggggcaccttcgaggaggcgttgtggagggcatcgccccctgtttattcacaacaccctcaggggcaaacaggcctgggacccgctgacaccattttgggtagctggatgcacccgacagcagtggggtccacacactgagctccagctggcactgcccactcaagggctgagtggaggggcccctccggccagctctgctccaccagccctgcaagctgatgcagggcgggggaagggctgggtgttgcactattgctgcgctgccttaaggcatctgtcctctggtggtgcacccgtgcacacaggtacagtgcatctgggcacagcttttggatccacacctctgcacaagtgtgaatacctctgcacatatgggcgtatctgtgtgtgctcgtgtatatggggtggggaacatgagacttcctgtgaccagtccaccctg

SEQ ID NO: 104589 - DNA, 2529 bp, Homo sapiens
  Payload ID: 537
  Gene Symbol: ADAM11
  Gene Name: ADAM metallopeptidase domain 11
  ENST ID: ENST00000535346
  CDS Start-End: 699-2408
gctgctgcagccaccttttcctgcagtgctcggggtgacagccggtccggagcgcgggagggtaggggagcgggagaggagggaaggtgcgtccacccacctgtccccagctggccgggcccaccgcgtccctgcccctgccgccgaccggccagctctgcaggtcttgggacccaaggtcctgctggagctctgcgatgggggggcttaccccagctgggaggcccaggagcccctgaggtcacggaacccagccgtctggttagggagagctccgggggagaggtccgaaagcagcagctggacacaagggtccgccaggagccaccagggggcccgcctgtccatctggcccaggtgagtttcgtcatcccagccttcaactcaaacttcaccctggacctggagctgaaccaccacctcctctcctcgcaatacgtggagcgccacttcagccgggaggggacaacccagcacagcaccggggctggagaccactgctactaccaggggaagctccgggggaacccgcactccttcgccgccctctccacctgccaggggctgcatggggtcttctctgatgggaacttgacttacatcgtggagccccaagaggtggctggaccttggggagcccctcagggaccccttccccacctcatttaccggacccctctcctcccagatcccctcggatgcagggaaccaggctgcctgtttgctgtgcctgcccagtcggctcctccaaaccggccgaggctgagaaggaaaaggtccgccggggccaccctacagtgcacagtgaaaccaagtatgtggagctaattgtgatcaacgaccaccagctgttcgagcagatgcgacagtcggtggtcctcaccagcaactttgccaagtccgtggtgaacctggccgatgtgatatacaaggagcagctcaacactcgcatcgtcctggttgccatggaaacatgggcagatggggacaagatccaggtgcaggatgacctcctggagaccctggcccggctcatggtctaccgacgggagggtctgcctgagcccagtgatgccacccacctcttctcgggcaggaccttccagagcacgagcagcggggcagcctacgtggggggcatatgctccctgtcccacggcgggggtgtgaacgagtacggcaacatgggggcgatggccgtgacccttgcccagacgctgggacagaacctgggcatgatgtggaacaaacaccggagctcggcaggggactgcaagtgtccagacatctggctgggctgcatcatggaggacactgggttctacctgccccgcaagttctcgcgctgtagcatcgacgagtacaaccagtttctgcaggagggtggtggcagctgcctcttcaacaagcccctcaagctcctggaccccccagagtgcgggaacggcttcgtggaggcaggggaggagtgcgactgcggctcggtgcaggagtgcagccgcgcaggtggcaactgctgcaagaaatgcaccctgactcacgacgccatgtgcagcgacgggctctgctgtcgccgctgcaagtacgaaccacggggtgtgtcctgccgagaggccgtgaacgagtgcgacatcgcggagacctgcaccggggactctagccagtgcccgcctaacctgcacaagctggacggttactactgtgaccatgagcagggccgctgctacggaggtcgctgcaaaacccgggaccggcagtgccaggttctttggggccatgcggctgctgatcgcttctgctacgagaagctgaatgtggaggggacggagcgtgggagctgtgggcgcaagggatctggctgggtccagtgcagtaagcaggacgtgctgtgtggcttcctcctctgtgtcaacatctctggagctcctcggctaggggacctggtgggagacatcagtagtgtcaccttctaccaccagggcaaggagctggactgcaggggaggccacgtgcagctggcggacggctctgacctgagctatgtggaggatggcacagcctgcgggcctaacatgttgtgcctggaccatcgctgcctgccagcttctgccttcaacttcagcacctgccccggcagtggggagcgccggatttgctcccaccacggggtctgcagcaatgaagggaagtgcatctgtcagccagactggacaggcaaagactgcagtatccataaccccctgcccacgtccccacccacgggggagacggagagatataaaggtcccagcggcaccaacatcatcattggctccattgctggggctgtcctggttgcagccatcgtcctgggcggcacgggctggggatttaaaaacattcgccgaggaaggtccggaggggcctaagtgccaccctcctccctccaagcctggcacccaccgtctcggccctgaaccacgaggctgcccccatccagccacggagggaggcaccatgcaaatgtcttccaggtccaaacccttcaac

SEQ ID NO: 104590 - DNA, 2858 bp, Homo sapiens
  Payload ID: 537
  Gene Symbol: ADAM11
  Gene Name: ADAM metallopeptidase domain 11
  ENST ID: ENST00000587773
  CDS Start-End: 1-1554
ctcctctcctcgcaatacgtggagcgccacttcagccgggaggggacaacccagcacagcaccggggctggagaccactgctactaccaggggaagctccgggggaacccgcactccttcgccgccctctccacctgccaggggctgcatggggtcttctctgatgggaacttgacttacatcgtggagccccaagaggtggctggaccttggggagcccctcagggaccccttccccacctcatttaccggacccctctcctcccagatcccctcggatgcagggaaccaggctgcctgtttgctgtgcctgcccagtcggctcctccaaaccggccgaggctgagaaggaaaaggcaggtccgccggggccaccctacagtgcacagtgaaaccaagtatgtggagctaattgtgatcaacgaccaccagctgttcgagcagatgcgacagtcggtggtcctcaccagcaactttgccaagtccgtggtgaacctggccgatgtgatatacaaggagcagctcaacactcgcatcgtcctggttgccatggaaacatgggcagatggggacaagatccaggtgcaggatgacctcctggagaccctggcccggctcatggtctaccgacgggagggtctgcctgagcccagtgatgccacccacctcttctcgggcaggaccttccagagcacgagcagcggggcagcctacgtggggggcatatgctccctgtcccacggcgggggtgtgaacgagtacggcaacatgggggcgatggccgtgacccttgcccagacgctgggacagaacctgggcatgatgtggaacaaacaccggagctcggcaggggactgcaagtgtccagacatctggctgggctgcatcatggaggacactgggttctacctgccccgcaagttctcgcgctgtagcatcgacgagtacaaccagtttctgcaggagggtggtggcagctgcctcttcaacaagcccctcaagctcctggaccccccagagtgcgggaacggcttcgtggaggcaggggaggagtgcgactgcggctcggtgcaggagtgcagccgcgcaggtggcaactgctgcaagaaatgcaccctgactcacgacgccatgtgcagcgacgggctctgctgtcgccgctgcaagtacgaaccacggggtgtgtcctgccgagaggccgtgaacgagtgcgacatcgcggagacctgcaccggggactctagccagtgcccgcctaacctgcacaagctggacggttactactgtgaccatgagcagggccgctgctacggaggtcgctgcaaaacccgggaccggcagtgccaggttctttggggccatgcggctgctgatcgcttctgctacgagaagctgaatgtggaggggacggagcgtgggagctgtgggcgcaagggatctggctgggtccagtgcagtaagcagccccaacagggacgtgctgtgtggcttcctcctctgtgtcaacatctctggagctcctcggctaggggacctggtgggagacatcagtagtgtcaccttctaccaccagggcaaggagctggactgcaggggaggccacgtgcagctggcggacggctctgacctgagctatgtggaggatggcacagcctgcgggcctaacatgttgtgcctggaccatcgctgcctgccagcttctgccttcaacttcagcacctgccccggcagtggggagcgccggatttgctcccaccacggggtctgcagcaatgaagggaagtgcatctgtcagccagactggacaggcaaagactgcagtatccataaccccctgcccacgtccccacccacgggggagacggagagatataaaggtcccagcggcaccaacatcatcattggctccattgctggggctgtcctggttgcagccatcgtcctgggcggcacgggctggggatttaaaaacattcgccgaggaaggtccggaggggcctaagtgccaccctcctccctccaagcctggcacccaccgtctcggccctgaaccacgaggctgcccccatccagccacggagggaggcaccatgcaaatgtcttccaggtccaaacccttcaactcctggctccgcaggggtttgggtgggggctgtggccctgcccttggcaccaccagggtggaccaggcctggagggcacttcctccacagtcccccacccacctcctgcggctcagccttgcacacccactgccccgtgtgaatgtagcttccacctcatggattgccacagctcaactcgggggcgcctggagggatgcccccaggcagccaccagtggacctagcctggatggcccctccttgcaaccaggcagctgagaccagggtcttacctctctgggacctagggggacggggctgacatctacattttttaaaactgaatcttaatcgatgaatgtaaactcgggggtgctggggccagggcagatgtggggatgttttgacatttacaggagggcccggagaaactgaggtatggccatgccctagaccctccccaaggatgaccacacccgaagtcctgtcactgagcacagtcaggggctgggcatcccagcttgcccccgcttagccccgctgagcttggaggaagtatgagtgctgattcaaaccaaagctgcctgtgccatgcccaaggcctaggttatgggtacggcaaccacatgtcccagatcgtctccaattcgaaaacaaccgtcctgctgtccctgtcaggacacatggattttggcagggcggggggggttctagaaaatatagttcctataataaaatggcaccttcccccttt

SEQ ID NO: 104591 - DNA, 3313 bp, Homo sapiens
  Payload ID: 538
  Gene Symbol: ADAM12
  Gene Name: ADAM metallopeptidase domain 12
  Uniprot ID: O43184
  ENST ID: ENST00000368676
  CDS Start-End: 311-2527
cactaacgctcttcctagtccccgggccaactcggacagtttgctcatttattgcaacggtcaaggctggcttgtgccagaacggcgcgcgcgcgcgcacgcacgcacacacacggggggaaacttttttaaaaatgaaaggctagaagagctcagcggcggcgcgggcgctgcgcgagggctccggagctgactcgccgaggcaggaaatccctccggtcgcgacgcccggccccggctcggcgcccgcgtgggatggtgcagcgctcgccgccgggcccgagagctgctgcactgaaggccggcgacgatggcagcgcgcccgctgcccgtgtcccccgcccgcgccctcctgctcgccctggccggtgctctgctcgcgccctgcgaggcccgaggggtgagcttatggaaccaaggaagagctgatgaagttgtcagtgcctctgttgggagtggggacctctggatcccagtgaagagcttcgactccaagaatcatccagaagtgctgaatattcgactacaacgggaaagcaaagaactgatcataaatctggaaagaaatgaaggtctcattgccagcagtttcacggaaacccactatctgcaagacggtactgatgtctccctcgctcgaaattacacggtaattctgggtcactgttactaccatggacatgtacggggatattctgattcagcagtcagtctcagcacgtgttctggtctcaggggacttattgtgtttgaaaatgaaagctatgtcttagaaccaatgaaaagtgcaaccaacagatacaaactcttcccagcgaagaagctgaaaagcgtccggggatcatgtggatcacatcacaacacaccaaacctcgctgcaaagaatgtgtttccaccaccctctcagacatgggcaagaaggcataaaagagagaccctcaaggcaactaagtatgtggagctggtgatcgtggcagacaaccgagagtttcagaggcaaggaaaagatctggaaaaagttaagcagcgattaatagagattgctaatcacgttgacaagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcagtggggtttatttccaagggaccaccatcggcatggccccaatcatgagcatgtgcacggcagaccagtctgggggaattgtcatggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagaagcaaggcaggaagctgcagagtccaacagggagcgcggccagggccaggagcccgtgggatcgcaggagcatgcgtctactgcctcactgacactcatctgagccctcccatgacatggagaccgtgaccagtgctgctgcagaggaggtcacgcgtccccaaggcctcctgtgactggcagcattgactctgtggctttgccatcgtttccatgacaacagacacaacacagttctcggggctcaggaggggaagtccagcctaccaggcacgtctgcagaaacagtgcaaggaagggcagcgacttcctggttgagcttctgctaaaacatggacatgcttcagtgctgctcctgagagagtagcaggttaccactctggcaggccccagccctgcagcaaggaggaagaggactcaaaagtctggcctttcactgagcctccacagcagtgggggagaagcaagggttgggcccagtgtcccctttccccagtgacacctcagccttggcagccctgatgactggtctctggctgcaacttaatgctctgatatggcttttagcatttattatatgaaaatagcagggttttagtttttaatttatcagagaccctgccacccattccatctccatccaagcaaactgaatggcaatgaaacaaactggagaagaaggtaggagaaagggcggtgaactctggctctttgctgtggacatgcgtgaccagcagtactcaggtttgagggtttgcagaaagccagggaacccacagagtcaccaacccttcatttaacaagtaagaatgttaaaaagtgaaaacaatgtaagagcctaactccatcccccgtggccattactgcataaaatagagtgcatttgaaa

SEQ ID NO: 104592 - DNA, 7938 bp, Homo sapiens
  Payload ID: 538
  Gene Symbol: ADAM12
  Gene Name: ADAM metallopeptidase domain 12
  Uniprot ID: O43184
  ENST ID: ENST00000368679
  CDS Start-End: 311-3040
cactaacgctcttcctagtccccgggccaactcggacagtttgctcatttattgcaacggtcaaggctggcttgtgccagaacggcgcgcgcgcgcgcacgcacgcacacacacggggggaaacttttttaaaaatgaaaggctagaagagctcagcggcggcgcgggcgctgcgcgagggctccggagctgactcgccgaggcaggaaatccctccggtcgcgacgcccggccccggctcggcgcccgcgtgggatggtgcagcgctcgccgccgggcccgagagctgctgcactgaaggccggcgacgatggcagcgcgcccgctgcccgtgtcccccgcccgcgccctcctgctcgccctggccggtgctctgctcgcgccctgcgaggcccgaggggtgagcttatggaaccaaggaagagctgatgaagttgtcagtgcctctgttgggagtggggacctctggatcccagtgaagagcttcgactccaagaatcatccagaagtgctgaatattcgactacaacgggaaagcaaagaactgatcataaatctggaaagaaatgaaggtctcattgccagcagtttcacggaaacccactatctgcaagacggtactgatgtctccctcgctcgaaattacacggtaattctgggtcactgttactaccatggacatgtacggggatattctgattcagcagtcagtctcagcacgtgttctggtctcaggggacttattgtgtttgaaaatgaaagctatgtcttagaaccaatgaaaagtgcaaccaacagatacaaactcttcccagcgaagaagctgaaaagcgtccggggatcatgtggatcacatcacaacacaccaaacctcgctgcaaagaatgtgtttccaccaccctctcagacatgggcaagaaggcataaaagagagaccctcaaggcaactaagtatgtggagctggtgatcgtggcagacaaccgagagtttcagaggcaaggaaaagatctggaaaaagttaagcagcgattaatagagattgctaatcacgttgacaagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcagtggggtttatttccaagggaccaccatcggcatggccccaatcatgagcatgtgcacggcagaccagtctgggggaattgtcatggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagataaccaaggtttaaccataggaattctggtgaccatcctgtgtcttcttgctgccggatttgtggtttatctcaaaaggaagaccttgatacgactgctgtttacaaataagaagaccaccattgaaaaactaaggtgtgtgcgcccttcccggccaccccgtggcttccaaccctgtcaggctcacctcggccaccttggaaaaggcctgatgaggaagccgccagattcctacccaccgaaggacaatcccaggagattgctgcagtgtcagaatgttgacatcagcagacccctcaacggcctgaatgtccctcagccccagtcaactcagcgagtgcttcctcccctccaccgggctccacgtgcacctagcgtccctgccagacccctgccagccaagcctgcacttaggcaggcccaggggacctgtaagccaaacccccctcagaagcctctgcctgcagatcctctggccagaacaactcggctcactcatgccttggccaggaccccaggacaatgggagactgggctccgcctggcacccctcagacctgctccacaatatccacaccaagtgcccagatccacccacaccgcctatattaagtgagaagccgacaccttttttcaacagtgaagacagaagtttgcactatctttcagctccagttggagttttttgtaccaacttttaggattttttttaatgtttaaaacatcattactataagaactttgagctactgccgtcagtgctgtgctgtgctatggtgctctgtctacttgctcaggtacttgtaaattattaatttatgcagaatgttgattacagtgcagtgcgctgtagtaggcatttttaccatcactgagttttccatggcaggaaggcttgttgtgcttttagtattttagtgaacttgaaatatcctgcttgatgggattctggacaggatgtgtttgctttctgatcaaggccttattggaaagcagtcccccaactacccccagctgtgcttatggtaccagatgcagctcaagagatcccaagtagaatctcagttgattttctggattccccatctcaggccagagccaaggggcttcaggtccaggctgtgtttggctttcagggaggccctgtgccccttgacaactggcaggcaggctcccagggacacctgggagaaatctggcttctggccaggaagctttggtgagaacctgggttgcagacaggaatcttaaggtgtagccacaccaggatagagactggaacactagacaagccagaacttgaccctgagctgaccagccgtgagcatgtttggaaggggtctgtagtgtcactcaaggcggtgcttgatagaaatgccaagcacttctttttctcgctgtcctttctagagcactgccaccagtaggttatttagcttgggaaaggtggtgtttctgtaagaaacctactgcccaggcactgcaaaccgccacctccctatactgcttggagctgagcaaatcaccacaaactgtaatacaatgatcctgtattcagacagatgaggctttccatgggaccacaactattttcagatgtgaaccattaaccagatctagtcaatcaagtctgtttactgcaaggttcaacttattaacaattaggcagactctttatgcttgcaaaaactacaaccaatggaatgtgatgttcatgggtatagttcatgtctgctatcattattcgtagatattggacaaagaaccttctctatggggcatcctctttttccaacttggctgcaggaatctttaaaagatgcttttaacagagtctgaacctatttcttaaacacttgcaacctacctgttgagcatcacagaatgtgataaggaaatcaacttgcttatcaacttcctaaatattatgagatgctggcttgggcagcatccccttgaactcttcactcttcaaatgcctgactagggagccatgtttcacaaggtctttaaagtgactaatggcatgagaaatacaaaaatactcagataaggtaaaatgccatgatgcctctgtcttctggactggttttcacattagaagacaattgacaacagttacataattcactctgagtgttttatgagaaagccttcttttgggggtcaacagttttcctatgctttgaaacagaaaaatatgtaccaagaatcttggtttgccttccagaaaacaaaactgcatttcactttcccggtgttccccactgtatctaggcaacatagtattcatgactatggataaactaaacacgtgacacaaacacacacaaaagggaacccagctctaatacattccaactcgtatagcatgcatctgtttattctatagttattaagttctttaaaatgtaaagccatgctggaaaataatactgctgagatacatacagaattactgtaactgattacacttggtaattgtactaaagccaaacatatatatactattaaaaaggtttacagaattttatggtgcattacgtgggcattgtctttttagatgcccaaatccttagatctggcatgttagcccttcctccaattataagaggatatgaactgagtttttcttttgttgtttgttcttagctgtaattcctatgcttctatttcagagagccaggagagtttgatattaaaggaggttaaaactgtgatcttatgccatgtcatcaatggccacttaggggccatggctgatgacacattcttatctctacagtactaatgtgttattatagagccatgcattttatttctgaataagaacatatttaaactaatattcccttacaatatggacagtattaatccttccaagatgcagtatttatcaagtgaagcatatttagcagcaaattccattttaacataacttaggaaccaataaccagggtgttttgtggttgggggaggcacggggtggagtattcttttttatatcctcaaaacaaaaaaaatcaatacttatatttcaatggcaatctagtatttttttaaaagactgtataggcatgaataatagaggtggtttgagttttgtagggccatcacctggaaagtcaatgtgactagacacaaagtagcccagaggctacttttcttcctacagcttattatagttgtaggttctatgacctcacttcatgggttccaggcaattccgctgaaaggtttgtctcctgaaattttttaagtttgttttcctgacacatgtaatcagatgtgtagcaaccgagggaaacgaagcctaacattctccattgtggaaatacacacaggaggttacatttcacagcgtggatttttccagcttacacatgtgggatgacatcacagaaaccacaaaagcagcaaattaaactgtaggagagtcaatactcctgacgagtctcggggggggggcatttttatgccttcttaactttatgagaattctcaggctgaactataggccattgttcccaggcaaatcaatacatcaatgcatcctcaaaaaaaaaaaaaaaaaaaaaaaaccggctaaaactgtgtcaaaatgttcttaaggagcctatggtctccacggtgctaaaaagagcctggtgctgggccgactggcagggctgagcatcctcctgccccctcgccactgatgtttactaagcactctgagccaatgagacccccagcagcagaaagggcacaaggtggcgccagggcagcagggccagatctttctcatgcacctcgacctcttgcagactttcttcgtgagatgtactactcatttcaaaactgctttgcagggctcccctatgtattcggggggcccacggcacactcaggctggagatccttcctcactgcgctcaagatggcctcagccagacaccagttacccagctgaaagtcacaatccctcccagaagtctcccaacactagtgctgaccagaggtggggctctcaggctaggagtttcacacacaatgacaggctgctgggggacattgcaggaccccttttcctctcctctccatgctagaagccagccctaggcagctgcagttactccctgtgactcagcagcaggctgattcaacacagctgcccacacaaagccagtggctaatacatctgtttacctttccctatcacccagacacaagcccctttcccaggtcaaaccacaggccgatgcatctccagtttgacagtcaaatcactacttccattgctactttagatcagccaaagtggtgactgctgcagtgtgtggctatccctacaaggcccacccaagggatgcccaaagcccaaccttctccagggctgcagcccagagcaaccccaccagcctaagtccagcagaggacctcccacccaatgtcttgttctaattagaaggggaagttagccacagaaaatcaacttatctataattacaaaattctcttgactcaccttaaagttcctattgacatctactgcttttaaacctatttgaaaactctgatactaaaacaaatgacactctaagaaagtttgggagccccatgctgagaaccatttctgtgcagtgaggatgtttccagaagctacttacctacatgtgaatgtgccattttctttccttttgtagagaaaatcccctttactttttggaacagtaatggcagcttctagtacagccattacagtttcatatgagaaaaattaagaataactataaaattgttaaaatatccaataatggataatgatggccagaagatttaacatacaaagtaattctcaatgtaaagctattcagctcttccaggttgaatgccctgtaacccaccctgaccttccacatcatcttcaaaaagcagtttctctgttccccatgattctcctataaggtaactctttagtcctccatttagcacattttaaatcctccaaagaataagtatcatgtgattattttagctttacaaaaaaaaagttgaatggcgttttattttcatggcctataagcaggtaccttagtagggcagatataggaaaaacaaattagagcaaaacaaatcctctacaaatccaaggcaggaaaagtggtggcagagtgactcattctcctgtccctcccatcaggtcaaatcaggaggctgcagtgaatgcctgttctttgaatgtgtagcagttgttcctgtaactctttaaaacttggctataggctgtttagcacagtacagattaaagatacagttacgtaaacagcaaagtaattttatagtgcttcatccatttatcatgctttggtttgctaattttttcacatacctttttctatcacagtctgttgcttttgtacacatttctcatattggggttcgacaggtaaacacaaactgctatttcagtagaaaaagttattgttatgaatattaaacccaataaattgtataaaggtaaatatcaatgtg

SEQ ID NO: 104593 - DNA, 1145 bp, Homo sapiens
  Payload ID: 538
  Gene Symbol: ADAM12
  Gene Name: ADAM metallopeptidase domain 12
  ENST ID: ENST00000448723
  CDS Start-End: 311-1145
cactaacgctcttcctagtccccgggccaactcggacagtttgctcatttattgcaacggtcaaggctggcttgtgccagaacggcgcgcgcgcgcgcacgcacgcacacacacggggggaaacttttttaaaaatgaaaggctagaagagctcagcggcggcgcgggcgctgcgcgagggctccggagctgactcgccgaggcaggaaatccctccggtcgcgacgcccggccccggctcggcgcccgcgtgggatggtgcagcgctcgccgccgggcccgagagctgctgcactgaaggccggcgacgatggcagcgcgcccgctgcccgtgtcccccgcccgcgccctcctgctcgccctggccggtgctctgctcgcgccctgcgaggcccgaggggtgagcttatggaaccaaggaagagctgatgaagttgtcagtgcctctgttgggagtggggacctctggatcccagtgaagagcttcgactccaagaatcatccagaagtgctgaatattcgactacaacgggaaagcaaagaactgatcataaatctggaaagaaatgaaggtctcattgccagcagtttcacggaaacccactatctgcaagacggtactgatgtctccctcgctcgaaattacacgggtcactgttactaccatggacatgtacggggatattctgattcagcagtcagtctcagcacgtgttctggtctcaggggacttattgtgtttgaaaatgaaagctatgtcttagaaccaatgaaaagtgcaaccaacagatacaaactcttcccagcgaagaagctgaaaagcgtccggggatcatgtggatcacatcacaacacaccaaacctcgctgcaaagaatgtgtttccaccaccctctcagacatgggcaagaaggcataaaagagagaccctcaaggcaactaagtatgtggagctggtgatcgtggcagacaaccgagagtttcagaggcaaggaaaagatctggaaaaagttaagcagcgattaatagagattgctaatcacgttgacaagttttacagaccactgaacattcggatcgtgttggtaggcgtggaagtgtggaatgacatggacaaatgctctgtaagtcaggacccattcacca

SEQ ID NO: 104594 - DNA, 2799 bp, Homo sapiens
  Payload ID: 539
  Gene Symbol: ADAM15
  Gene Name: ADAM metallopeptidase domain 15
  Uniprot ID: Q13444
  ENST ID: ENST00000271836
  CDS Start-End: 82-2526
ccgaggcgacctggccgccggccgctcctccgcgcgctgttccgcacttgctgccctcgcccggcccggagcgccgctgccatgcggctggcgctgctctgggccctggggctcctgggcgcgggcagccctctgccttcctggccgctcccaaatataggtggcactgaggagcagcaggcagagtcagagaaggccccgagggagcccttggagccccaggtccttcaggacgatctcccaattagcctcaaaaaggtgcttcagaccagtctgcctgagcccctgaggatcaagttggagctggacggtgacagtcatatcctggagctgctacagaatagggagttggtcccaggccgcccaaccctggtgtggtaccagcccgatggcactcgggtggtcagtgagggacacactttggagaactgctgctaccagggaagagtgcggggatatgcaggctcctgggtgtccatctgcacctgctctgggctcagaggcttggtggtcctgaccccagagagaagctataccctggagcaggggcctggggaccttcagggtcctcccattatttcgcgaatccaagatctccacctgccaggccacacctgtgccctgagctggcgggaatctgtacacactcagaagccaccagagcaccccctgggacagcgccacattcgccggaggcgggatgtggtaacagagaccaagactgtggagttggtgattgtggctgatcactcggaggcccagaaataccgggacttccagcacctgctaaaccgcacactggaagtggccctcttgctggacacattcttccggcccctgaatgtacgagtggcactagtgggcctggaggcctggacccagcgtgacctggtggagatcagcccaaacccagctgtcaccctcgaaaacttcctccactggcgcagggcacatttgctgcctcgattgccccatgacagtgcccagctggtgactggtacttcattctctgggcctacggtgggcatggccattcagaactccatctgttctcctgacttctcaggaggtgtgaacatggaccactccaccagcatcctgggagtcgcctcctccatagcccatgagttgggccacagcctgggcctggaccatgatttgcctgggaatagctgcccctgtccaggtccagccccagccaagacctgcatcatggaggcctccacagacttcctaccaggcctgaacttcagcaactgcagccgacgggccctggagaaagccctcctggatggaatgggcagctgcctcttcgaacggctgcctagcctaccccctatggctgctttctgcggaaatatgtttgtggagccgggcgagcagtgtgactgtggcttcctggatgactgcgtcgatccctgctgtgattctttgacctgccagctgaggccaggtgcacagtgtgcatctgacggaccctgttgtcaaaattgccagctgcgcccgtctggctggcagtgtcgtcctaccagaggggattgtgacttgcctgaattctgcccaggagacagctcccagtgtccccctgatgtcagcctaggggatggcgagccctgcgctggcgggcaagctgtgtgcatgcacgggcgttgtgcctcctatgcccagcagtgccagtcactttggggacctggagcccagcccgctgcgccactttgcctccagacagctaatactcggggaaatgcttttgggagctgtgggcgcaaccccagtggcagttatgtgtcctgcacccctagagatgccatttgtgggcagctccagtgccagacaggtaggacccagcctctgctgggctccatccgggatctactctgggagacaatagatgtgaatgggactgagctgaactgcagctgggtgcacctggacctgggcagtgatgtggcccagcccctcctgactctgcctggcacagcctgtggccctggcctggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagggcagcccaatctggtccctctgaacggccaggacctccgcagagggccctgctggcacgaggcactaagtctcaggggccagccaagcccccacccccaaggaagccactgcctgccgacccccagggccggtgcccatcgggtgacctgcccggcccaggggctggaatcccgcccctagtggtaccctccagaccagcgccaccgcctccgacagtgtcctcgctctacctctgacctctccggaggttccgctgcctccaagccggacttagggcttcaagaggcgggcgtgccctctggagtcccctaccatgactgaaggcgccagagactggcggtgtcttaagactccgggcaccgccacgcgctgtcaagcaacactctgcggacctgccggcgtagttgcagcgggggcttggggaggggctgggggttggacgggattgaggaaggtccgcacagcctgtctctgctcagttgcaataaacgtgacatcttgggagcgtt

SEQ ID NO: 104595 - DNA, 2877 bp, Homo sapiens
  Payload ID: 539
  Gene Symbol: ADAM15
  Gene Name: ADAM metallopeptidase domain 15
  Uniprot ID: Q13444
  ENST ID: ENST00000355956
  CDS Start-End: 102-2621
gcgcggcgctgctgggttctccgaggcgacctggccgccggccgctcctccgcgcgctgttccgcacttgctgccctcgcccggcccggagcgccgctgccatgcggctggcgctgctctgggccctggggctcctgggcgcgggcagccctctgccttcctggccgctcccaaatataggtggcactgaggagcagcaggcagagtcagagaaggccccgagggagcccttggagccccaggtccttcaggacgatctcccaattagcctcaaaaaggtgcttcagaccagtctgcctgagcccctgaggatcaagttggagctggacggtgacagtcatatcctggagctgctacagaatagggagttggtcccaggccgcccaaccctggtgtggtaccagcccgatggcactcgggtggtcagtgagggacacactttggagaactgctgctaccagggaagagtgcggggatatgcaggctcctgggtgtccatctgcacctgctctgggctcagaggcttggtggtcctgaccccagagagaagctataccctggagcaggggcctggggaccttcagggtcctcccattatttcgcgaatccaagatctccacctgccaggccacacctgtgccctgagctggcgggaatctgtacacactcagaagccaccagagcaccccctgggacagcgccacattcgccggaggcgggatgtggtaacagagaccaagactgtggagttggtgattgtggctgatcactcggaggcccagaaataccgggacttccagcacctgctaaaccgcacactggaagtggccctcttgctggacacattcttccggcccctgaatgtacgagtggcactagtgggcctggaggcctggacccagcgtgacctggtggagatcagcccaaacccagctgtcaccctcgaaaacttcctccactggcgcagggcacatttgctgcctcgattgccccatgacagtgcccagctggtgactggtacttcattctctgggcctacggtgggcatggccattcagaactccatctgttctcctgacttctcaggaggtgtgaacatggaccactccaccagcatcctgggagtcgcctcctccatagcccatgagttgggccacagcctgggcctggaccatgatttgcctgggaatagctgcccctgtccaggtccagccccagccaagacctgcatcatggaggcctccacagacttcctaccaggcctgaacttcagcaactgcagccgacgggccctggagaaagccctcctggatggaatgggcagctgcctcttcgaacggctgcctagcctaccccctatggctgctttctgcggaaatatgtttgtggagccgggcgagcagtgtgactgtggcttcctggatgactgcgtcgatccctgctgtgattctttgacctgccagctgaggccaggtgcacagtgtgcatctgacggaccctgttgtcaaaattgccagctgcgcccgtctggctggcagtgtcgtcctaccagaggggattgtgacttgcctgaattctgcccaggagacagctcccagtgtccccctgatgtcagcctaggggatggcgagccctgcgctggcgggcaagctgtgtgcatgcacgggcgttgtgcctcctatgcccagcagtgccagtcactttggggacctggagcccagcccgctgcgccactttgcctccagacagctaatactcggggaaatgcttttgggagctgtgggcgcaaccccagtggcagttatgtgtcctgcacccctagagatgccatttgtgggcagctccagtgccagacaggtaggacccagcctctgctgggctccatccgggatctactctgggagacaatagatgtgaatgggactgagctgaactgcagctgggtgcacctggacctgggcagtgatgtggcccagcccctcctgactctgcctggcacagcctgtggccctggcctggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagggcagcccaatctggtccctctgaacggccaggacctccgcagagggccctgctggcacgaggcactaagcaggctagtgctctcagcttcccggcccccccttccaggccgctgccgcctgaccctgtgtccaagagactccagtctcaggggccagccaagcccccacccccaaggaagccactgcctgccgacccccagggccggtgcccatcgggtgacctgcccggcccaggggctggaatcccgcccctagtggtaccctccagaccagcgccaccgcctccgacagtgtcctcgctctacctctgacctctccggaggttccgctgcctccaagccggacttagggcttcaagaggcgggcgtgccctctggagtcccctaccatgactgaaggcgccagagactggcggtgtcttaagactccgggcaccgccacgcgctgtcaagcaacactctgcggacctgccggcgtagttgcagcgggggcttggggaggggctgggggttggacgggattgaggaaggtccgcacagcctgtctctgctcagttgcaataaacgt

SEQ ID NO: 104596 - DNA, 2949 bp, Homo sapiens
  Payload ID: 539
  Gene Symbol: ADAM15
  Gene Name: ADAM metallopeptidase domain 15
  Uniprot ID: Q13444
  ENST ID: ENST00000356955
  CDS Start-End: 102-2693
gcgcggcgctgctgggttctccgaggcgacctggccgccggccgctcctccgcgcgctgttccgcacttgctgccctcgcccggcccggagcgccgctgccatgcggctggcgctgctctgggccctggggctcctgggcgcgggcagccctctgccttcctggccgctcccaaatataggtggcactgaggagcagcaggcagagtcagagaaggccccgagggagcccttggagccccaggtccttcaggacgatctcccaattagcctcaaaaaggtgcttcagaccagtctgcctgagcccctgaggatcaagttggagctggacggtgacagtcatatcctggagctgctacagaatagggagttggtcccaggccgcccaaccctggtgtggtaccagcccgatggcactcgggtggtcagtgagggacacactttggagaactgctgctaccagggaagagtgcggggatatgcaggctcctgggtgtccatctgcacctgctctgggctcagaggcttggtggtcctgaccccagagagaagctataccctggagcaggggcctggggaccttcagggtcctcccattatttcgcgaatccaagatctccacctgccaggccacacctgtgccctgagctggcgggaatctgtacacactcagaagccaccagagcaccccctgggacagcgccacattcgccggaggcgggatgtggtaacagagaccaagactgtggagttggtgattgtggctgatcactcggaggcccagaaataccgggacttccagcacctgctaaaccgcacactggaagtggccctcttgctggacacattcttccggcccctgaatgtacgagtggcactagtgggcctggaggcctggacccagcgtgacctggtggagatcagcccaaacccagctgtcaccctcgaaaacttcctccactggcgcagggcacatttgctgcctcgattgccccatgacagtgcccagctggtgactggtacttcattctctgggcctacggtgggcatggccattcagaactccatctgttctcctgacttctcaggaggtgtgaacatggaccactccaccagcatcctgggagtcgcctcctccatagcccatgagttgggccacagcctgggcctggaccatgatttgcctgggaatagctgcccctgtccaggtccagccccagccaagacctgcatcatggaggcctccacagacttcctaccaggcctgaacttcagcaactgcagccgacgggccctggagaaagccctcctggatggaatgggcagctgcctcttcgaacggctgcctagcctaccccctatggctgctttctgcggaaatatgtttgtggagccgggcgagcagtgtgactgtggcttcctggatgactgcgtcgatccctgctgtgattctttgacctgccagctgaggccaggtgcacagtgtgcatctgacggaccctgttgtcaaaattgccagctgcgcccgtctggctggcagtgtcgtcctaccagaggggattgtgacttgcctgaattctgcccaggagacagctcccagtgtccccctgatgtcagcctaggggatggcgagccctgcgctggcgggcaagctgtgtgcatgcacgggcgttgtgcctcctatgcccagcagtgccagtcactttggggacctggagcccagcccgctgcgccactttgcctccagacagctaatactcggggaaatgcttttgggagctgtgggcgcaaccccagtggcagttatgtgtcctgcacccctagagatgccatttgtgggcagctccagtgccagacaggtaggacccagcctctgctgggctccatccgggatctactctgggagacaatagatgtgaatgggactgagctgaactgcagctgggtgcacctggacctgggcagtgatgtggcccagcccctcctgactctgcctggcacagcctgtggccctggcctggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagggcagcccaatctggtccctctgaacggccaggacctccgcagagggccctgctggcacgaggcactaagcaggctagtgctctcagcttcccggcccccccttccaggccgctgccgcctgaccctgtgtccaagagactccaggctgagctggctgaccgacccaatccccctacccgccctctgcccgctgacccggtggtgagaagcccgaagtctcaggggccagccaagcccccacccccaaggaagccactgcctgccgacccccagggccggtgcccatcgggtgacctgcccggcccaggggctggaatcccgcccctagtggtaccctccagaccagcgccaccgcctccgacagtgtcctcgctctacctctgacctctccggaggttccgctgcctccaagccggacttagggcttcaagaggcgggcgtgccctctggagtcccctaccatgactgaaggcgccagagactggcggtgtcttaagactccgggcaccgccacgcgctgtcaagcaacactctgcggacctgccggcgtagttgcagcgggggcttggggaggggctgggggttggacgggattgaggaaggtccgcacagcctgtctctgctcagttgcaataaacgt

SEQ ID NO: 104597 - DNA, 2874 bp, Homo sapiens
  Payload ID: 539
  Gene Symbol: ADAM15
  Gene Name: ADAM metallopeptidase domain 15
  Uniprot ID: Q13444
  ENST ID: ENST00000359280
  CDS Start-End: 102-2618
gcgcggcgctgctgggttctccgaggcgacctggccgccggccgctcctccgcgcgctgttccgcacttgctgccctcgcccggcccggagcgccgctgccatgcggctggcgctgctctgggccctggggctcctgggcgcgggcagccctctgccttcctggccgctcccaaatataggtggcactgaggagcagcaggcagagtcagagaaggccccgagggagcccttggagccccaggtccttcaggacgatctcccaattagcctcaaaaaggtgcttcagaccagtctgcctgagcccctgaggatcaagttggagctggacggtgacagtcatatcctggagctgctacagaatagggagttggtcccaggccgcccaaccctggtgtggtaccagcccgatggcactcgggtggtcagtgagggacacactttggagaactgctgctaccagggaagagtgcggggatatgcaggctcctgggtgtccatctgcacctgctctgggctcagaggcttggtggtcctgaccccagagagaagctataccctggagcaggggcctggggaccttcagggtcctcccattatttcgcgaatccaagatctccacctgccaggccacacctgtgccctgagctggcgggaatctgtacacactcagaagccaccagagcaccccctgggacagcgccacattcgccggaggcgggatgtggtaacagagaccaagactgtggagttggtgattgtggctgatcactcggaggcccagaaataccgggacttccagcacctgctaaaccgcacactggaagtggccctcttgctggacacattcttccggcccctgaatgtacgagtggcactagtgggcctggaggcctggacccagcgtgacctggtggagatcagcccaaacccagctgtcaccctcgaaaacttcctccactggcgcagggcacatttgctgcctcgattgccccatgacagtgcccagctggtgactggtacttcattctctgggcctacggtgggcatggccattcagaactccatctgttctcctgacttctcaggaggtgtgaacatggaccactccaccagcatcctgggagtcgcctcctccatagcccatgagttgggccacagcctgggcctggaccatgatttgcctgggaatagctgcccctgtccaggtccagccccagccaagacctgcatcatggaggcctccacagacttcctaccaggcctgaacttcagcaactgcagccgacgggccctggagaaagccctcctggatggaatgggcagctgcctcttcgaacggctgcctagcctaccccctatggctgctttctgcggaaatatgtttgtggagccgggcgagcagtgtgactgtggcttcctggatgactgcgtcgatccctgctgtgattctttgacctgccagctgaggccaggtgcacagtgtgcatctgacggaccctgttgtcaaaattgccagctgcgcccgtctggctggcagtgtcgtcctaccagaggggattgtgacttgcctgaattctgcccaggagacagctcccagtgtccccctgatgtcagcctaggggatggcgagccctgcgctggcgggcaagctgtgtgcatgcacgggcgttgtgcctcctatgcccagcagtgccagtcactttggggacctggagcccagcccgctgcgccactttgcctccagacagctaatactcggggaaatgcttttgggagctgtgggcgcaaccccagtggcagttatgtgtcctgcacccctagagatgccatttgtgggcagctccagtgccagacaggtaggacccagcctctgctgggctccatccgggatctactctgggagacaatagatgtgaatgggactgagctgaactgcagctgggtgcacctggacctgggcagtgatgtggcccagcccctcctgactctgcctggcacagcctgtggccctggcctggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagggcagcccaatctggtccctctgaacggccaggacctccgcagagggccctgctggcacgaggcactaaggctgagctggctgaccgacccaatccccctacccgccctctgcccgctgacccggtggtgagaagcccgaagtctcaggggccagccaagcccccacccccaaggaagccactgcctgccgacccccagggccggtgcccatcgggtgacctgcccggcccaggggctggaatcccgcccctagtggtaccctccagaccagcgccaccgcctccgacagtgtcctcgctctacctctgacctctccggaggttccgctgcctccaagccggacttagggcttcaagaggcgggcgtgccctctggagtcccctaccatgactgaaggcgccagagactggcggtgtcttaagactccgggcaccgccacgcgctgtcaagcaacactctgcggacctgccggcgtagttgcagcgggggcttggggaggggctgggggttggacgggattgaggaaggtccgcacagcctgtctctgctcagttgcaataaacgt

SEQ ID NO: 104598 - DNA, 2732 bp, Homo sapiens
  Payload ID: 539
  Gene Symbol: ADAM15
  Gene Name: ADAM metallopeptidase domain 15
  Uniprot ID: Q13444
  ENST ID: ENST00000360674
  CDS Start-End: 102-2420
gcgcggcgctgctgggttctccgaggcgacctggccgccggccgctcctccgcgcgctgttccgcacttgctgccctcgcccggcccggagcgccgctgccatgcggctggcgctgctctgggccctggggctcctgggcgcgggcagccctctgccttcctggccgctcccaaatataggtggcactgaggagcagcaggcagagtcagagaaggccccgagggagcccttggagccccaggtccttcaggacgatctcccaattagcctcaaaaaggtgcttcagaccagtctgcctgagcccctgaggatcaagttggagctggacggtgacagtcatatcctggagctgctacagaatagggagttggtcccaggccgcccaaccctggtgtggtaccagcccgatggcactcgggtggtcagtgagggacacactttggagaactgctgctaccagggaagagtgcggggatatgcaggctcctgggtgtccatctgcacctgctctgggctcagaggcttggtggtcctgaccccagagagaagctataccctggagcaggggcctggggaccttcagggtcctcccattatttcgcgaatccaagatctccacctgccaggccacacctgtgccctgagctggcgggaatctgtacacactcagaagccaccagagcaccccctgggacagcgccacattcgccggaggcgggatgtggtaacagagaccaagactgtggagttggtgattgtggctgatcactcggaggcccagaaataccgggacttccagcacctgctaaaccgcacactggaagtggccctcttgctggacacattcttccggcccctgaatgtacgagtggcactagtgggcctggaggcctggacccagcgtgacctggtggagatcagcccaaacccagctgtcaccctcgaaaacttcctccactggcgcagggcacatttgctgcctcgattgccccatgacagtgcccagctggtgactggtacttcattctctgggcctacggtgggcatggccattcagaactccatctgttctcctgacttctcaggaggtgtgaacatggaccactccaccagcatcctgggagtcgcctcctccatagcccatgagttgggccacagcctgggcctggaccatgatttgcctgggaatagctgcccctgtccaggtccagccccagccaagacctgcatcatggaggcctccacagacttcctaccaggcctgaacttcagcaactgcagccgacgggccctggagaaagccctcctggatggaatgggcagctgcctcttcgaacggctgcctagcctaccccctatggctgctttctgcggaaatatgtttgtggagccgggcgagcagtgtgactgtggcttcctggatgactgcgtcgatccctgctgtgattctttgacctgccagctgaggccaggtgcacagtgtgcatctgacggaccctgttgtcaaaattgccagctgcgcccgtctggctggcagtgtcgtcctaccagaggggattgtgacttgcctgaattctgcccaggagacagctcccagtgtccccctgatgtcagcctaggggatggcgagccctgcgctggcgggcaagctgtgtgcatgcacgggcgttgtgcctcctatgcccagcagtgccagtcactttggggacctggagcccagcccgctgcgccactttgcctccagacagctaatactcggggaaatgcttttgggagctgtgggcgcaaccccagtggcagttatgtgtcctgcacccctagagatgccatttgtgggcagctccagtgccagacaggtaggacccagcctctgctgggctccatccgggatctactctgggagacaatagatgtgaatgggactgagctgaactgcagctgggtgcacctggacctgggcagtgatgtggcccagcccctcctgactctgcctggcacagcctgtggccctggcctggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagtctcaggggccagccaagcccccacccccaaggaagccactgcctgccgacccccagggccggtgcccatcgggtgacctgcccggcccaggggctggaatcccgcccctagtggtaccctccagaccagcgccaccgcctccgacagtgtcctcgctctacctctgacctctccggaggttccgctgcctccaagccggacttagggcttcaagaggcgggcgtgccctctggagtcccctaccatgactgaaggcgccagagactggcggtgtcttaagactccgggcaccgccacgcgctgtcaagcaacactctgcggacctgccggcgtagttgcagcgggggcttggggaggggctgggggttggacgggattgaggaaggtccgcacagcctgtctctgctcagttgcaataaacgt

SEQ ID NO: 104599 - DNA, 2804 bp, Homo sapiens
  Payload ID: 539
  Gene Symbol: ADAM15
  Gene Name: ADAM metallopeptidase domain 15
  Uniprot ID: Q13444
  ENST ID: ENST00000368412
  CDS Start-End: 102-2492
gcgcggcgctgctgggttctccgaggcgacctggccgccggccgctcctccgcgcgctgttccgcacttgctgccctcgcccggcccggagcgccgctgccatgcggctggcgctgctctgggccctggggctcctgggcgcgggcagccctctgccttcctggccgctcccaaatataggtggcactgaggagcagcaggcagagtcagagaaggccccgagggagcccttggagccccaggtccttcaggacgatctcccaattagcctcaaaaaggtgcttcagaccagtctgcctgagcccctgaggatcaagttggagctggacggtgacagtcatatcctggagctgctacagaatagggagttggtcccaggccgcccaaccctggtgtggtaccagcccgatggcactcgggtggtcagtgagggacacactttggagaactgctgctaccagggaagagtgcggggatatgcaggctcctgggtgtccatctgcacctgctctgggctcagaggcttggtggtcctgaccccagagagaagctataccctggagcaggggcctggggaccttcagggtcctcccattatttcgcgaatccaagatctccacctgccaggccacacctgtgccctgagctggcgggaatctgtacacactcagaagccaccagagcaccccctgggacagcgccacattcgccggaggcgggatgtggtaacagagaccaagactgtggagttggtgattgtggctgatcactcggaggcccagaaataccgggacttccagcacctgctaaaccgcacactggaagtggccctcttgctggacacattcttccggcccctgaatgtacgagtggcactagtgggcctggaggcctggacccagcgtgacctggtggagatcagcccaaacccagctgtcaccctcgaaaacttcctccactggcgcagggcacatttgctgcctcgattgccccatgacagtgcccagctggtgactggtacttcattctctgggcctacggtgggcatggccattcagaactccatctgttctcctgacttctcaggaggtgtgaacatggaccactccaccagcatcctgggagtcgcctcctccatagcccatgagttgggccacagcctgggcctggaccatgatttgcctgggaatagctgcccctgtccaggtccagccccagccaagacctgcatcatggaggcctccacagacttcctaccaggcctgaacttcagcaactgcagccgacgggccctggagaaagccctcctggatggaatgggcagctgcctcttcgaacggctgcctagcctaccccctatggctgctttctgcggaaatatgtttgtggagccgggcgagcagtgtgactgtggcttcctggatgactgcgtcgatccctgctgtgattctttgacctgccagctgaggccaggtgcacagtgtgcatctgacggaccctgttgtcaaaattgccagctgcgcccgtctggctggcagtgtcgtcctaccagaggggattgtgacttgcctgaattctgcccaggagacagctcccagtgtccccctgatgtcagcctaggggatggcgagccctgcgctggcgggcaagctgtgtgcatgcacgggcgttgtgcctcctatgcccagcagtgccagtcactttggggacctggagcccagcccgctgcgccactttgcctccagacagctaatactcggggaaatgcttttgggagctgtgggcgcaaccccagtggcagttatgtgtcctgcacccctagagatgccatttgtgggcagctccagtgccagacaggtaggacccagcctctgctgggctccatccgggatctactctgggagacaatagatgtgaatgggactgagctgaactgcagctgggtgcacctggacctgggcagtgatgtggcccagcccctcctgactctgcctggcacagcctgtggccctggcctggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacaggctagtgctctcagcttcccggcccccccttccaggccgctgccgcctgaccctgtgtccaagagactccagtctcaggggccagccaagcccccacccccaaggaagccactgcctgccgacccccagggccggtgcccatcgggtgacctgcccggcccaggggctggaatcccgcccctagtggtaccctccagaccagcgccaccgcctccgacagtgtcctcgctctacctctgacctctccggaggttccgctgcctccaagccggacttagggcttcaagaggcgggcgtgccctctggagtcccctaccatgactgaaggcgccagagactggcggtgtcttaagactccgggcaccgccacgcgctgtcaagcaacactctgcggacctgccggcgtagttgcagcgggggcttggggaggggctgggggttggacgggattgaggaaggtccgcacagcctgtctctgctcagttgcaataaacgt

SEQ ID NO: 104600 - DNA, 1901 bp, Homo sapiens
  Payload ID: 539
  Gene Symbol: ADAM15
  Gene Name: ADAM metallopeptidase domain 15
  Uniprot ID: Q13444
  ENST ID: ENST00000368413
  CDS Start-End: 72-1634
ctggccgccggccgctcctccgcgcgctgttccgcacttgctgccctcgcccggcccggagcgccgctgccatgcggctggcgctgctctgggccctggggctcctgggcgcgggcagccctctgccttcctggccgctcccaaatataggtggcactgaggagcagcaggcagagtcagagaaggccccgagggagcccttggagccccaggtccttcaggacgatctcccaattagcctcaaaaaggtgcttcagaccagtctgcctgagcccctgaggatcaagttggagctggacggtgacagtcatatcctggagctgctacagaatagggagttggtcccaggcctgaacttcagcaactgcagccgacgggccctggagaaagccctcctggatggaatgggcagctgcctcttcgaacggctgcctagcctaccccctatggctgctttctgcggaaatatgtttgtggagccgggcgagcagtgtgactgtggcttcctggatgactgcgtcgatccctgctgtgattctttgacctgccagctgaggccaggtgcacagtgtgcatctgacggaccctgttgtcaaaattgccagctgcgcccgtctggctggcagtgtcgtcctaccagaggggattgtgacttgcctgaattctgcccaggagacagctcccagtgtccccctgatgtcagcctaggggatggcgagccctgcgctggcgggcaagctgtgtgcatgcacgggcgttgtgcctcctatgcccagcagtgccagtcactttggggacctggagcccagcccgctgcgccactttgcctccagacagctaatactcggggaaatgcttttgggagctgtgggcgcaaccccagtggcagttatgtgtcctgcacccctagagatgccatttgtgggcagctccagtgccagacaggtaggacccagcctctgctgggctccatccgggatctactctgggagacaatagatgtgaatgggactgagctgaactgcagctgggtgcacctggacctgggcagtgatgtggcccagcccctcctgactctgcctggcacagcctgtggccctggcctggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagggcagcccaatctggtccctctgaacggccaggacctccgcagagggccctgctggcacgaggcactaagtctcaggggccagccaagcccccacccccaaggaagccactgcctgccgacccccagggccggtgcccatcgggtgacctgcccggcccaggggctggaatcccgcccctagtggtaccctccagaccagcgccaccgcctccgacagtgtcctcgctctacctctgacctctccggaggttccgctgcctccaagccggacttagggcttcaagaggcgggcgtgccctctggagtcccctaccatgactgaaggcgccagagactggcggtgtcttaagactccgggcaccgccacgcgctgtcaagcaacactctgcggacctgccggcgtagttgcagcgggggcttggggaggggctgggggttggacgggattgaggaaggtccgcacagcctgtctctgctcagttgcaataaacgtgacatcttggg

SEQ ID NO: 104601 - DNA, 2946 bp, Homo sapiens
  Payload ID: 539
  Gene Symbol: ADAM15
  Gene Name: ADAM metallopeptidase domain 15
  Uniprot ID: Q13444
  ENST ID: ENST00000449910
  CDS Start-End: 102-2690
gcgcggcgctgctgggttctccgaggcgacctggccgccggccgctcctccgcgcgctgttccgcacttgctgccctcgcccggcccggagcgccgctgccatgcggctggcgctgctctgggccctggggctcctgggcgcgggcagccctctgccttcctggccgctcccaaatataggtggcactgaggagcagcaggcagagtcagagaaggccccgagggagcccttggagccccaggtccttcaggacgatctcccaattagcctcaaaaaggtgcttcagaccagtctgcctgagcccctgaggatcaagttggagctggacggtgacagtcatatcctggagctgctacagaatagggagttggtcccaggccgcccaaccctggtgtggtaccagcccgatggcactcgggtggtcagtgagggacacactttggagaactgctgctaccagggaagagtgcggggatatgcaggctcctgggtgtccatctgcacctgctctgggctcagaggcttggtggtcctgaccccagagagaagctataccctggagcaggggcctggggaccttcagggtcctcccattatttcgcgaatccaagatctccacctgccaggccacacctgtgccctgagctggcgggaatctgtacacactcagaagccaccagagcaccccctgggacagcgccacattcgccggaggcgggatgtggtaacagagaccaagactgtggagttggtgattgtggctgatcactcggaggcccagaaataccgggacttccagcacctgctaaaccgcacactggaagtggccctcttgctggacacattcttccggcccctgaatgtacgagtggcactagtgggcctggaggcctggacccagcgtgacctggtggagatcagcccaaacccagctgtcaccctcgaaaacttcctccactggcgcagggcacatttgctgcctcgattgccccatgacagtgcccagctggtgactggtacttcattctctgggcctacggtgggcatggccattcagaactccatctgttctcctgacttctcaggaggtgtgaacatggaccactccaccagcatcctgggagtcgcctcctccatagcccatgagttgggccacagcctgggcctggaccatgatttgcctgggaatagctgcccctgtccaggtccagccccagccaagacctgcatcatggaggcctccacagacttcctaccaggcctgaacttcagcaactgcagccgacgggccctggagaaagccctcctggatggaatgggcagctgcctcttcgaacggctgcctagcctaccccctatggctgctttctgcggaaatatgtttgtggagccgggcgagcagtgtgactgtggcttcctggatgactgcgtcgatccctgctgtgattctttgacctgccagctgaggccaggtgcacagtgtgcatctgacggaccctgttgtcaaaattgccagctgcgcccgtctggctggcagtgtcgtcctaccagaggggattgtgacttgcctgaattctgcccaggagacagctcccagtgtccccctgatgtcagcctaggggatggcgagccctgcgctggcgggcaagctgtgtgcatgcacgggcgttgtgcctcctatgcccagcagtgccagtcactttggggacctggagcccagcccgctgcgccactttgcctccagacagctaatactcggggaaatgcttttgggagctgtgggcgcaaccccagtggcagttatgtgtcctgcacccctagagatgccatttgtgggcagctccagtgccagacaggtaggacccagcctctgctgggctccatccgggatctactctgggagacaatagatgtgaatgggactgagctgaactgcagctgggtgcacctggacctgggcagtgatgtggcccagcccctcctgactctgcctggcacagcctgtggccctggcctggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagggcagcccaatctggtccctctgaacggccaggacctccgcagagggccctgctggcacgaggcactaaggctagtgctctcagcttcccggcccccccttccaggccgctgccgcctgaccctgtgtccaagagactccaggctgagctggctgaccgacccaatccccctacccgccctctgcccgctgacccggtggtgagaagcccgaagtctcaggggccagccaagcccccacccccaaggaagccactgcctgccgacccccagggccggtgcccatcgggtgacctgcccggcccaggggctggaatcccgcccctagtggtaccctccagaccagcgccaccgcctccgacagtgtcctcgctctacctctgacctctccggaggttccgctgcctccaagccggacttagggcttcaagaggcgggcgtgccctctggagtcccctaccatgactgaaggcgccagagactggcggtgtcttaagactccgggcaccgccacgcgctgtcaagcaacactctgcggacctgccggcgtagttgcagcgggggcttggggaggggctgggggttggacgggattgaggaaggtccgcacagcctgtctctgctcagttgcaataaacgt

SEQ ID NO: 104602 - DNA, 3091 bp, Homo sapiens
  Payload ID: 539
  Gene Symbol: ADAM15
  Gene Name: ADAM metallopeptidase domain 15
  Uniprot ID: Q13444
  ENST ID: ENST00000526491
  CDS Start-End: 102-2570
gcgcggcgctgctgggttctccgaggcgacctggccgccggccgctcctccgcgcgctgttccgcacttgctgccctcgcccggcccggagcgccgctgccatgcggctggcgctgctctgggccctggggctcctgggcgcgggcagccctctgccttcctggccgctcccaaatataggtggcactgaggagcagcaggcagagtcagagaaggccccgagggagcccttggagccccaggtccttcaggacgatctcccaattagcctcaaaaaggtgcttcagaccagtctgcctgagcccctgaggatcaagttggagctggacggtgacagtcatatcctggagctgctacagaatagggagttggtcccaggccgcccaaccctggtgtggtaccagcccgatggcactcgggtggtcagtgagggacacactttggagaactgctgctaccagggaagagtgcggggatatgcaggctcctgggtgtccatctgcacctgctctgggctcagaggcttggtggtcctgaccccagagagaagctataccctggagcaggggcctggggaccttcagggtcctcccattatttcgcgaatccaagatctccacctgccaggccacacctgtgccctgagctggcgggaatctgtacacactcagaagccaccagagcaccccctgggacagcgccacattcgccggaggcgggatgtggtaacagagaccaagactgtggagttggtgattgtggctgatcactcggaggcccagaaataccgggacttccagcacctgctaaaccgcacactggaagtggccctcttgctggacacattcttccggcccctgaatgtacgagtggcactagtgggcctggaggcctggacccagcgtgacctggtggagatcagcccaaacccagctgtcaccctcgaaaacttcctccactggcgcagggcacatttgctgcctcgattgccccatgacagtgcccagctggtgactggtacttcattctctgggcctacggtgggcatggccattcagaactccatctgttctcctgacttctcaggaggtgtgaacatggaccactccaccagcatcctgggagtcgcctcctccatagcccatgagttgggccacagcctgggcctggaccatgatttgcctgggaatagctgcccctgtccaggtccagccccagccaagacctgcatcatggaggcctccacagacttcctaccaggcctgaacttcagcaactgcagccgacgggccctggagaaagccctcctggatggaatgggcagctgcctcttcgaacggctgcctagcctaccccctatggctgctttctgcggaaatatgtttgtggagccgggcgagcagtgtgactgtggcttcctggatgactgcgtcgatccctgctgtgattctttgacctgccagctgaggccaggtgcacagtgtgcatctgacggaccctgttgtcaaaattgccagctgcgcccgtctggctggcagtgtcgtcctaccagaggggattgtgacttgcctgaattctgcccaggagacagctcccagtgtccccctgatgtcagcctaggggatggcgagccctgcgctggcgggcaagctgtgtgcatgcacgggcgttgtgcctcctatgcccagcagtgccagtcactttggggacctggagcccagcccgctgcgccactttgcctccagacagctaatactcggggaaatgcttttgggagctgtgggcgcaaccccagtggcagttatgtgtcctgcacccctagagatgccatttgtgggcagctccagtgccagacaggtaggacccagcctctgctgggctccatccgggatctactctgggagacaatagatgtgaatgggactgagctgaactgcagctgggtgcacctggacctgggcagtgatgtggcccagcccctcctgactctgcctggcacagcctgtggccctggcctggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagggcagcccaatctggtccctctgaacggccaggacctccgcagagggccctgctggcacgaggcactaagcaggctagtgctctcagcttcccggcccccccttccaggccgctgccgcctgaccctgtgtccaagagactccaggctgagctggctgaccgacccaatccccctacccgccctctgcccgctgacccggtggtgagaagcccgaaggtaacggtggggggagagaagggcacggcctctccccccacctagggctgtggtgctggtagccatgacggtggtggccgtggcgagatgccccctcagtgcatgagggcacatatcccggtggtgcctttaatggtgacagtctcaggggccagccaagcccccacccccaaggaagccactgcctgccgacccccagggccggtgcccatcgggtgacctgcccggcccaggggctggaatcccgcccctagtggtaccctccagaccagcgccaccgcctccgacagtgtcctcgctctacctctgacctctccggaggttccgctgcctccaagccggacttagggcttcaagaggcgggcgtgccctctggagtcccctaccatgactgaaggcgccagagactggcggtgtcttaagactccgggcaccgccacgcgctgtcaagcaacactctgcggacctgccggcgtagttgcagcgggggcttggggaggggctgggggttggacgggattgaggaaggtccgcacagcctgtctctgctcagttgcaataaacgt

SEQ ID NO: 104603 - DNA, 2678 bp, Homo sapiens
  Payload ID: 539
  Gene Symbol: ADAM15
  Gene Name: ADAM metallopeptidase domain 15
  Uniprot ID: Q13444
  ENST ID: ENST00000531455
  CDS Start-End: 37-2511
acttgctgccctcgcccggcccggagcgccgctgccatgcggctggcgctgctctgggccctggggctcctgggcgcgggcagccctctgccttcctggccgctcccaaatatagtactgtcttggggtgtcctgggacctgcaggtggcactgaggagcagcaggcagagtcagagaaggccccgagggagcccttggagccccaggtccttcaggacgatctcccaattagcctcaaaaaggtgcttcagaccagtctgcctgagcccctgaggatcaagttggagctggacggtgacagtcatatcctggagctgctacagaatagggagttggtcccaggccgcccaaccctggtgtggtaccagcccgatggcactcgggtggtcagtgagggacacactttggagaactgctgctaccagggaagagtgcggggatatgcaggctcctgggtgtccatctgcacctgctctgggctcagaggcttggtggtcctgaccccagagagaagctataccctggagcaggggcctggggaccttcagggtcctcccattatttcgcgaatccaagatctccacctgccaggccacacctgtgccctgagctggcgggaatctgtacacactcagaagccaccagagcaccccctgggacagcgccacattcgccggaggcgggatgtggtaacagagaccaagactgtggagttggtgattgtggctgatcactcggaggcccagaaataccgggacttccagcacctgctaaaccgcacactggaagtggccctcttgctggacacattcttccggcccctgaatgtacgagtggcactagtgggcctggaggcctggacccagcgtgacctggtggagatcagcccaaacccagctgtcaccctcgaaaacttcctccactggcgcagggcacatttgctgcctcgattgccccatgacagtgcccagctggtgactggtacttcattctctgggcctacggtgggcatggccattcagaactccatctgttctcctgacttctcaggaggtgtgaacatggaccactccaccagcatcctgggagtcgcctcctccatagcccatgagttgggccacagcctgggcctggaccatgatttgcctgggaatagctgcccctgtccaggtccagccccagccaagacctgcatcatggaggcctccacagacttcctaccaggcctgaacttcagcaactgcagccgacgggccctggagaaagccctcctggatggaatgggcagctgcctcttcgaacggctgcctagcctaccccctatggctgctttctgcggaaatatgtttgtggagccgggcgagcagtgtgactgtggcttcctggatgactgcgtcgatccctgctgtgattctttgacctgccagctgaggccaggtgcacagtgtgcatctgacggaccctgttgtcaaaattgccagctgcgcccgtctggctggcagtgtcgtcctaccagaggggattgtgacttgcctgaattctgcccaggagacagctcccagtgtccccctgatgtcagcctaggggatggcgagccctgcgctggcgggcaagctgtgtgcatgcacgggcgttgtgcctcctatgcccagcagtgccagtcactttggggacctggagcccagcccgctgcgccactttgcctccagacagctaatactcggggaaatgcttttgggagctgtgggcgcaaccccagtggcagttatgtgtcctgcacccctagagatgccatttgtgggcagctccagtgccagacaggtaggacccagcctctgctgggctccatccgggatctactctgggagacaatagatgtgaatgggactgagctgaactgcagctgggtgcacctggacctgggcagtgatgtggcccagcccctcctgactctgcctggcacagcctgtggccctggcctggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagggcagcccaatctggtccctctgaacggccaggacctccgcagagggccctgctggcacgaggcactaagtctcaggggccagccaagcccccacccccaaggaagccactgcctgccgacccccagggccggtgcccatcgggtgacctgcccggcccaggggctggaatcccgcccctagtggtaccctccagaccagcgccaccgcctccgacagtgtcctcgctctacctctgacctctccggaggttccgctgcctccaagccggacttagggcttcaagaggcgggcgtgccctctggagtcccctaccatgactgaaggcgccagagactggcggtgtcttaagactccgggcaccgccacgcgctgtcaagcaacactctgcggacctgccggcgta

SEQ ID NO: 104604 - DNA, 3016 bp, Homo sapiens
  Payload ID: 539
  Gene Symbol: ADAM15
  Gene Name: ADAM metallopeptidase domain 15
  Uniprot ID: Q13444
  ENST ID: ENST00000529473
  CDS Start-End: 102-2495
gcgcggcgctgctgggttctccgaggcgacctggccgccggccgctcctccgcgcgctgttccgcacttgctgccctcgcccggcccggagcgccgctgccatgcggctggcgctgctctgggccctggggctcctgggcgcgggcagccctctgccttcctggccgctcccaaatataggtggcactgaggagcagcaggcagagtcagagaaggccccgagggagcccttggagccccaggtccttcaggacgatctcccaattagcctcaaaaaggtgcttcagaccagtctgcctgagcccctgaggatcaagttggagctggacggtgacagtcatatcctggagctgctacagaatagggagttggtcccaggccgcccaaccctggtgtggtaccagcccgatggcactcgggtggtcagtgagggacacactttggagaactgctgctaccagggaagagtgcggggatatgcaggctcctgggtgtccatctgcacctgctctgggctcagaggcttggtggtcctgaccccagagagaagctataccctggagcaggggcctggggaccttcagggtcctcccattatttcgcgaatccaagatctccacctgccaggccacacctgtgccctgagctggcgggaatctgtacacactcagaagccaccagagcaccccctgggacagcgccacattcgccggaggcgggatgtggtaacagagaccaagactgtggagttggtgattgtggctgatcactcggaggcccagaaataccgggacttccagcacctgctaaaccgcacactggaagtggccctcttgctggacacattcttccggcccctgaatgtacgagtggcactagtgggcctggaggcctggacccagcgtgacctggtggagatcagcccaaacccagctgtcaccctcgaaaacttcctccactggcgcagggcacatttgctgcctcgattgccccatgacagtgcccagctggtgactggtacttcattctctgggcctacggtgggcatggccattcagaactccatctgttctcctgacttctcaggaggtgtgaacatggaccactccaccagcatcctgggagtcgcctcctccatagcccatgagttgggccacagcctgggcctggaccatgatttgcctgggaatagctgcccctgtccaggtccagccccagccaagacctgcatcatggaggcctccacagacttcctaccaggcctgaacttcagcaactgcagccgacgggccctggagaaagccctcctggatggaatgggcagctgcctcttcgaacggctgcctagcctaccccctatggctgctttctgcggaaatatgtttgtggagccgggcgagcagtgtgactgtggcttcctggatgactgcgtcgatccctgctgtgattctttgacctgccagctgaggccaggtgcacagtgtgcatctgacggaccctgttgtcaaaattgccagctgcgcccgtctggctggcagtgtcgtcctaccagaggggattgtgacttgcctgaattctgcccaggagacagctcccagtgtccccctgatgtcagcctaggggatggcgagccctgcgctggcgggcaagctgtgtgcatgcacgggcgttgtgcctcctatgcccagcagtgccagtcactttggggacctggagcccagcccgctgcgccactttgcctccagacagctaatactcggggaaatgcttttgggagctgtgggcgcaaccccagtggcagttatgtgtcctgcacccctagagatgccatttgtgggcagctccagtgccagacaggtaggacccagcctctgctgggctccatccgggatctactctgggagacaatagatgtgaatgggactgagctgaactgcagctgggtgcacctggacctgggcagtgatgtggcccagcccctcctgactctgcctggcacagcctgtggccctggcctggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagggcagcccaatctggtccctctgaacggccaggacctccgcagagggccctgctggcacgaggcactaaggctgagctggctgaccgacccaatccccctacccgccctctgcccgctgacccggtggtgagaagcccgaaggtaacggtggggggagagaagggcacggcctctccccccacctagggctgtggtgctggtagccatgacggtggtggccgtggcgagatgccccctcagtgcatgagggcacatatcccggtggtgcctttaatggtgacagtctcaggggccagccaagcccccacccccaaggaagccactgcctgccgacccccagggccggtgcccatcgggtgacctgcccggcccaggggctggaatcccgcccctagtggtaccctccagaccagcgccaccgcctccgacagtgtcctcgctctacctctgacctctccggaggttccgctgcctccaagccggacttagggcttcaagaggcgggcgtgccctctggagtcccctaccatgactgaaggcgccagagactggcggtgtcttaagactccgggcaccgccacgcgctgtcaagcaacactctgcggacctgccggcgtagttgcagcgggggcttggggaggggctgggggttggacgggattgaggaaggtccgcacagcctgtctctgctcagttgcaataaacgt

SEQ ID NO: 104605 - DNA, 2146 bp, Homo sapiens
  Payload ID: 539
  Gene Symbol: ADAM15
  Gene Name: ADAM metallopeptidase domain 15
  Uniprot ID: Q13444
  ENST ID: ENST00000447332
  CDS Start-End: 36-1937
cttgctgccctcgcccggcccggagcgccgctgccatgcggctggcgctgctctgggccctggggctcctgggcgcgggcagccctctgccttcctggccgctcccaaatatagtctcagcatgcaatgtggaagcccctcaggtggcactgaggagcagcaggcagagtcagagaaggccccgagggagcccttggagccccaggtccttcaggacgatctcccaattagcctcaaaaaggtgcttcagggagttggtcccaggccgcccaaccctggtgtggtaccagcccgatggcactcgggtggtcagtgagggacacactttggagaactgctgctaccagggaagagtgcggggatatgcaggctcctgggtgtccatctgcacctgctctgggctcagaggcttggtggtcctgaccccagagagaagctataccctggagcaggggcctggggaccttcagggtcctcccattatttcgcgaatccaagatctccacctgccaggccacacctgtgccctgagctggcgggaatctgtacacactcagaagccaccagagcaccccctgggacagcgccacattcgccggaggcgggatgtggtaacagagaccaagactgtggagttggtgattgtggctgatcactcggaggcccagaaataccgggacttccagcacctgctaaaccgcacactggaagtggccctcttgctggacacattcttccggcccctgaatgtacgagtggcactagtgggcctggaggcctggacccagcgtgacctggtggagatcagcccaaacccagctgtcaccctcgaaaacttcctccactggcgcagggcacatttgctgcctcgattgccccatgacagtgcccagctggtgactggtacttcattctctgggcctacggtgggcatggccattcagaactccatctgttctcctgacttctcaggaggtgtgaacatggaccactccaccagcatcctgggagtcgcctcctccatagcccatgagttgggccacagcctgggcctggaccatgatttgcctgggaatagctgcccctgtccaggtccagccccagccaagacctgcatcatggaggcctccacagacttcctaccaggcctgaacttcagcaactgcagccgacgggccctggagaaagccctcctggatggaatgggcagctgcctcttcgaacggctgcctagcctaccccctatggctgctttctgcggaaatatgtttgtggagccgggcgagcagtgtgactgtggcttcctggatgactgcgtcgatccctgctgtgattctttgacctgccagctgaggccaggtgcacagtgtgcatctgacggaccctgttgtcaaaattgccagctgcgcccgtctggctggcagtgtcgtcctaccagaggggattgtgacttgcctgaattctgcccaggagacagctcccagtgtccccctgatgtcagcctaggggatggcgagccctgcgctggcgggcaagctgtgtgcatgcacgggcgttgtgcctcctatgcccagcagtgccagtcactttggggacctggagcccagcccgctgcgccactttgcctccagacagctaatactcggggaaatgcttttgggagctgtgggcgcaaccccagtggcagttatgtgtcctgcacccctagagatgccatttgtgggcagctccagtgccagacaggtaggacccagcctctgctgggctccatccgggatctactctgggagacaatagatgtgaatgggactgagctgaactgcagctgggtgcacctggacctgggcagtgatgtggcccagcccctcctgactctgcctggcacagcctgtggccctggcctggtgagcagcctgggtgggcaagaccaggtgtgagaagggacatttggaccacaatgaacagagcccagacttcaccattcaccaatgtcaaaggcagggactccaagggaagtcagtttcttacttcagatggagcaaagtcctatcaactcactatgccttggtttccccatctgtaaacgcagggtatggcctcaaccttattggcctcccagtcccattaaagctttgtgggaatctga

SEQ ID NO: 104606 - DNA, 4349 bp, Homo sapiens
  Payload ID: 540
  Gene Symbol: ADAM17
  Gene Name: ADAM metallopeptidase domain 17
  Uniprot ID: P78536
  ENST ID: ENST00000310823
  CDS Start-End: 184-2658
acctgcacttctgggggcgtcgagcctggcggtagaatcttcccagtaggcggcgcgggagggaaaagaggattgaggggctaggccgggcggatcccgtcctcccccgatgtgagcagttttccgaaaccccgtcaggcgaaggctgcccagagaggtggagtcggtagcggggccgggaacatgaggcagtctctcctattcctgaccagcgtggttcctttcgtgctggcgccgcgacctccggatgacccgggcttcggcccccaccagagactcgagaagcttgattctttgctctcagactacgatattctctctttatctaatatccagcagcattcggtaagaaaaagagatctacagacttcaacacatgtagaaacactactaactttttcagctttgaaaaggcattttaaattatacctgacatcaagtactgaacgtttttcacaaaatttcaaggtcgtggtggtggatggtaaaaacgaaagcgagtacactgtaaaatggcaggacttcttcactggacacgtggttggtgagcctgactctagggttctagcccacataagagatgatgatgttataatcagaatcaacacagatggggccgaatataacatagagccactttggagatttgttaatgataccaaagacaaaagaatgttagtttataaatctgaagatatcaagaatgtttcacgtttgcagtctccaaaagtgtgtggttatttaaaagtggataatgaagagttgctcccaaaagggttagtagacagagaaccacctgaagagcttgttcatcgagtgaaaagaagagctgacccagatcccatgaagaacacgtgtaaattattggtggtagcagatcatcgcttctacagatacatgggcagaggggaagagagtacaactacaaattacttaatagagctaattgacagagttgatgacatctatcggaacacttcatgggataatgcaggttttaaaggctatggaatacagatagagcagattcgcattctcaagtctccacaagaggtaaaacctggtgaaaagcactacaacatggcaaaaagttacccaaatgaagaaaaggatgcttgggatgtgaagatgttgctagagcaatttagctttgatatagctgaggaagcatctaaagtttgcttggcacaccttttcacataccaagattttgatatgggaactcttggattagcttatgttggctctcccagagcaaacagccatggaggtgtttgtccaaaggcttattatagcccagttgggaagaaaaatatctatttgaatagtggtttgacgagcacaaagaattatggtaaaaccatccttacaaaggaagctgacctggttacaactcatgaattgggacataattttggagcagaacatgatccggatggtctagcagaatgtgccccgaatgaggaccagggagggaaatatgtcatgtatcccatagctgtgagtggcgatcacgagaacaataagatgttttcaaactgcagtaaacaatcaatctataagaccattgaaagtaaggcccaggagtgttttcaagaacgcagcaataaagtttgtgggaactcgagggtggatgaaggagaagagtgtgatcctggcatcatgtatctgaacaacgacacctgctgcaacagcgactgcacgttgaaggaaggtgtccagtgcagtgacaggaacagtccttgctgtaaaaactgtcagtttgagactgcccagaagaagtgccaggaggcgattaatgctacttgcaaaggcgtgtcctactgcacaggtaatagcagtgagtgcccgcctccaggaaatgctgaagatgacactgtttgcttggatcttggcaagtgtaaggatgggaaatgcatccctttctgcgagagggaacagcagctggagtcctgtgcatgtaatgaaactgacaactcctgcaaggtgtgctgcagggacctttctggccgctgtgtgccctatgtcgatgctgaacaaaagaacttatttttgaggaaaggaaagccctgtacagtaggattttgtgacatgaatggcaaatgtgagaaacgagtacaggatgtaattgaacgattttgggatttcattgaccagctgagcatcaatacttttggaaagtttttagcagacaacatcgttgggtctgtcctggttttctccttgatattttggattcctttcagcattcttgtccattgtgtggataagaaattggataaacagtatgaatctctgtctctgtttcaccccagtaacgtcgaaatgctgagcagcatggattctgcatcggttcgcattatcaaaccctttcctgcgccccagactccaggccgcctgcagcctgcccctgtgatcccttcggcgccagcagctccaaaactggaccaccagagaatggacaccatccaggaagaccccagcacagactcacatatggacgaggatgggtttgagaaggaccccttcccaaatagcagcacagctgccaagtcatttgaggatctcacggaccatccggtcaccagaagtgaaaaggctgcctcctttaaactgcagcgtcagaatcgtgttgacagcaaagaaacagagtgctaatttagttctcagctcttctgacttaagtgtgcaaaatatttttatagatttgacctacaaatcaatcacagcttgtattttgtgaagactgggaagtgacttagcagatgctggtcatgtgtttgaacttcctgcaggtaaacagttcttgtgtggtttggcccttctccttttgaaaaggtaaggtgaaggtgaatctagcttattttgaggctttcaggttttagtttttaaaatatcttttgacctgtggtgcaaaagcagaaaatacagctggattgggttatgaatatttacgtttttgtaaattaatcttttatattgataacagcactgactagggaaatgatcagtttttttttatacactgtaatgaaccgctgaatatgaggcatttggcatttatttgtgatgacaactggaatagttttttttttttttttttttttttgccttcaactaaaaacaaaggagataaatctagtatacattgtctctaaattgtgggtctatttctagttattacccagagtttttatgtagcagggaaaatatatatctaaatttagaaatcatttgggttaatatggctcttcataattctaagactaatgctctctagaaacctaaccacctaccttacagtgagggctatacatggtagccagttgaatttatggaatctaccaactgtttagggccctgatttgctgggcagtttttctgtattttataagtatcttcatgtatccctgttactgatagggatacatgctcttagaaaattcactattggctgggagtggtggctcatgcctgtaatcccagcacttggagaggctgaggttgcgccactacactccagcctgggtgacagagtgagactctgcctcaaaaaaaaaaaaaaaaaaaaaaaattcactatctacaaacctagaatatttaaaatacaaagattgcctgttttcaaacactattgaataagagggtgagatatttcttaacaacaacaacaacaaaaaaaacaggttgttttgaatgtgatgagccagccaggagatagaatactacctgcccttagggttgggggctgtccccacaagacttgatacttcagaaaccctttttattgacccacaagcagatatttgaattacttcttactttattgctccaggattctggatgggctgcatttactgtgtgaaggataaaaatcattagcctggattctgatttctataaattgccattaaaagctttttttcccctaagaactgaaatgtgctcaccagccaaaacattttaacttgtaaattttgagggcagttaaccaaacctgtgactaatcatatctcctcctaccccccatttccaaggacatttgttactcagatacttgttatactaatacttgaacttgtaccttatggtatttgctatcttttaactagtcatgatattcttatactttagttacacttttggaatttgatacaaggttgagtggggtgtgtgggtgtatgtatgagtgaaacagttctcaaaagaatgtaagaaaaaccatttttataaaattgtgactttttaaaaacatagtctttgtcatttatagaattaacaagctgctcagggtatattttatagctgtagcactgatatctgcattaataaatactgtcgaaacacaa

SEQ ID NO: 104607 - DNA, 1873 bp, Homo sapiens
  Payload ID: 540
  Gene Symbol: ADAM17
  Gene Name: ADAM metallopeptidase domain 17
  ENST ID: ENST00000497134
  CDS Start-End: 188-1045
cgccacctgcacttctgggggcgtcgagcctggcggtagaatcttcccagtaggcggcgcgggagggaaaagaggattgaggggctaggccgggcggatcccgtcctcccccgatgtgagcagttttccgaaaccccgtcaggcgaaggctgcccagagaggtggagtcggtagcggggccgggaacatgaggcagtctctcctattcctgaccagcgtggttcctttcgtgctggcgccgcgacctccggatgacccgggcttcggcccccaccagagactcgagaagcttgattctttgctctcagactacgatattctctctttatctaatatccagcagcattcggtaagaaaaagagatctacagacttcaacacatgtagaaacactactaactttttcagctttgaaaaggcattttaaattatacctgacatcaagtactgaacgtttttcacaaaatttcaaggtcgtggtggtggatggtaaaaacgaaagcgagtacactgtaaaatggcaggacttcttcactggacacgtggttggtgagcctgactctagggttctagcccacataagagatgatgatgttataatcagaatcaacacagatggggccgaatataacatagagccactttggagatttgttaatgataccaaagacaaaagaatgttagtttataaatctgaagatatcaagaatgtttcacgtttgcagtctccaaaagtgtgtggttatttaaaagtggataatgaagagttgctcccaaaagggttagtagacagagaaccacctgaagagcttgttcatcgagtgaaaagaagagctgacccagatcccatgaagaacacgtgtaaattattggtggtagcagatcatcgcttctacagatacatgggcagaggggaagagagtacaactacaaattacttaatagagctaattgacagagttgatgacatctatcggaacacttcatgggataatgcaggttttaaaggctatggaatacagatagagcagttattatttgaataggtaacatgtacacagtacaaaagccagtgaaaagtaagtctctgcagcctgtttattgtcaaaccagttcctttccccaaagacattcatgtcactagtttcatatgtatctttctagagatgtcgtatgcaggtatagtgtatgtatatgtctgtatttgacacaacggtgctatgcagtacacttttacaccttgctttttcatttcacagtatgttggagagtacttcatgttcatgcatgtaaagctgcttcacttgttttattataaatagctgcatcatgtttgagtttcagggaacctgtaaattttctttttgctttaggcatttggaaccagtcgaagaaacaggaataatataggagattaaaacattaacttctttacatctgatgaaggatggattggagggtgtggtttagatgtgtatcatggtgggcttctaagtagttctatcccagatttgaccttgaccagccaccatcaaaactgcagagtccaccccagtaaacttaccacacagtggcagaggagaccagaatgggccttctctgcaggcaggcaggcaggcaggcaggcagagagactcacagaaactctgagctgagcatggtttccttctttatctcacacttactaatgggagcctttgttacttttttttttcttctttgcaggtttaatatgaatttgtctgaaatgcctgtataaggagaagactctattcttagccttttattcctttgatgcacaaagagatgtatattttattattctttcctgagttgtcgactgtagtcgtaataaatattttaggctcctgtaa

SEQ ID NO: 104608 - DNA, 1881 bp, Homo sapiens
  Payload ID: 540
  Gene Symbol: ADAM17
  Gene Name: ADAM metallopeptidase domain 17
  ENST ID: ENST00000618923
  CDS Start-End: 188-964
cgccacctgcacttctgggggcgtcgagcctggcggtagaatcttcccagtaggcggcgcgggagggaaaagaggattgaggggctaggccgggcggatcccgtcctcccccgatgtgagcagttttccgaaaccccgtcaggcgaaggctgcccagagaggtggagtcggtagcggggccgggaacatgaggcagtctctcctattcctgaccagcgtggttcctttcgtgctggcgccgcgacctccggatgacccgggcttcggcccccaccagagactcgagaagcttgattctttgctctcagactacgatattctctctttatctaatatccagcagcattcggtaagaaaaagagatctacagacttcaacacatgtagaaacactactaactttttcagctttgaaaaggcattttaaattatacctgacatcaagtactgaacgtttttcacaaaatttcaaggtcgtggtggtggatggtaaaaacgaaagcgagtacactgtaaaatggcaggacttcttcactggacacgtggttggtgagcctgactctagggttctagcccacataagagatgatgatgttataatcagaatcaacacagatggggccgaatataacatagagccactttggagatttgttaatgataccaaagacaaaagaatgttagtttataaatctgaagatatcaagaatgtttcacgtttgcagtctccaaaagtgtgtggttatttaaaagtggataatgaagagttgctcccaaaagggttagtagacagagaaccacctgaagagcttgttcatcgagtgaaaagaagagctgacccagatcccatgaagaacacgtgtaaattattggtggtagcagatcatcgcttctacagatacatgggcagaggggaagagagtacaactacaaattacttaatacacacagatagagctaattgacagagttgatgacatctatcggaacacttcatgggataatgcaggttttaaaggctatggaatacagatagagcagttattatttgaataggtaacatgtacacagtacaaaagccagtgaaaagtaagtctctgcagcctgtttattgtcaaaccagttcctttccccaaagacattcatgtcactagtttcatatgtatctttctagagatgtcgtatgcaggtatagtgtatgtatatgtctgtatttgacacaacggtgctatgcagtacacttttacaccttgctttttcatttcacagtatgttggagagtacttcatgttcatgcatgtaaagctgcttcacttgttttattataaatagctgcatcatgtttgagtttcagggaacctgtaaattttctttttgctttaggcatttggaaccagtcgaagaaacaggaataatataggagattaaaacattaacttctttacatctgatgaaggatggattggagggtgtggtttagatgtgtatcatggtgggcttctaagtagttctatcccagatttgaccttgaccagccaccatcaaaactgcagagtccaccccagtaaacttaccacacagtggcagaggagaccagaatgggccttctctgcaggcaggcaggcaggcaggcaggcagagagactcacagaaactctgagctgagcatggtttccttctttatctcacacttactaatgggagcctttgttacttttttttttcttctttgcaggtttaatatgaatttgtctgaaatgcctgtataaggagaagactctattcttagccttttattcctttgatgcacaaagagatgtatattttattattctttcctgagttgtcgactgtagtcgtaataaatattttaggctcctgt

SEQ ID NO: 104609 - DNA, 2388 bp, Homo sapiens
  Payload ID: 541
  Gene Symbol: ADAM18
  Gene Name: ADAM metallopeptidase domain 18
  Uniprot ID: Q9Y3Q7
  ENST ID: ENST00000265707
  CDS Start-End: 46-2265
aacggtctctgtccttggctgtggctcctgcgctctggctgagccatgttccttctcctcgccctcctcactgagcttggaagactgcaagcccacgaaggttctgaaggaatatttctgcatgtcacagttccacggaagattaagtcaaatgacagtgaagtttcagagaggaagatgatttacatcattacaattgatggacaaccttacactctacatctcggaaaacaatcattcttaccccagaactttttggtttatacatataatgaaactggatctttgcattctgtgtctccatattttatgatgcattgccattaccaaggatatgctgccgaatttccaaattcatttgtgacactcagtatatgttctggtctcaggggatttctccagtttgaaaatatcagttatggaattgaaccagtagaatcttcagcaagatttgagcatataatttatcaaatgaaaaataatgatccaaatgtatccattttagcagtaaattacagtcatatttggcagaaagaccagccctacaaagttcctttaaactcacagataaaaaatctttcaaaactattaccccaatatctggaaatatacattatagtggaaaaagctttgtatgattatatgggatctgaaatgatggctgtaacacaaaaaattgtccaggttattgggcttgtcaacactatgtttacccagttcaaattgactgttatactgtcttccttggaattgtggtcaaatgaaaaccagatttccaccagtggggatgctgatgatatattacaaagatttttggcatggaaacgggactatctcatcctacggccccatgacatagcatacttacttgtttacaggaaacatcctaaatatgtgggagcaacatttcctggcactgtatgcaataaaagctatgatgcaggtattgctatgtatccagatgcaataggtttggagggattttcggttattatagctcaactgcttggccttaatgtaggattaacatatgatgacatcactcagtgtttctgtctgagagctacatgcatcatgaatcatgaagcagtgagtgccagtggtagaaagatttttagcaactgcagcatgcacgactatagatattttgtttcaaaatttgagactaaatgccttcagaagctttcaaatttgcaaccattacatcaaaatcaaccagtgtgtggtaatgggattttggaatccaatgaagaatgtgactgtggtaataaaaatgaatgtcaatttaagaagtgctgtgattataacacatgtaaactgaagggctcagtaaaatgtggttctggaccatgttgtacatcaaagtgtgagttgtcaatagcaggcactccatgtagaaagagtattgatccagagtgtgattttacagagtactgcaatggaacctctagtaattgtgttcctgacacttatgcattgaatggccgtttgtgcaagttgggaactgcctattgctataacggacaatgtcaaactactgataaccagtgtgccaagatatttggaaaaggtgctcaaggtgctccatttgcctgttttaaagaagttaattctctgcatgaaagatctgaaaactgtggttttaaaaattcacaaccattaccttgtgaacggaaggatgttctctgtggaaaattagcttgtgttcagccacataaaaatgctaataaaagtgacgctcaatctacagtttattcatatattcaagaccatgtatgtgtatctatagccactggttcctccatgagatcagatggaacagacaatgcctatgtggctgatggcaccatgtgtggtccagaaatgtactgtgtaaataaaacctgcagaaaagttcatttaatgggatataactgtaatgccaccacaaaatgcaaagggaaagggatatgtaataattttggtaattgtcaatgcttccctggacatagacctccagattgtaaattccagtttggttccccagggggtagtattgatgatggaaattttcagaaatctggtgacttttatactgaaaaaggctacaatacacactggaacaactggtttattctgagtttctgcatttttctgccgtttttcatagttttcaccactgtgatctttaaaagaaatgaaataagtaaatcatgtaacagagagaatgcagagtataatcgtaattcatccgttgtatcagaaagcgatgacgtgggacattaatattgcacagaacttccatagcaaataacctaaaggaacgaatgtgctttatttataaccttacgttatccccaatgcattgtaaatgtcaaacttttggaaaataaagcctgcgtgccctcc

SEQ ID NO: 104610 - DNA, 2314 bp, Homo sapiens
  Payload ID: 541
  Gene Symbol: ADAM18
  Gene Name: ADAM metallopeptidase domain 18
  Uniprot ID: Q9Y3Q7
  ENST ID: ENST00000379866
  CDS Start-End: 43-2190
ggtctctgtccttggctgtggctcctgcgctctggctgagccatgttccttctcctcgccctcctcactgagcttggaagactgcaagcccacgaaggttctgaaggaatatttctgcatgtcacagttccacggaagattaagtcaaatgacagtgaagtttcagagaggaagatgatttacatcattacaattgatggacaaccttacactctacatctcggaaaacaatcattcttaccccagaactttttggtttatacatataatgaaactggatctttgcattctgtgtctccatattttatgatgcattgccattaccaaggatatgctgccgaatttccaaattcatttgtgacactcagtatatgttctggtctcaggggatttctccagtttgaaaatatcagttatggaattgaaccagtagaatcttcagcaagatttgagcatataatttatcaaatgaaaaataatgatccaaatgtatccattttagcagtaaattacagtcatatttggcagaaagaccagccctacaaagttcctttaaactcacagataaaaaatctttcaaaactattaccccaatatctggaaatatacattatagtggaaaaagctttgatgtttacccagttcaaattgactgttatactgtcttccttggaattgtggtcaaatgaaaaccagatttccaccagtggggatgctgatgatatattacaaagatttttggcatggaaacgggactatctcatcctacggccccatgacatagcatacttacttgtttacaggaaacatcctaaatatgtgggagcaacatttcctggcactgtatgcaataaaagctatgatgcaggtattgctatgtatccagatgcaataggtttggagggattttcggttattatagctcaactgcttggccttaatgtaggattaacatatgatgacatcactcagtgtttctgtctgagagctacatgcatcatgaatcatgaagcagtgagtgccagtggtagaaagatttttagcaactgcagcatgcacgactatagatattttgtttcaaaatttgagactaaatgccttcagaagctttcaaatttgcaaccattacatcaaaatcaaccagtgtgtggtaatgggattttggaatccaatgaagaatgtgactgtggtaataaaaatgaatgtcaatttaagaagtgctgtgattataacacatgtaaactgaagggctcagtaaaatgtggttctggaccatgttgtacatcaaagtgtgagttgtcaatagcaggcactccatgtagaaagagtattgatccagagtgtgattttacagagtactgcaatggaacctctagtaattgtgttcctgacacttatgcattgaatggccgtttgtgcaagttgggaactgcctattgctataacggacaatgtcaaactactgataaccagtgtgccaagatatttggaaaaggtgctcaaggtgctccatttgcctgttttaaagaagttaattctctgcatgaaagatctgaaaactgtggttttaaaaattcacaaccattaccttgtgaacggaaggatgttctctgtggaaaattagcttgtgttcagccacataaaaatgctaataaaagtgacgctcaatctacagtttattcatatattcaagaccatgtatgtgtatctatagccactggttcctccatgagatcagatggaacagacaatgcctatgtggctgatggcaccatgtgtggtccagaaatgtactgtgtaaataaaacctgcagaaaagttcatttaatgggatataactgtaatgccaccacaaaatgcaaagggaaagggatatgtaataattttggtaattgtcaatgcttccctggacatagacctccagattgtaaattccagtttggttccccagggggtagtattgatgatggaaattttcagaaatctggtgacttttatactgaaaaaggctacaatacacactggaacaactggtttattctgagtttctgcatttttctgccgtttttcatagttttcaccactgtgatctttaaaagaaatgaaataagtaaatcatgtaacagagagaatgcagagtataatcgtaattcatccgttgtatcagaaagcgatgacgtgggacattaatattgcacagaacttccatagcaaataacctaaaggaacgaatgtgctttatttataaccttacgttatccccaatgcattgtaaatgtcaaacttttggaaaataaagcctgcgtgccctccc

SEQ ID NO: 104611 - DNA, 1886 bp, Homo sapiens
  Payload ID: 541
  Gene Symbol: ADAM18
  Gene Name: ADAM metallopeptidase domain 18
  ENST ID: ENST00000520087
  CDS Start-End: 1-348
atgttccttctcctcgccctcctcactgagcttggaagactgcaagcccacgaaggttctgaaggaatatttctgcatgtcacagttccacggaagattaagtcaaatgacagtgaagtttcagagaggaagatgatttacatcattacaattgatggacaaccttacactctacatctcggaaaacaatcattcttaccccagaactttttggtttatacatataatgaaactggatctttgcattctgtgtctccatattttatgatgcattgccattaccaaggatatgctgccgaatttccaaattcatttgtgacactcagtatatgttctggtctcagataaaaaatctttcaaaactattaccccaatatctggaaatatacattatagtggaaaaagctttgtatgattatatgggatctgaaatgatggctgtaacacaaaaaattgtccaggttattgggcttgtcaacactatgtttacccagttcaaattgactgttatactgtcttccttggaattgtggtcaaatgaaaaccagatttccaccagtggggatgctgatgatatattacaaagatttttggcatggaaacgggactatctcatcctacggccccatgacatagcatacttacttgtttacaggaaacatcctaaatatgtgggagcaacatttcctggcactgtatgcaataaaagctatgatgcaggtattgctatgtatccagatgcaataggtttggagggattttcggttattatagctcaactgcttggccttaatgtaggattaacatatgatgacatcactcagtgtttctgtctgagagctacatgcatcatgaatcatgaagcagtgaatgtcaatttaagaagtgctgtgattataacacatgtaaactgaagggctcagtaaaatgtggttctggaccatgttgtacatcaaagtgtgagttgtcaatagcaggcactccatgtagaaagagtattgatccagagtgtgattttacagagtactgcaatggaacctctagtaattgtgttcctgacacttatgcattgaatggccgtttgtgcaagttgggaactgcctattgctataacggacaatgtcaaactactgataaccagtgtgccaagatatttggaaaaggtgctcaaggtgctccatttgcctgttttaaagaagttaattctctgcatgaaagatctgaaaactgtggttttaaaaattcacaaccattaccttgtgaacggaaggatgttctctgtggaaaattagcttgtgttcagccacataaaaatgctaataaaagtgacgctcaatctacagtttattcatatattcaagaccatgtatgtgtatctatagccactggttcctccatgagatcagatggaacagacaatgcctatgtggctgatggcaccatgtgtggtccagaaatgtactgtgtaaataaaacctgcagaaaagttcatttaatgggatataactgtaatgccaccacaaaatgcaaagggaaagggatatgtaataattttggtaattgtcaatgcttccctggacatagacctccagattgtaaattccagtttggttccccagggggtagtattgatgatggaaattttcagaaatctggtgacttttatactgaaaaaggctacaatacacactggaacaactggtttattctgagtttctgcatttttctgccgtttttcatagttttcaccactgtgatctttaaaagaaatgaaataagtaaatcatgtaacagagagaatgcagagtataatcgtaattcatccgttgtatcagaaagcgatgacgtgggacattaatattgcacagaacttccatagcaaataa

SEQ ID NO: 104612 - DNA, 728 bp, Homo sapiens
  Payload ID: 541
  Gene Symbol: ADAM18
  Gene Name: ADAM metallopeptidase domain 18
  ENST ID: ENST00000520001
  CDS Start-End: 135-323
ctcacccccagggtcctggggcagcacagggtcctccctggcccaggcgcccggtggccgagagcctgcccgcgagctcaacgctgctcaacggtctctgtccttggctgtggctcctgcgctctggctgagccatgttccttctcctcgccctcctcactgagcttggaagactgcaagcccacgaaggttctgaaggaatatttctgcatgtcacagttccacggaagattaagtcaaatgacagtgaagtttcagagaggaaggtttttggggagcaggtggtatttggttacatgaatgatttacatcattacaattgatggacaaccttacactctacatctcggaaaacaatcattcttaccccagaactttttggtttatacatataatgaaactggatctttgcattctgtgtctccatattttatgatgcattgccattaccaaggatatgctgccgaatttccaaattcatttgtgacactcagtatatgttctggtctcaggggatttctccagtttgaaaatatcagttatggaattgaaccagtagaatcttcagcaagatttgagcatataatttatcaaatgaaaaataatgatccaaatgtatccattttagcagtaaattacagtcatatttggcagaaagaccagccctacaaagttcctttaaactcacaggtgactgtcatcattctgatgttatgacatactagaac

SEQ ID NO: 104613 - DNA, 1429 bp, Homo sapiens
  Payload ID: 541
  Gene Symbol: ADAM18
  Gene Name: ADAM metallopeptidase domain 18
  Uniprot ID: Q9Y3Q7
  ENST ID: ENST00000520772
  CDS Start-End: 39-587
tctgtccttggctgtggctcctgcgctctggctgagccatgttccttctcctcgccctcctcactgagcttggaagactgcaagcccacgaaggttctgaaggaatatttctgcatgtcacagttccacggaagattaagtcaaatgacagtgaagtttcagagaggaagatgatttacatcattacaattgatggacaaccttacactctacatctcggaaaacaatcattcttaccccagaactttttggtttatacatataatgaaactggatctttgcattctgtgtctccatattttatgatgcattgccattaccaaggatatgctgccgaatttccaaattcatttgtgacactcagtatatgttctggtctcaggggatttctccagtttgaaaatatcagttatggaattgaaccagtagaatcttcagcaagatttgagcatataatttatcaaatgaaaaataatgatccaaatgtatccattttagcagtaaattacagtcatatttggcagaaagaccagccctacaaagttcctttaaactcacaggtgactgtcatcattctgatgttatgacatactagaacattgcctgtgtagttttcttgtaaatcatgaaaggaatttagttagctgttgagtaggaatattaaattttatgtatttttctacctttaaataaaacattgaaacttcatctaaaatatttggaaagttacatatttcaagcttaatattttatgatgtattatgtaacattaatttttatatttttttcaaacaaaatgatactattgaaaaagtttagaaatgcagaaagaacagagtcactgttattctagtaccttggtaaaattacttttaatattttgttatatatcttacatactacctgaacatatctttctaaaatgcacagccatttgcatgttgccagatgctcttaatttgctggtagactaggtatagaattcttgctggcagtttctttctttcagcactttgaatatttcaatccatcaccatgtggcctctgttttttctgataaaaatattctattattcttattgggaattccttggacaaaatgagttgcttctcttttgtttcttttgagattcttcctttgcctttgtcttatggcagtgtgcttatcatgtttctatgaatggatctctttgtgtttaccatacttggagctcaaagcacttcttgggtctgtaaatggatgtgttttgaaattaaattagcttgtgtgaatcctgaaaaaaaaaatcccatgaagctatgaaaccaactatctgtatggttcctagagacttcacacttttattctactttaaaatttgtctcgattttgtagttcattattgccaaaagtatttactgggataaataaaaaaagcattcttctcgg

SEQ ID NO: 104614 - DNA, 2388 bp, Homo sapiens
  Payload ID: 541
  Gene Symbol: ADAM18
  Gene Name: ADAM metallopeptidase domain 18
  Uniprot ID: Q9Y3Q7
  ENST ID: ENST00000613609
  CDS Start-End: 46-2265
aacggtctctgtccttggctgtggctcctgcgctctggctgagccatgttccttctcctcgccctcctcactgagcttggaagactgcaagcccacgaaggttctgaaggaatatttctgcatgtcacagttccacggaagattaagtcaaatgacagtgaagtttcagagaggaagatgatttacatcattacaattgatggacaaccttacactctacatctcggaaaacaatcattcttaccccagaactttttggtttatacatataatgaaactggatctttgcattctgtgtctccatattttatgatgcattgccattaccaaggatatgctgccgaatttccaaattcatttgtgacactcagtatatgttctggtctcaggggatttctccagtttgaaaatatcagttatggaattgaaccagtagaatcttcagcaagatttgagcatataatttatcaaatgaaaaataatgatccaaatgtatccattttagcagtaaattacagtcatatttggcagaaagaccagccctacaaagttcctttaaactcacagataaaaaatctttcaaaactattaccccaatatctggaaatatacattatagtggaaaaagctttgtatgattatatgggatctgaaatgatggctgtaacacaaaaaattgtccaggttattgggcttgtcaacactatgtttacccagttcaaattgactgttatactgtcttccttggaattgtggtcaaatgaaaaccagatttccaccagtggggatgctgatgatatattacaaagatttttggcatggaaacgggactatctcatcctacggccccatgacatagcatacttacttgtttacaggaaacatcctaaatatgtgggagcaacatttcctggcaccgtatgcaataaaagctatgatgcaggtattgctatgtatccagatgcaataggtttggagggattttcggttattatagctcaactgcttggccttaatgtaggattaacatatgatgacatcactcagtgtttctgtctgagagctacatgcatcatgaatcatgaagcagtgagtgccagtggtagaaagatttttagcaactgcagcatgcacgactatagatattttgtttcaaaatttgagactaaatgccttcagaagctttcaaatttgcaaccattacatcaaaatcaaccagtgtgtggtaatgggattttggaatccaatgaagaatgtgactgtggtaataaaaatgaatgtcaatttaagaagtgctgtgattataacacatgtaaactgaagggctcagtaaaatgtggttctggaccatgttgtacatcaaagtgtgagttgtcaatagcaggcactccatgtagaaagagtattgatccagagtgtgattttacagagtactgcaatggaacctctagtaattgtgttcctgacacttatgcattgaatggccgtttgtgcaagttgggaactgcctattgctataacggacaatgtcaaactactgataaccagtgtgccaagatatttggaaaaggtgctcaaggtgctccatttgcctgttttaaagaagttaattctctgcatgaaagatctgaaaactgtggttttaaaaattcacaaccattaccttgtgaacggaaggatgttctctgtggaaaattagcttgtgttcagccacataaaaatgctaataaaagtgacgctcaatctacagtttattcatatattcaagaccatgtatgtgtatctatagccactggttcctccatgagatcagatggaacagacaatgcctatgtggctgatggcaccatgtgtggtccagaaatgtactgtgtaaataaaacctgcagaaaagttcatttaatgggatataactgtaatgccaccacaaaatgcaaagggaaagggatatgtaataattttggtaattgtcaatgcttccctggacatagacctccagattgtaaattccagtttggttccccagggggtagtattgatgatggaaattttcagaaatctggtgacttttatactgaaaaaggctacaatacacactggaacaactggtttattctgagtttctgcatttttctgccgtttttcatagttttcaccactgtgatctttaaaagaaatgaaataagtaaatcatgtaacagagagaatgcagagtataatcgtaattcatccgttgtatcagaaagcgatgacgtgggacattaatattgcacagaacttccatagcaaataacctaaaggaacgaatgtgctttatttataaccttacgttatccccaatgcattgtaaatgtcaaacttttggaaaataaagcctgcgtgccctcc

SEQ ID NO: 104615 - DNA, 1886 bp, Homo sapiens
  Payload ID: 541
  Gene Symbol: ADAM18
  Gene Name: ADAM metallopeptidase domain 18
  ENST ID: ENST00000614391
  CDS Start-End: 1-348
atgttccttctcctcgccctcctcactgagcttggaagactgcaagcccacgaaggttctgaaggaatatttctgcatgtcacagttccacggaagattaagtcaaatgacagtgaagtttcagagaggaagatgatttacatcattacaattgatggacaaccttacactctacatctcggaaaacaatcattcttaccccagaactttttggtttatacatataatgaaactggatctttgcattctgtgtctccatattttatgatgcattgccattaccaaggatatgctgccgaatttccaaattcatttgtgacactcagtatatgttctggtctcagataaaaaatctttcaaaactattaccccaatatctggaaatatacattatagtggaaaaagctttgtatgattatatgggatctgaaatgatggctgtaacacaaaaaattgtccaggttattgggcttgtcaacactatgtttacccagttcaaattgactgttatactgtcttccttggaattgtggtcaaatgaaaaccagatttccaccagtggggatgctgatgatatattacaaagatttttggcatggaaacgggactatctcatcctacggccccatgacatagcatacttacttgtttacaggaaacatcctaaatatgtgggagcaacatttcctggcaccgtatgcaataaaagctatgatgcaggtattgctatgtatccagatgcaataggtttggagggattttcggttattatagctcaactgcttggccttaatgtaggattaacatatgatgacatcactcagtgtttctgtctgagagctacatgcatcatgaatcatgaagcagtgaatgtcaatttaagaagtgctgtgattataacacatgtaaactgaagggctcagtaaaatgtggttctggaccatgttgtacatcaaagtgtgagttgtcaatagcaggcactccatgtagaaagagtattgatccagagtgtgattttacagagtactgcaatggaacctctagtaattgtgttcctgacacttatgcattgaatggccgtttgtgcaagttgggaactgcctattgctataacggacaatgtcaaactactgataaccagtgtgccaagatatttggaaaaggtgctcaaggtgctccatttgcctgttttaaagaagttaattctctgcatgaaagatctgaaaactgtggttttaaaaattcacaaccattaccttgtgaacggaaggatgttctctgtggaaaattagcttgtgttcagccacataaaaatgctaataaaagtgacgctcaatctacagtttattcatatattcaagaccatgtatgtgtatctatagccactggttcctccatgagatcagatggaacagacaatgcctatgtggctgatggcaccatgtgtggtccagaaatgtactgtgtaaataaaacctgcagaaaagttcatttaatgggatataactgtaatgccaccacaaaatgcaaagggaaagggatatgtaataattttggtaattgtcaatgcttccctggacatagacctccagattgtaaattccagtttggttccccagggggtagtattgatgatggaaattttcagaaatctggtgacttttatactgaaaaaggctacaatacacactggaacaactggtttattctgagtttctgcatttttctgccgtttttcatagttttcaccactgtgatctttaaaagaaatgaaataagtaaatcatgtaacagagagaatgcagagtataatcgtaattcatccgttgtatcagaaagcgatgacgtgggacattaatattgcacagaacttccatagcaaataa

SEQ ID NO: 104616 - DNA, 1430 bp, Homo sapiens
  Payload ID: 541
  Gene Symbol: ADAM18
  Gene Name: ADAM metallopeptidase domain 18
  Uniprot ID: Q9Y3Q7
  ENST ID: ENST00000633688
  CDS Start-End: 39-587
tctgtccttggctgtggctcctgcgctctggctgagccatgttccttctcctcgccctcctcactgagcttggaagactgcaagcccacgaaggttctgaaggaatatttctgcatgtcacagttccacggaagattaagtcaaatgacagtgaagtttcagagaggaagatgatttacatcattacaattgatggacaaccttacactctacatctcggaaaacaatcattcttaccccagaactttttggtttatacatataatgaaactggatctttgcattctgtgtctccatattttatgatgcattgccattaccaaggatatgctgccgaatttccaaattcatttgtgacactcagtatatgttctggtctcaggggatttctccagtttgaaaatatcagttatggaattgaaccagtagaatcttcagcaagatttgagcatataatttatcaaatgaaaaataatgatccaaatgtatccattttagcagtaaattacagtcatatttggcagaaagaccagccctacaaagttcctttaaactcacaggtgactgtcatcattctgatgttatgacatactagaacattgcctgtgtagttttcttgtaaatcatgaaaggaatttagttagctgttgagtaggaatattaaattttatgtatttttctacctttaaataaaacattgaaacttcatctaaaatatttggaaagttacatatttcaagcttaatattttatgatgtattatgtaacattaatttttatatttttttcaaacaaaatgatactattgaaaaagtttagaaatgcagaaagaacagagtcactgttattctagtaccttggtaaaattacttttaatattttgttatatatcttacatactacctgaacatatctttctaaaatgcacagccatttgcatgttgccagatgctcttaatttgctggtagactaggtatagaattcttgctggcagtttctttctttcagcactttgaatatttcaatccatcaccatgtggcctctgttttttctgataaaaatattctattattcttattgggaattccttggacaaaatgagttgcttctcttttgtttcttttgagattcttcctttgcctttgtcttatggcagtgtgcttatcatgtttctatgaatgtatctctttgtgtttaccatacttggagctcaaagcacttcttgggtctgaaaatggatgtgttttgaaattaaattagcttgtgtgaatcctgaaaaaaaaaaatcccatgaagctatgaaaccaactatctgtatggttcctagagacttcacacttttattctactttaaaatttgtctcgattttgtagttcattattgccaaaagtatttactgggataaataaaaaaagcattcttctcgg

SEQ ID NO: 104617 - DNA, 2314 bp, Homo sapiens
  Payload ID: 541
  Gene Symbol: ADAM18
  Gene Name: ADAM metallopeptidase domain 18
  Uniprot ID: Q9Y3Q7
  ENST ID: ENST00000633768
  CDS Start-End: 43-2190
ggtctctgtccttggctgtggctcctgcgctctggctgagccatgttccttctcctcgccctcctcactgagcttggaagactgcaagcccacgaaggttctgaaggaatatttctgcatgtcacagttccacggaagattaagtcaaatgacagtgaagtttcagagaggaagatgatttacatcattacaattgatggacaaccttacactctacatctcggaaaacaatcattcttaccccagaactttttggtttatacatataatgaaactggatctttgcattctgtgtctccatattttatgatgcattgccattaccaaggatatgctgccgaatttccaaattcatttgtgacactcagtatatgttctggtctcaggggatttctccagtttgaaaatatcagttatggaattgaaccagtagaatcttcagcaagatttgagcatataatttatcaaatgaaaaataatgatccaaatgtatccattttagcagtaaattacagtcatatttggcagaaagaccagccctacaaagttcctttaaactcacagataaaaaatctttcaaaactattaccccaatatctggaaatatacattatagtggaaaaagctttgatgtttacccagttcaaattgactgttatactgtcttccttggaattgtggtcaaatgaaaaccagatttccaccagtggggatgctgatgatatattacaaagatttttggcatggaaacgggactatctcatcctacggccccatgacatagcatacttacttgtttacaggaaacatcctaaatatgtgggagcaacatttcctggcaccgtatgcaataaaagctatgatgcaggtattgctatgtatccagatgcaataggtttggagggattttcggttattatagctcaactgcttggccttaatgtaggattaacatatgatgacatcactcagtgtttctgtctgagagctacatgcatcatgaatcatgaagcagtgagtgccagtggtagaaagatttttagcaactgcagcatgcacgactatagatattttgtttcaaaatttgagactaaatgccttcagaagctttcaaatttgcaaccattacatcaaaatcaaccagtgtgtggtaatgggattttggaatccaatgaagaatgtgactgtggtaataaaaatgaatgtcaatttaagaagtgctgtgattataacacatgtaaactgaagggctcagtaaaatgtggttctggaccatgttgtacatcaaagtgtgagttgtcaatagcaggcactccatgtagaaagagtattgatccagagtgtgattttacagagtactgcaatggaacctctagtaattgtgttcctgacacttatgcattgaatggccgtttgtgcaagttgggaactgcctattgctataacggacaatgtcaaactactgataaccagtgtgccaagatatttggaaaaggtgctcaaggtgctccatttgcctgttttaaagaagttaattctctgcatgaaagatctgaaaactgtggttttaaaaattcacaaccattaccttgtgaacggaaggatgttctctgtggaaaattagcttgtgttcagccacataaaaatgctaataaaagtgacgctcaatctacagtttattcatatattcaagaccatgtatgtgtatctatagccactggttcctccatgagatcagatggaacagacaatgcctatgtggctgatggcaccatgtgtggtccagaaatgtactgtgtaaataaaacctgcagaaaagttcatttaatgggatataactgtaatgccaccacaaaatgcaaagggaaagggatatgtaataattttggtaattgtcaatgcttccctggacatagacctccagattgtaaattccagtttggttccccagggggtagtattgatgatggaaattttcagaaatctggtgacttttatactgaaaaaggctacaatacacactggaacaactggtttattctgagtttctgcatttttctgccgtttttcatagttttcaccactgtgatctttaaaagaaatgaaataagtaaatcatgtaacagagagaatgcagagtataatcgtaattcatccgttgtatcagaaagcgatgacgtgggacattaatattgcacagaacttccatagcaaataacctaaaggaacgaatgtgctttatttataaccttacgttatccccaatgcattgtaaatgtcaaacttttggaaaataaagcctgcgtgccctccc

SEQ ID NO: 104618 - DNA, 728 bp, Homo sapiens; identical to SEQ ID NO: 104612
  Payload ID: 541
  Gene Symbol: ADAM18
  Gene Name: ADAM metallopeptidase domain 18
  ENST ID: ENST00000633693
  CDS Start-End: 135-323

SEQ ID NO: 104619 - DNA, 6481 bp, Homo sapiens
  Payload ID: 542
  Gene Symbol: ADAM19
  Gene Name: ADAM metallopeptidase domain 19
  Uniprot ID: Q9H013
  ENST ID: ENST00000257527
  CDS Start-End: 80-2836
agacgcgcctccaccgccgggcagtgggcaggtatggctgagggcgtgtgagcgccgagcgctaagggccgccgccaccatgccagggggcgcaggcgccgcccggctctgcttgctggcgtttgccctgcagcccctccggccgcgggcggcgcgggagcctggatggacaagaggaagtgaggaaggcagccccaagctgcagcatgaacttatcatacctcagtggaagacttcagaaagccccgtgagagaaaagcatccactcaaagctgagctcagggtaatggctgaggggcgagaactgatcctggacctggagaagaatgagcaactttttgctccttcctacacagaaacccattatacttcaagtggtaaccctcaaaccaccacacggaaattggaggatcactgcttttaccacggcacggtgagggagacagaactgtccagcgtcacgctcagcacttgccgaggaattagaggactgattacggtgagcagcaacctcagctacgtcatcgagcccctccctgacagcaagggccaacaccttatttacagatctgaacatctcaagccgcccccgggaaactgtgggttcgagcactccaagcccaccaccagggactgggctcttcagtttacacaacagaccaagaagcgacctcgcaggatgaaaagggaagatttaaactccatgaagtatgtggagctttacctcgtggctgattatttagagtttcagaagaatcgacgagaccaggacgccaccaaacacaagctcatagagatcgccaactatgttgataagttttaccgatccttgaacatccggattgctctcgtgggcttggaagtgtggacccacgggaacatgtgtgaagtttcagagaatccatattctaccctctggtcctttctcagttggaggcgcaagctgcttgcccagaagtaccatgacaacgcccaattaatcacgggcatgtccttccacggcaccaccatcggcctggcccccctcatggccatgtgctctgtgtaccagtctggaggagtcaacatggaccactccgagaatgccattggcgtggctgccaccatggcccacgagatgggccacaactttggcatgacccatgattctgcagattgctgctcggccagtgcggctgatggtgggtgcatcatggcagctgccactgggcacccctttcccaaagtgttcaatggatgcaacaggagggagctggacaggtatctgcagtcaggtggtggaatgtgtctctccaacatgccagacaccaggatgttgtatggaggccggaggtgtgggaacgggtatctggaagatggggaagagtgtgactgtggagaagaagaggaatgtaacaacccctgctgcaatgcctctaattgtaccctgaggccgggggcggagtgtgctcacggctcctgctgccaccagtgtaagctgttggctcctgggaccctgtgccgcgagcaggccaggcagtgtgacctcccggagttctgtacgggcaagtctccccactgccctaccaacttctaccagatggatggtaccccctgtgagggcggccaggcctactgctacaacggcatgtgcctcacctaccaggagcagtgccagcagctgtggggacccggagcccgacctgcccctgacctctgcttcgagaaggtgaatgtggcaggagacacctttggaaactgtggaaaggacatgaatggtgaacacaggaagtgcaacatgagagatgcgaagtgtgggaagatccagtgtcagagctctgaggcccggcccctggagtccaacgcggtgcccattgacaccactatcatcatgaatgggaggcagatccagtgccggggcacccacgtctaccgaggtcctgaggaggagggtgacatgctggacccagggctggtgatgactggaaccaagtgtggctacaaccatatttgctttgaggggcagtgcaggaacacctccttctttgaaactgaaggctgtgggaagaagtgcaatggccatggggtctgtaacaacaaccagaactgccactgcctgccgggctgggccccgcccttctgcaacacaccgggccacgggggcagtatcgacagtgggcctatgccccctgagagtgtgggtcctgtggtagctggagtgttggtggccatcttggtgctggcggtcctcatgctgatgtactactgctgcagacagaacaacaaactaggccaactcaagccctcagctctcccttccaagctgaggcaacagttcagttgtcccttcagggtttctcagaacagcgggactggtcatgccaacccaactttcaagctgcagacgccccagggcaagcgaaaggtgatcaacactccggaaatcctgcggaagccctcccagcctcctccccggccccctccagattatctgcgtggtgggtccccacctgcaccactgccagctcacctgagcagggctgctaggaactccccagggcccgggtctcaaatagagaggacggagtcgtccaggaggcctcctccaagccggccaattccccccgcaccaaattgcatcgtttcccaggacttctccaggcctcggccgccccagaaggcactcccggcaaacccagtgccaggccgcaggagcctccccaggccaggaggtgcatccccactgcggccccctggtgctggccctcagcagtcccggcctctggcagcacttgccccaaagtttccagaatacagatcacagagggctggagggatgattagctcgaaaatctagacctgtccaaggggcttctccctttccttgagctctctggacactgcagaggacccatggccatggaaccctgaagaagcatgtctggccgcctctgagctcctcccaccctcctccaggaacctccacatctccaaaaatctccctgttgactcagtgcctcctcggcttccttggaagcccagagggactatgatctgatggcctctaggtgttgttttgtgcaatatacagccccaggtagggaggggagagtatgaggagggtgactggcagcttctcctccagactcctagccccgaggtgctgatggagatgctcaaggccagcaagcccctcaggccagcacttcgcttgcagaagccatccattcactcctggggtgcagggcacgcaagagagcttcccattgcttctgctctcctcagaggtcccgggctggatggaggctggtacttacccaccccttttagcttttagggattaaggaagggtcaagccagccactgctgtggccctgcccagggcttggttgagggaacggcttctggctgtatggctgcatgtgacaagccacgtcccctcccacctctccccaaacccctgcatccctgtattcacacgggtcactctgactcagacaggtactattcgtaggcagtgtagacagcaggaggagcaccgggcttgggcttcctctgagccgtgatgccaaaggttgcgactcctgactctggataatttttagttgctctttgttttctctgccgcactttcctggtgccccacgcttttctctcttccttcccctctcattctccctctaatgtgtggtgctttggtgagcaaaccctcagcagtcctgaccttcgggtgaccaggtgcttgtgacctacaagtcagagtcctctctcacagtcggccactggatttccctcactggctctcaggagtgtgaccagagtagacttggggcatggccattggggtcatatgtttatttttcattgtgttttgtgacctcagcagggtgggggtcttcctccttactctaagctaaatctaggtgaggtttccccttagggagcccagctatttacaaagtacacacgagggagcaggctggtcattgacttcgggctggaccgttgccctctgagcagagaacagacccatttctgggagctgcccgagatcactggagaaggcagccagcagcagctgcactggaacagtcagagcagggagcctcttcctcaacccagctttttgtcattcacttccttttgttctctctctggtcactgcccttacctgaccctcacagaaagagagctctgagcaggtgagggggtctgcggtggctcctgtcttccctgcagcagggaaggagggccgtgtggtgctttgctagataggacggtttttgcaaagcacctggagatgtttgctgggagatagactcccactccacaaaggtgctgggtggctctccggacaggagctggcctgactctcactcctctgaggctttcctggggcctcctcccatcctgccatgagcaattgtttgctcttgaaaacctcactgcaaggctgaggctgagcttctgattcaccaccccagggcctccttatagttctctgcacacaataggtgcttcttggatgttcttgggtttggaaataagtggaaaatacgggatgtacccctgggggaaaagcctgggttgggtttagaaagatctcaggaaaatgagtttctcttccctcagggtggctgtgatacaggttccccatgtccttgccgtgggtcatccttgctgtgggtcatccttgctgtggagatccattccccacctttcctgtggcccaaccttttatttaaatgtgctaccctctgcctcaaggcttggttcctggaaagtaaaggtgaaaacatcccctttcacccctctgcaaaacaaacaagcaacatcctcaaaacccaaccccatgcctcacagagcttcctgtggcttctccagcctttctccctcacatcaggaggtagatagctctgaaatgacagcgccacagccatagtgactgcatgagccatctgaacctgcagtccaccctccctggaaccacaccagaaagagacctgggttgtcgttttcttgctttttgttttgttttgttttattattttcatatcacctccatcccataaagttgtactgtgaactggaagatggtggaatgttttggaatttgatagactttcggcaaccagttctactaatgcttcactcctggctctgttcagggaggctgcccaggaggaagactggccattatgcatccccttttctttccagtgcccagtatgctgttttgaggtgtcaaatacaaataaatctgggcttagggaaggagagaccttattccaaagcacgattgcagaaggggaaagggaatattgcaaaagggagaggaaggggccttatgggaatagtgaaaaggctcagaccgaccgatggcaagatctgcaagcgtctcaaagcccaggcagaaaaggacttttcttttattggaagaagtaaacatggctagaaagaaccacgttcagggaatgacgttgtgcccagcctttttttttttttttttttttttgtctccaggggaggggctgtttgctggctcaggctgaggatggcccaaagtccagggtctggtggggaggagggaagcttaactcaagtttgggttagtgagttagcaagctctttgtgcagatggggatgtaggtaaatctttttaaaagtgaaattaacctcctgccaattttacaacccaagaatttttttttaagggccttggagccatctctaaaacaaacctcaagggatttagtgccctgtctccctgtctctagaagccttagcctgggcacctggctcaatcttgtaactgcctgctagccatagattcctttcagccttgctgacttctccctataaaagtaaagcctttttctgccccagctctgagacacttgcagatcttaaggtctgagacttgctgattttctggttggagtgtttttttgtattgccatagtcccttccccctgaagcaatagcccctccccacctcctgcaatacgcctttccaatctttattggaagtctctccctgcctacttcctaatttattcttatttgacagagggtatggaagacttgcaatttgaaaactggggaccagttccaaagtcagtaattgtgttaaccacgtgtataacagctctgctggacacccaagaaagccatgggaacgccaactggaaaggtccccttccccaggggagcctgcgaaggagaggttctgtagaatccaagcccacatttccaaagtcacccccaacgcgtcctctcacaccgtccactgtgcgtttgtatgtgtctgggatccagggcaatgtgaattttctttttatttgggagattgttcacggaaaacagatcttcttctctcttgtccacctattaattgtttacaatatttgtacatctatgcaaaatacttgaatgggccatggtgccttttttccttgttagtatttaattaaaaatgaattgtttgtcatttgcaatgtta

SEQ ID NO: 104620 - DNA, 2839 bp, Homo sapiens
  Payload ID: 542
  Gene Symbol: ADAM19
  Gene Name: ADAM metallopeptidase domain 19
  ENST ID: ENST00000517951
  CDS Start-End: 80-898
agacgcgcctccaccgccgggcagtgggcaggtatggctgagggcgtgtgagcgccgagcgctaagggccgccgccaccatgccagggggcgcaggcgccgcccggctctgcttgctggcgtttgccctgcagcccctccggccgcgggcggcgcgggagcctggatggacaagaggaagtgaggaaggcagccccaagctgcagcatgaacttatcatacctcagtggaagacttcagaaagccccgtgagagaaaagcatccactcaaagctgagctcagggtaatggctgaggggcgagaactgatcctggacctggagaagaatgagcaactttttgctccttcctacacagaaacccattatacttcaagtggtaaccctcaaaccaccacacggaaattggaggatcactgcttttaccacggcacggtgagggagacagaactgtccagcgtcacgctcagcacttgccgaggaattagaggactgattacggtgagcagcaacctcagctacgtcatcgagcccctccctgacagcaagggccaacaccttatttacagatctgaacatctcaagccgcccccgggaaactgtgggttcgagcactccaagcccaccaccagggactgggctcttcagtttacacaacagaccaagaagcgacctcgcaggatgaaaagggaagatttaaactccatgaagtatgtggagctttacctcgtggctgattatttagagtttcagaagaatcgacgagaccaggacgccaccaaacacaagctcatagagatcgccaactatgttgataaggtgagaccagttttaccgatccttgaacatccggattgctctcgtgggcttggaagtgtggacccacgggaacatgtgtgaagtttcagagaatccatattctaccctctggtcctttctcagttggaggcgcaagctgcttgcccagaagtaccatgacaacgcccaattaatcacgggcatgtccttccacggcaccaccatcggcctggcccccctcatggccatgtgctctgtgtaccagtctggaggagtcaacatggaccactccgagaatgccattggcgtggctgccaccatggcccacgagatgggccacaactttggcatgacccatgattctgcagattgctgctcggccagtgcggctgatggtgggtgcatcatggcagctgccactgggcacccctttcccaaagtgttcaatggatgcaacaggagggagctggacaggtatctgcagtcaggtggtggaatgtgtctctccaacatgccagacaccaggatgttgtatggaggccggaggtgtgggaacgggtatctggaagatggggaagagtgtgactgtggagaagaagaggaatgtaacaacccctgctgcaatgcctctaattgtaccctgaggccgggggcggagtgtgctcacggctcctgctgccaccagtgtaagctgttggctcctgggaccctgtgccgcgagcaggccaggcagtgtgacctcccggagttctgtacgggcaagtctccccactgccctaccaacttctaccagatggatggtaccccctgtgagggcggccaggcctactgctacaacggcatgtgcctcacctaccaggagcagtgccagcagctgtggggacccggagcccgacctgcccctgacctctgcttcgagaaggtgaatgtggcaggagacacctttggaaactgtggaaaggacatgaatggtgaacacaggaagtgcaacatgagagatgcgaagtgtgggaagatccagtgtcagagctctgaggcccggcccctggagtccaacgcggtgcccattgacaccactatcatcatgaatgggaggcagatccagtgccggggcacccacgtctaccgaggtcctgaggaggagggtgacatgctggacccagggctggtgatgactggaaccaagtgtggctacaaccatatttgctttgaggggcagtgcaggaacacctccttctttgaaactgaaggctgtgggaagaagtgcaatggccatggggtctgtaacaacaaccagaactgccactgcctgccgggctgggccccgcccttctgcaacacaccgggccacgggggcagtatcgacagtgggcctatgccccctgagagtgtgggtcctgtggtagctggagtgttggtggccatcttggtgctggcggtcctcatgctgatgtactactgctgcagacagaacaacaaactaggccaactcaagccctcagctctcccttccaagctgaggcaacagttcagttgtcccttcagggtttctcagaacagcgggactggtcatgccaacccaactttcaagctgcagacgccccagggcaagcgaaaggtgatcaacactccggaaatcctgcggaagccctcccagcctcctccccggccccctccagattatctgcgtggtgggtccccacctgcaccactgccagctcacctgagcagggctgctaggaactccccagggcccgggtctcaaatagagaggacggagtcgtccaggaggcctcctccaagccggccaattccccccgcaccaaattgcatcgtttcccagaagtgccttttgcctcctgccatgattctgagggctccccagccaagtggaactgttgtttgcttagtaattagttttaatatggccttctacaggtcaatgaggattagaatagaaccaggaatcaagaccaagttgctggttttactagtttggaagcagttttaatgaagatggaaatgtttatcaactcaacacag

SEQ ID NO: 104621 - DNA, 3312 bp, Homo sapiens
  Payload ID: 542
  Gene Symbol: ADAM19
  Gene Name: ADAM metallopeptidase domain 19
  Uniprot ID: Q9H013
  ENST ID: ENST00000517905
  CDS Start-End: 46-2913
tggctgagggcgtgtgagcgccgagcgctaagggccgccgccaccatgccagggggcgcaggcgccgcccggctctgcttgctggcgtttgccctgcagcccctccggccgcgggcggcgcgggagcctggatggacaagaggaagtgaggaaggcagccccaagctgcagcatgaacttatcatacctcagtggaagacttcagaaagccccgtgagagaaaagcatccactcaaagctgagctcagggtaatggctgaggggcgagaactgatcctggacctggagaagaatgagcaactttttgctccttcctacacagaaacccattatacttcaagtggtaaccctcaaaccaccacacggaaattggaggatcactgcttttaccacggcacggtgagggagacagaactgtccagcgtcacgctcagcacttgccgaggaattagaggactgattacggtgagcagcaacctcagctacgtcatcgagcccctccctgacagcaagggccaacaccttatttacagatctgaacatctcaagccgcccccgggaaactgtgggttcgagcactccaagcccaccaccagggactgggctcttcagtttacacaacagaccaagaagcgacctcgcaggatgaaaagggaagatttaaactccatgaagtatgtggagctttacctcgtggctgattatttagagtttcagaagaatcgacgagaccaggacgccaccaaacacaagctcatagagatcgccaactatgttgataagttttaccgatccttgaacatccggattgctctcgtgggcttggaagtgtggacccacgggaacatgtgtgaagtttcagagaatccatattctaccctctggtcctttctcagttggaggcgcaagctgcttgcccagaagtaccatgacaacgcccaattaatcacgggcatgtccttccacggcaccaccatcggcctggcccccctcatggccatgtgctctgtgtaccagtctggaggagtcaacatggaccactccgagaatgccattggcgtggctgccaccatggcccacgagatgggccacaactttggcatgacccatgattctgcagattgctgctcggccagtgcggctgatggtgggtgcatcatggcagctgccactgggcacccctttcccaaagtgttcaatggatgcaacaggagggagctggacaggtatctgcagtcaggtggtggaatgtgtctctccaacatgccagacaccaggatgttgtatggaggccggaggtgtgggaacgggtatctggaagatggggaagagtgtgactgtggagaagaagaggaatgtaacaacccctgctgcaatgcctctaattgtaccctgaggccgggggcggagtgtgctcacggctcctgctgccaccagtgtaagctgttggctcctgggaccctgtgccgcgagcaggccaggcagtgtgacctcccggagttctgtacgggcaagtctccccactgccctaccaacttctaccagatggatggtaccccctgtgagggcggccaggcctactgctacaacggcatgtgcctcacctaccaggagcagtgccagcagctgtggggacccggagcccgacctgcccctgacctctgcttcgagaaggtgaatgtggcaggagacacctttggaaactgtggaaaggacatgaatggtgaacacaggaagtgcaacatgagagatgcgaagtgtgggaagatccagtgtcagagctctgaggcccggcccctggagtccaacgcggtgcccattgacaccactatcatcatgaatgggaggcagatccagtgccggggcacccacgtctaccgaggtcctgaggaggagggtgacatgctggacccagggctggtgatgactggaaccaagtgtggctacaaccatatttgctttgaggggcagtgcaggaacacctccttctttgaaactgaaggctgtgggaagaagtgcaatggccatggggtctgtaacaacaaccagaactgccactgcctgccgggctgggccccgcccttctgcaacacaccgggccacgggggcagtatcgacagtgggcctatgccccctgagagtgtgggtcctgtggtagctggagtgttggtggccatcttggtgctggcggtcctcatgctgatgtactactgctgcagacagaacaacaaactaggccaactcaagccctcagctctcccttccaagctgaggcaacagttcagttgtcccttcagggtttctcagaacagcgggactggtcatgccaacccaactttcaagctgcagacgccccagggcaagcgaaaggtgatcaacactccggaaatcctgcggaagccctcccagcctcctccccggccccctccagattatctgcgtggtgggtccccacctgcaccactgccagctcacctgagcagggctgctaggaactccccagggcccgggtctcaaatagagaggacggagtcgtccaggaggcctcctccaagccggccaattccccccgcaccaaattgcatcgtttcccaggacttctccaggcctcggccgccccagaaggcactcccggcaaacccagtgccaggccgcaggagcctccccaggccaggaggtgcatccccactgcggccccctggtgctggccctcagcagtcccggcctctggcagcacttgccccaaaggtgagtccacgggaagccctcaaggtgaaagctggtaccagagggctccaggggggcaggtgtagagttgagaaaacaaagcaattcatgcttcttgtggtctggactgaacttccagaacaaaagccaagggcaaaacattcatgtttcttggtgcccgcttgactgtggagttttggcttcatgtgaaaggtgattcttagaatcctgagctgtggtggcttcagtcctgcccctgcacctgacctggggagggaccctgagcaagtccctcttgagtctgtttcctcatttgtacagaggctatgatgagcagtagtaccagccccatcaggttgttgtgaagagcaaggaagtgcattagtagaagccacctggcctgcgggaggctgtgtacacttggcccctcctcgtacttcttctgtgtggctgacagtctcagtttgccagtcttggcagtcaggtcagaaagggatgaggtgaagaagctggctgaccatgctgtattcccacgaggcattgagaaaactatggactgtgctgctgccttagcagggaagggaa

SEQ ID NO: 104622 - DNA, 1847 bp, Homo sapiens
  Payload ID: 542
  Gene Symbol: ADAM19
  Gene Name: ADAM metallopeptidase domain 19
  ENST ID: ENST00000517374
  CDS Start-End: 1-1469
gtgactgtggagaagaagaggaatgtaacaacccctgctgcaatgcctctaattgtaccctgaggccgggggcggagtgtgctcacggctcctgctgccaccagtgtaagctgttggctcctgggaccctgtgccgcgagcaggccaggcagtgtgacctcccggagttctgtacgggcaagtctccccactgccctaccaacttctaccagatggatggtaccccctgtgagggcggccaggcctactgctacaacggcatgtgcctcacctaccaggagcagtgccagcagctgtggggacccggagcccgacctgcccctgacctctgcttcgagaaggtgaatgtggcaggagacacctttggaaactgtggaaaggacatgaatggtgaacacaggaagtgcaacatgagagatgcgaagtgtgggaagatccagtgtcagagctctgaggcccggcccctggagtccaacgcggtgcccattgacaccactatcatcatgaatgggaggcagatccagtgccggggcacccacgtctaccgaggtcctgaggaggagggtgacatgctggacccagggctggtgatgactggaaccaagtgtggctacaaccatatttgctttgaggggcagtgcaggaacacctccttctttgaaactgaaggctgtgggaagaagtgcaatggccatggggtctgtaacaacaaccagaactgccactgcctgccgggctgggccccgcccttctgcaacacaccgggccacgggggcagtatcgacagtgggcctatgccccctgagagtgtgggtcctgtggtagctggagtgttggtggccatcttggtgctggcggtcctcatgctgatgtactactgctgcagacagaacaacaaactaggccaactcaagccctcagctctcccttccaagctgaggcaacagttcagttgtcccttcagggtttctcagaacagcgggactggtcatgccaacccaactttcaagctgcagacgccccagggcaagcgaaaggtgatcaacactccggaaatcctgcggaagccctcccagcctcctccccggccccctccagattatctgcgtggtgggtccccacctgcaccactgccagctcacctgagcagggctgctaggaactccccagggcccgggtctcaaatagagaggacggagtcgtccaggaggcctcctccaagccggccaattccccccgcaccaaattgcatcgtttcccaggacttctccaggcctcggccgccccagaaggcactcccggcaaacccagtgccaggccgcaggagcctccccaggccaggaggtgcatccccactgcggccccctggtgctggccctcagcagtcccggcctctggcagcacttgccccaaagagggtatggaagacttgcaatttgaaaactggggaccagttccaaagtcagtaattgtgttaaccacgtgtataacagctctgctggacacccaagaaagccatgggaacgccaactggaaaggtccccttccccaggggagcctgcgaaggagaggttctgtagaatccaagcccacatttccaaagtcacccccaacgcgtcctctcacaccgtccactgtgcgtttgtatgtgtctgggatccagggcaatgtgaattttctttttatttgggagattgttcacggaaaacagatcttcttctctcttgtccacctattaattgtttacaatatttgtacatctatgcaaaatacttgaatgggccatggtgccttttttccttgttagtatttaattaaaaatgaattgtttgtcatttgcaatgtta

SEQ ID NO: 104623 - DNA, 2672 bp, Homo sapiens
  Payload ID: 543
  Gene Symbol: ADAM2
  Gene Name: ADAM metallopeptidase domain 2
  Uniprot ID: Q99965
  ENST ID: ENST00000265708
  CDS Start-End: 105-2312
gcctacctcttccaggctgcgtggccggggcgtcatctcgcgcttccaactgccctgtaaccaccaactgccattattccggctgggacccaggacttcaagccatgtggcgcgtcttgtttctgctcagcgggctcggcgggctgcggatggacagtaattttgatagtttacctgtgcaaattacagttccggagaaaatacggtcaataataaaggaaggaattgaatcgcaggcatcctacaaaattgtaattgaagggaaaccatatactgtgaatttaatgcaaaaaaactttttaccccataattttagagtttacagttatagtggcacaggaattatgaaaccacttgaccaagattttcagaatttctgccactaccaagggtatattgaaggttatccaaaatctgtggtgatggttagcacatgtactggactcaggggcgtactacagtttgaaaatgttagttatggaatagaacccctggagtcttcagttggctttgaacatgtaatttaccaagtaaaacataagaaagcagatgtttccttatataatgagaaggatattgaatcaagagatctgtcctttaaattacaaagcgtagagccacagcaagattttgcaaagtatatagaaatgcatgttatagttgaaaaacaattgtataatcatatggggtctgatacaactgttgtcgctcaaaaagttttccagttgattggattgacgaatgctatttttgtttcatttaatattacaattattctgtcttcattggagctttggatagatgaaaataaaattgcaaccactggagaagctaatgagttattacacacatttttaagatggaaaacatcttatcttgttttacgtcctcatgatgtggcatttttacttgtttacagagaaaagtcaaattatgttggtgcaacctttcaagggaagatgtgtgatgcaaactatgcaggaggtgttgttctgcaccccagaaccataagtctggaatcacttgcagttattttagctcaattattgagccttagtatggggatcacttatgatgacattaacaaatgccagtgctcaggagctgtctgcattatgaatccagaagcaattcatttcagtggtgtgaagatctttagtaactgcagcttcgaagactttgcacattttatttcaaagcagaagtcccagtgtcttcacaatcagcctcgcttagatccttttttcaaacagcaagcagtgtgtggtaatgcaaagctggaagcaggagaggagtgtgactgtgggactgaacaggattgtgcccttattggagaaacatgctgtgatattgccacatgtagatttaaagccggttcaaactgtgctgaaggaccatgctgcgaaaactgtctatttatgtcaaaagaaagaatgtgtaggccttcctttgaagaatgcgacctccctgaatattgcaatggatcatctgcatcatgcccagaaaaccactatgttcagactgggcatccgtgtggactgaatcaatggatctgtatagatggagtttgtatgagtggggataaacaatgtacagacacatttggcaaagaagtagagtttggcccttcagaatgttattctcaccttaattcaaagactgatgtatctggaaactgtggtataagtgattcaggatacacacagtgtgaagctgacaatctgcagtgcggaaaattaatatgtaaatatgtaggtaaatttttattacaaattccaagagccactattatttatgccaacataagtggacatctctgcattgctgtggaatttgccagtgatcatgcagacagccaaaagatgtggataaaagatggaacttcttgtggttcaaataaggtttgcaggaatcaaagatgtgtgagttcttcatacttgggttatgattgtactactgacaaatgcaatgatagaggtgtatgcaataacaaaaagcactgtcactgtagtgcttcatatttacctccagattgctcagttcaatcagatctatggcctggtgggagtattgacagtggcaattttccacctgtagctataccagccagactccctgaaaggcgctacattgagaacatttaccattccaaaccaatgagatggccatttttcttattcattcctttctttattattttctgtgtactgattgctataatggtgaaagttaatttccaaaggaaaaaatggagaactgaggactattcaagcgatgagcaacctgaaagtgagagtgaacctaaagggtagtctggacaacagagatgccatgatatcacttcttctagagtaattatctgtgatggatggacacaaaaaaatggaaagaaaagaatgtacattacctggtttcctgggattcaaacctgcatattgtgattttaatttgaccagaaaatatgatatatatgtataatttcacagataatttacttatttaaaaatgcatgataatgagttttacattacaaatttctgtttttttaaagttatcttacgctatttctgttggttagtagacactaattctgtcagtaggggcatggtataaggaaatatcataatgtaatgaggtggtactatgattaaaagccactgttacatttcaaa

SEQ ID NO: 104624 - DNA, 2535 bp, Homo sapiens
  Payload ID: 543
  Gene Symbol: ADAM2
  Gene Name: ADAM metallopeptidase domain 2
  Uniprot ID: Q99965
  ENST ID: ENST00000347580
  CDS Start-End: 25-2175
ggctgggacccaggacttcaagccatgtggcgcgtcttgtttctgctcagcgggctcggcgggctgcggatggacagtaattttgatagtttacctgtgcaaattacagttccggagaaaatacggtcaataataaaggaaggaattgaatcgcaggcatcctacaaaattgtaattgaagggaaaccatatactgtgaatttaatgcaaaaaaactttttaccccataattttagagtttacagttatagtggcacaggaattatgaaaccacttgaccaagattttcagaatttctgccactaccaagggtatattgaaggttatccaaaatctgtggtgatggttagcacatgtactggactcaggggcgtactacagtttgaaaatgttagttatggaatagaacccctggagtcttcagttggctttgaacatgtaatttaccaagtaaaacataagaaagcagatgtttccttatataatgagaaggatattgaatcaagagatctgtcctttaaattacaaagcgtagagtataatcatatggggtctgatacaactgttgtcgctcaaaaagttttccagttgattggattgacgaatgctatttttgtttcatttaatattacaattattctgtcttcattggagctttggatagatgaaaataaaattgcaaccactggagaagctaatgagttattacacacatttttaagatggaaaacatcttatcttgttttacgtcctcatgatgtggcatttttacttgtttacagagaaaagtcaaattatgttggtgcaacctttcaagggaagatgtgtgatgcaaactatgcaggaggtgttgttctgcaccccagaaccataagtctggaatcacttgcagttattttagctcaattattgagccttagtatggggatcacttatgatgacattaacaaatgccagtgctcaggagctgtctgcattatgaatccagaagcaattcatttcagtggtgtgaagatctttagtaactgcagcttcgaagactttgcacattttatttcaaagcagaagtcccagtgtcttcacaatcagcctcgcttagatccttttttcaaacagcaagcagtgtgtggtaatgcaaagctggaagcaggagaggagtgtgactgtgggactgaacaggattgtgcccttattggagaaacatgctgtgatattgccacatgtagatttaaagccggttcaaactgtgctgaaggaccatgctgcgaaaactgtctatttatgtcaaaagaaagaatgtgtaggccttcctttgaagaatgcgacctccctgaatattgcaatggatcatctgcatcatgcccagaaaaccactatgttcagactgggcatccgtgtggactgaatcaatggatctgtatagatggagtttgtatgagtggggataaacaatgtacagacacatttggcaaagaagtagagtttggcccttcagaatgttattctcaccttaattcaaagactgatgtatctggaaactgtggtataagtgattcaggatacacacagtgtgaagctgacaatctgcagtgcggaaaattaatatgtaaatatgtaggtaaatttttattacaaattccaagagccactattatttatgccaacataagtggacatctctgcattgctgtggaatttgccagtgatcatgcagacagccaaaagatgtggataaaagatggaacttcttgtggttcaaataaggtttgcaggaatcaaagatgtgtgagttcttcatacttgggttatgattgtactactgacaaatgcaatgatagaggtgtatgcaataacaaaaagcactgtcactgtagtgcttcatatttacctccagattgctcagttcaatcagatctatggcctggtgggagtattgacagtggcaattttccacctgtagctataccagccagactccctgaaaggcgctacattgagaacatttaccattccaaaccaatgagatggccatttttcttattcattcctttctttattattttctgtgtactgattgctataatggtgaaagttaatttccaaaggaaaaaatggagaactgaggactattcaagcgatgagcaacctgaaagtgagagtgaacctaaagggtagtctggacaacagagatgccatgatatcacttcttctagagtaattatctgtgatggatggacacaaaaaaatggaaagaaaagaatgtacattacctggtttcctgggattcaaacctgcatattgtgattttaatttgaccagaaaatatgatatatatgtataatttcacagataatttacttatttaaaaatgcatgataatgagttttacattacaaatttctgtttttttaaagttatcttacgctatttctgttggttagtagacactaattctgtcagtaggggcatggtataaggaaatatcataatgtaatgaggtggtactatgattaaaagccactgttacatttcaaa

SEQ ID NO: 104625 - DNA, 2125 bp, Homo sapiens
  Payload ID: 543
  Gene Symbol: ADAM2
  Gene Name: ADAM metallopeptidase domain 2
  ENST ID: ENST00000379853
  CDS Start-End: 26-1765
cggctgggacccaggacttcaagccatgtggcgcgtcttgtttctgctcagcgggctcggcgggctgcggatggacagtaattttgatagtttacctgtgcaaattacagttccggagaaaatacggtcaataataaaggaaggaattgaatcgcaggcatcctacaaaattgtaattgaagggaaaccatatactgtgaatttaatgcaaaaaaactttttaccccataattttagagtttacagttatagtggcacaggaattatgaaaccacttgaccaagattttcagaatttctgccactaccaagggtatattgaaggttatccaaaatctgtggtgatggttagcacatgtactggactcaggggcgtactacagtttgaaaatgttagttatggaatagaacccctggagtcttcagttggctttgaacatgtaatttaccaagtaaaacataagaaagcagatgtttccttatataatgagaaggatattgaatcaagagatctgtcctttaaattacaaagcgtagagcaccccagaaccataagtctggaatcacttgcagttattttagctcaattattgagccttagtatggggatcacttatgatgacattaacaaatgccagtgctcaggagctgtctgcattatgaatccagaagcaattcatttcagtggtgtgaagatctttagtaactgcagcttcgaagactttgcacattttatttcaaagcagaagtcccagtgtcttcacaatcagcctcgcttagatccttttttcaaacagcaagcagtgtgtggtaatgcaaagctggaagcaggagaggagtgtgactgtgggactgaacaggattgtgcccttattggagaaacatgctgtgatattgccacatgtagatttaaagccggttcaaactgtgctgaaggaccatgctgcgaaaactgtctatttatgtcaaaagaaagaatgtgtaggccttcctttgaagaatgcgacctccctgaatattgcaatggatcatctgcatcatgcccagaaaaccactatgttcagactgggcatccgtgtggactgaatcaatggatctgtatagatggagtttgtatgagtggggataaacaatgtacagacacatttggcaaagaagtagagtttggcccttcagaatgttattctcaccttaattcaaagactgatgtatctggaaactgtggtataagtgattcaggatacacacagtgtgaagctgatggacatctctgcattgctgtggaatttgccagtgatcatgcagacagccaaaagatgtggataaaagatggaacttcttgtggttcaaataaggtttgcaggaatcaaagatgtgtgagttcttcatacttgggttatgattgtactactgacaaatgcaatgatagaggtgtatgcaataacaaaaagcactgtcactgtagtgcttcatatttacctccagattgctcagttcaatcagatctatggcctggtgggagtattgacagtggcaattttccacctgtagctataccagccagactccctgaaaggcgctacattgagaacatttaccattccaaaccaatgagatggccatttttcttattcattcctttctttattattttctgtgtactgattgctataatggtgaaagttaatttccaaaggaaaaaatggagaactgaggactattcaagcgatgagcaacctgaaagtgagagtgaacctaaagggtagtctggacaacagagatgccatgatatcacttcttctagagtaattatctgtgatggatggacacaaaaaaatggaaagaaaagaatgtacattacctggtttcctgggattcaaacctgcatattgtgattttaatttgaccagaaaatatgatatatatgtataatttcacagataatttacttatttaaaaatgcatgataatgagttttacattacaaatttctgtttttttaaagttatcttacgctatttctgttggttagtagacactaattctgtcagtaggggcatggtataaggaaatatcataatgtaatgaggtggtactatgattaaaagccactgttacatttcaaa

SEQ ID NO: 104626 - DNA, 2125 bp, Homo sapiens
  Payload ID: 543
  Gene Symbol: ADAM2
  Gene Name: ADAM metallopeptidase domain 2
  ENST ID: ENST00000521880
  CDS Start-End: 43-2061
accaactgccattattccggctgggacccaggacttcaagccatgtggcgcgtcttgtttctgctcagcgggctcggcgggctgcggatggacagtaattttgatagtttacctgtgcaaattacagttccggagaaaatacggtcaataataaaggaaggaattgaatcgcaggcatcctacaaaattgtaattgaagggaaaccatatactgtgaatttaatgcaaaaaaactttttaccccataattttagagtttacagttatagtggcacaggaattatgaaaccacttgaccaagattttcagaatttctgccactaccaagggtatattgaaggttatccaaaatctgtggtgatggttagcacatgtactggactcaggggcgtactacagtttgaaaatgttagttatggaatagaacccctggagtcttcagttggctttgaacatgtaatttaccaagtaaaacataagaaagcagatgtttccttatataatgagaaggatattgaatcaagagatctgtcctttaaattacaaagcgtagagccacagcaagattttgcaaagtatatagaaatgcatgttatagttgaaaaacaattgtataatcatatggggtctgatacaactgttgtcgctcaaaaagttttccagttgattggattgacgaatgctatttttgtttcatttaatattacaattattctgtcttcattggagctttggatagatgaaaataaaattgcaaccactggagaagctaatgagttattacacacatttttaagatggaaaacatcttatcttgttttacgtcctcatgatgtggcatttttacttgtttacagagaaaagtcaaattatgttggtgcaacctttcaagggaagatgtgtgatgcaaactatgcaggaggtgttgttctgcaccccagaaccataagtctggaatcacttgcagttattttagctcaattattgagccttagtatggggatcacttatgatgacattaacaaatgccagtgctcaggagctgtctgcattatgaatccagaagcaattcatttcagtggtgtgaagatctttagtaactgcagcttcgaagactttgcacattttatttcaaagcagaagtcccagtgtcttcacaatcagcctcgcttagatccttttttcaaacagcaagcagtgtgtggtaatgcaaagctggaagcaggagaggagtgtgactgtgggactgaacaggattgtgcccttattggagaaacatgctgtgatattgccacatgtagatttaaagccggttcaaactgtgctgaaggaccatgctgcgaaaactgtctatttatgtcaaaagaaagaatgtgtaggccttcctttgaagaatgcgacctccctgaatattgcaatggatcatctgcatcatgcccagaaaaccactatgttcagactgggcatccgtgtggactgaatcaatggatctgtatagatggagtttgtatgagtggggataaacaatgtacagacacatttggcaaagaagtagagtttggcccttcagaatgttattctcaccttaattcaaagactgatgtatctggaaactgtggtataagtgattcaggatacacacagtgtgaagtttgcaggaatcaaagatgtgtgagttcttcatacttgggttatgattgtactactgacaaatgcaatgatagaggtgtatgcaataacaaaaagcactgtcactgtagtgcttcatatttacctccagattgctcagttcaatcagatctatggcctggtgggagtattgacagtggcaattttccacctgtagctataccagccagactccctgaaaggcgctacattgagaacatttaccattccaaaccaatgagatggccatttttcttattcattcctttctttattattttctgtgtactgattgctataatggtgaaagttaatttccaaaggaaaaaatggagaactgaggactattcaagcgatgagcaacctgaaagtgagagtgaacctaaagggtagtctggacaacagagatgccatgatatcacttcttctagagtaattatctgtgatggatggacac

SEQ ID NO: 104627 - DNA, 2480 bp, Homo sapiens
  Payload ID: 543
  Gene Symbol: ADAM2
  Gene Name: ADAM metallopeptidase domain 2
  ENST ID: ENST00000611998
  CDS Start-End: 105-2123
gcctacctcttccaggctgcgtggccggggcgtcatctcgcgcttccaactgccctgtaaccaccaactgccattattccggctgggacccaggacttcaagccatgtggcgcgtcttgtttctgctcagcgggctcggcgggctgcggatggacagtaattttgatagtttacctgtgcaaattacagttccggagaaaatacggtcaataataaaggaaggaattgaatcgcaggcatcctacaaaattgtaattgaagggaaaccatatactgtgaatttaatgcaaaaaaactttttaccccataattttagagtttacagttatagtggcacaggaattatgaaaccacttgaccaagattttcagaatttctgccactaccaagggtatattgaaggttatccaaaatctgtggtgatggttagcacatgtactggactcaggggcgtactacagtttgaaaatgttagttatggaatagaacccctggagtcttcagttggctttgaacatgtaatttaccaagtaaaacataagaaagcagatgtttccttatataatgagaaggatattgaatcaagagatctgtcctttaaattacaaagcgtagagccacagcaagattttgcaaagtatatagaaatgcatgttatagttgaaaaacaattgtataatcatatggggtctgatacaactgttgtcgctcaaaaagttttccagttgattggattgacgaatgctatttttgtttcatttaatattacaattattctgtcttcattggagctttggatagatgaaaataaaattgcaaccactggagaagctaatgagttattacacacatttttaagatggaaaacatcttatcttgttttacgtcctcatgatgtggcatttttacttgtttacagagaaaagtcaaattatgttggtgcaacctttcaagggaagatgtgtgatgcaaactatgcaggaggtgttgttctgcaccccagaaccataagtctggaatcacttgcagttattttagctcaattattgagccttagtatggggatcacttatgatgacattaacaaatgccagtgctcaggagctgtctgcattatgaatccagaagcaattcatttcagtggtgtgaagatctttagtaactgcagcttcgaagactttgcacattttatttcaaagcagaagtcccagtgtcttcacaatcagcctcgcttagatccttttttcaaacagcaagcagtgtgtggtaatgcaaagctggaagcaggagaggagtgtgactgtgggactgaacaggattgtgcccttattggagaaacatgctgtgatattgccacatgtagatttaaagccggttcaaactgtgctgaaggaccatgctgcgaaaactgtctatttatgtcaaaagaaagaatgtgtaggccttcctttgaagaatgcgacctccctgaatattgcaatggatcatctgcatcatgcccagaaaaccactatgttcagactgggcatccgtgtggactgaatcaatggatctgtatagatggagtttgtatgagtggggataaacaatgtacagacacatttggcaaagaagtagagtttggcccttcagaatgttattctcaccttaattcaaagactgatgtatctggaaactgtggtataagtgattcaggatacacacagtgtgaagtttgcaggaatcaaagatgtgtgagttcttcatacttgggttatgattgtactactgacaaatgcaatgatagaggtgtatgcaataacaaaaagcactgtcactgtagtgcttcatatttacctccagattgctcagttcaatcagatctatggcctggtgggagtattgacagtggcaattttccacctgtagctataccagccagactccctgaaaggcgctacattgagaacatttaccattccaaaccaatgagatggccatttttcttattcattcctttctttattattttctgtgtactgattgctataatggtgaaagttaatttccaaaggaaaaaatggagaactgaggactattcaagcgatgagcaacctgaaagtgagagtgaacctaaagggtagtctggacaacagagatgccatgatatcacttcttctagagtaattatctgtgatggatggacacaaaaaaatggaaagaaaagaatgtacattacctggtttcctgggattcaaacctgcatattgtgattttaatttgaccagaaaatatgatatatatgtataatttcacagataatttacttatttaaaaatgcatgataatgagttttacattacaaatttctgtttttttaaagttatcttacgctatttctgttggttagtagacactaattctgtcagtaggggcatggtataaggaaatatcataatgtaatgaggtggtactatgattaaaagccactgttacatttc

SEQ ID NO: 104628 - DNA, 2125 bp, Homo sapiens; identical to SEQ ID NO: 104625
  Payload ID: 543
  Gene Symbol: ADAM2
  Gene Name: ADAM metallopeptidase domain 2
  ENST ID: ENST00000619491
  CDS Start-End: 26-1765

SEQ ID NO: 104629 - DNA, 2672 bp, Homo sapiens; identical to SEQ ID NO: 104623
  Payload ID: 543
  Gene Symbol: ADAM2
  Gene Name: ADAM metallopeptidase domain 2
  Uniprot ID: Q99965
  ENST ID: ENST00000620181
  CDS Start-End: 105-2312

SEQ ID NO: 104630 - DNA, 2480 bp, Homo sapiens; identical to SEQ ID NO: 104627
  Payload ID: 543
  Gene Symbol: ADAM2
  Gene Name: ADAM metallopeptidase domain 2
  ENST ID: ENST00000622267
  CDS Start-End: 105-2123

SEQ ID NO: 104631 - DNA, 2535 bp, Homo sapiens; identical to SEQ ID NO: 104624
  Payload ID: 543
  Gene Symbol: ADAM2
  Gene Name: ADAM metallopeptidase domain 2
  Uniprot ID: Q99965
  ENST ID: ENST00000613160
  CDS Start-End: 25-2175

SEQ ID NO: 104632 - DNA, 2125 bp, Homo sapiens; identical to SEQ ID NO: 104626
  Payload ID: 543
  Gene Symbol: ADAM2
  Gene Name: ADAM metallopeptidase domain 2
  ENST ID: ENST00000633755
  CDS Start-End: 43-2061

SEQ ID NO: 104633 - DNA, 2795 bp, Homo sapiens
  Payload ID: 544
  Gene Symbol: ADAM20
  Gene Name: ADAM metallopeptidase domain 20
  Uniprot ID: O43506
  ENST ID: ENST00000256389
  CDS Start-End: 246-2576
gggagttcagcagtgtgtttaagactagggtcatgcccacatcaatctcagattcccattttatctttcttttttggtatcactcctagtaccaagtcttgtgtctgtcaatatcctgtccaaaaaagaaaaacacaccaaggaaaattaatataggaaaaatttaaaaagttattagaggactgaaaatataaaaatggaacactgaaagacacagagtttttattttcagcactgcagctctgatggtccagctccaccaggacacagatccccagatccctaaaggtcagccatgcaccctgaacagctcagagggaggagccagaccagcagtgcctcacaccttgttctcttctgctctagacagatggctccataatgacagcttcataatggcagtgggtgagcccctggtgcacatcagggtcactcttctgctgctctggtttgggatgtttttgtctatttctggccactctcaggccaggccctcccagtatttcacttctccagaagtggtgatccctttgaaggtgatcagcaggggcagaggtgcaaaggctcctggatggctctcctatagcctgcggtttgggggacagagatacattgtccacatgagggtaaataagctgttgtttgctgcacaccttcctgtgttcacctacacagagcagcatgccctgctccaggatcagcccttcatccaggatgactgctactaccatggttatgtggagggggtccctgagtccttggttgcccttagtacctgttctgggggctttcttggaatgctacagataaatgaccttgtttatgaaatcaagccaattagtgtttctgccacatttgaacacctagtatataagatagacagtgatgatacacagtttccacctatgagatgtgggttaacagaagagaaaatagcacaccagatggagttgcaattgtcatataatttcactctgaagcaaagttcttttgtgggctggtggacccatcagcggtttgttgagctggtagtggtcgtggataatattagatatcttttctctcaaagtaatgcaacaacagtgcagcatgaagtatttaacgttgtcaatatagtggattccttctatcatcctttggaggttgatgtaattttgactggaattgatatatggactgcatcaaatccacttcctaccagtggagacctagataatgttttagaggacttttctatttggaagaattataaccttaataatcgactacaacatgatgttgcacatcttttcataaaagacacacaaggcatgaagcttggtgttgcctatgttaaaggaatatgccagaatccttttaatactggagttgatgtttttgaagacaacaggttggtcgtttttgcaattactttgggccacgagcttggtcataatttgggtatgcaacatgacacccagtggtgtgtgtgcgagctacagtggtgcataatgcatgcctatagaaaggtgacaactaaatttagcaactgcagttatgcccaatattgggacagtactatcagtagtggattatgtattcaaccgcctccatatccagggaatatatttagactgaagtactgtgggaatctagtggttgaagaaggggaggaatgtgactgtggaaccatacggcagtgtgcaaaagatccctgttgtctgttaaactgtactctacatcctggggctgcttgtgcttttggaatatgttgcaaagactgcaaatttctgccatcaggaactttatgtagacaacaagttggtgaatgtgaccttccagagtggtgcaatgggacatcccatcaatgcccagatgatgtgtatgtgcaggacgggatctcctgtaatgtgaatgccttctgctatgaaaagacgtgtaataaccatgatatacaatgtaaagagatttttggccaagatgcaaggagtgcatctcagagttgctaccaagaaatcaacacccaaggaaaccgtttcggtcactgtggtattgtaggcacaacatatgtaaaatgttggacccctgatatcatgtgtgggagggttcagtgtgaaaatgtgggagtaattcccaatctgatagagcattctacagtgcagcagtttcacctcaatgacaccacttgctggggcactgattatcatttagggatggctatacctgatattggtgaggtgaaagatggcacagtatgtggtccagaaaagatctgcatccgtaagaagtgtgccagtatggttcatctgtcacaagcctgtcagcctaagacctgcaacatgaggggaatctgcaacaacaaacaacactgtcactgcaaccatgaatgggcacccccatactgcaaggacaaaggctatggaggtagtgctgatagtggcccacctcctaagaacaacatggaaggattaaatgtgatgggaaagttgcgttacctgtcactattgtgccttcttcctttggttgcttttttattattttgcttacatgtgctttttaagaaacgcacaaaaagtaaagaagatgaagaaggataagagaaatgggaaaaagaaggagactaaactttatacttcatttttaatatccaattttttaatagaaaaatatgaagccatgtctcactgtttaaataaaacttcatggacatttcatgtcaggattgcaagcattagctatcacagcaaaggattcctagcctattcttacttactctacagtgtcttaagcaatattaaaggttccttttcccagaa

SEQ ID NO: 104634 - DNA, 2658 bp, Homo sapiens
  Payload ID: 545
  Gene Symbol: ADAM21
  Gene Name: ADAM metallopeptidase domain 21
  Uniprot ID: Q9UKJ8
  ENST ID: ENST00000603540
  CDS Start-End: 259-2427
ggcttatgtttccctttgttctgtggcctcagctacaaaccattgataaagcatggtataaaccatctagacagaaatggccatggaaactactgtttcttctgatgcactgcagttctgatctaactctgccaggacacagatccacagggtcagccctgcatcctgagcagcttagagggagaagccagaccagcagtgcctcacaccttgtcctcttctgctctggacagatggctccataacgacagcttcataatggcagtggatgggaccctcgtgtacatcagagtcactcttctgctgctctggcttggggtatttttgtctatttccggctactgtcaggctgggccctcccagcatttcacttccccggaagtggtgatccccttgaaggtgatcagcaggggcagaagtgcaaaggctcctggatggctctcctatagtctgcggtttgggggccagaaacacgttgttcatatgagggtcaagaagctcttagtttctagacacctcccagtgttcacctacacagatgaccgtgcactcctggaggatcagctcttcatcccagatgactgttactatcatggttacgtggaggcagcccctgagtctctggttgtgttcagtgcttgttttgggggctttcgaggagtattaaaaataagtggcctcacttatgaaattgaacccatcaggcactctgccacatttgaacacctggtttataagataaacagtaatgagacacaattcccagctatgagatgtggcttaacagagaaggaagtagcacgccaacagttggaatttgaagaggctgagaactcagctctggaaccaaaatctgctggtgactggtggactcatgcatggtttctggagctagttgttgtggtgaaccatgatttcttcatttactctcaaagcaacatctcaaaggtgcaagaggatgtatttcttgttgtcaacatagtggattccatgtataagcagttaggtacttacataattttgattggaattgaaatttggaatcaaggaaatgttttcccaatgacaagcatagaacaggtcctgaacgatttctctcaatggaaacaaatcagtctttcccagctacagcatgatgctgcacatatgttcataaaaaattcacttataagtatacttggcctagcctatgttgcaggaatatgtcgtccacctattgattgtggagttgataattttcaaggagatacctggtctctttttgccaacactgtggcccatgagttaggtcatacgttaggtatgcagcatgatgaagaattctgtttttgtggggaaagaggttgcatcatgaatacttttagagtgccagcagagaaattcaccaattgcagttacgctgattttatgaagaccaccttaaaccagggatcatgtctgcataatcctccaagattgggggaaatctttatgctaaagcgctgtgggaatggtgtggttgaaagagaagagcagtgtgactgtggatccgtacagcagtgtgaacaagacgcctgttgtctgttgaactgcactctaaggcctggggctgcctgtgcttttgggctttgttgcaaagactgcaagttcatgccatcaggggaactctgtagacaagaggtcaatgaatgtgaccttccagaatggtgcaatggaacatctcatcagtgtccagaagatagatatgtgcaggacgggatcccctgtagtgacagtgcctactgctatcaaaagaggtgtaataaccatgaccagcattgcagggagatttttggtaaagatgcaaaaagtgcatctcagaattgctataaagaaatcaattctcagggaaaccgttttggtcactgtggtataaatggcacaacatacctaaaatgtcatatctctgatgtcttttgtgggagagttcaatgtgagaatgtgagagacattcctcttctccaagatcattttactttgcagcacactcatatcaatggtgtcacctgctggggtattgactatcatttaaggatgaacatatctgacattggtgaagtgaaagatggtactgtgtgtggcccaggaaagatctgcatccataagaagtgtgtcagtctgtctgtcttgtcacatgtctgccttcctgagacctgcaatatgaaggggatctgcaataacaaacatcactgccactgtggctatgggtggtccccaccctactgccagcacagaggctatgggggcagtattgacagtggcccagcatctgcaaagagaggagtttttttgccgctgattgtgattccttctttgtctgttttgactttcctgtttactgtcgggcttcttatgtatctacgacaatgttctggtcccaaagaaactaaggctcattcatcaggttaagaaaatgtctctaacttaatattccatgcattagtacactttagtctcttggcagtagaaacattagtacatccctgaaactgagcacatttctgaccatttccagaaagctgcaaagatcttcccttacattagtaccacaaacattgtcattaagttcaagttattcttaacatgtttctatctattgtttattgttttaagcagcaaataaagctacatccttccctc

SEQ ID NO: 104635 - DNA, 2891 bp, Homo sapiens
  Payload ID: 546
  Gene Symbol: ADAM22
  Gene Name: ADAM metallopeptidase domain 22
  Uniprot ID: Q9P0K1
  ENST ID: ENST00000265727
  CDS Start-End: 80-2800
gcggagcgagggaaacggactcggcggcgccggcatgaggagctgagcgtctcgggcgaggcgggctgacggcagcaccatgcaggcggcagtggctgtgtccgtgcccttcttgctgctctgtgtcctggggacctgccctccggcgcgctgcggccaggcaggagacgcctcattgatggagctagagaagaggaaggaaaaccgcttcgtggagcgccagagcatcgtgccactgcgcctcatctaccgctcgggcggcgaagacgaaagtcggcacgacgcgctcgacacgcgggtgcggggcgacctcggtggcccgcagttgactcatgttgaccaagcaagcttccaggttgatgcctttggaacgtcattcattctcgatgtcgtgctaaatcatgatttgctgtcctctgaatacatagagagacacattgaacatggaggcaagactgtggaagttaaaggaggagagcactgttactaccagggccatatccgaggaaaccctgactcatttgttgcattgtcaacatgccacggacttcatgggatgttctatgacgggaaccacacatatctcattgagccagaagaaaatgacactactcaagaggatttccattttcattcagtttacaaatccagactgtttgaattttccttggatgatcttccatctgaatttcagcaagtaaacattactccatcaaaatttattttgaagccaagaccaaaaaggagtaaacggcagcttcgtcgatatcctcgtaatgtagaagaagaaaccaaatacattgaactgatgattgtgaatgatcaccttatgtttaaaaaacatcggctttccgttgtacataccaatacctatgcgaaatctgtggtgaacatggcagatttaatatataaagaccaacttaagaccaggatagtattggttgctatggaaacctgggcgactgacaacaagtttgccatatctgaaaatccattgatcaccctacgtgagtttatgaaatacaggagggattttatcaaagagaaaagtgatgcagttcaccttttttcgggaagtcaatttgagagtagccggagcggggcagcttatattggtgggatttgctcgttgctgaaaggaggaggcgtgaatgaatttgggaaaactgatttaatggctgttacacttgcccagtcattagcccataatattggtattatctcagacaaaagaaagttagcaagtggtgaatgtaaatgcgaggacacgtggtccgggtgcataatgggagacactggctattatcttcctaaaaagttcacccagtgtaatattgaagagtatcatgacttcctgaatagtggaggtggtgcctgccttttcaacaaaccttctaagcttcttgatcctcctgagtgtggcaatggcttcattgaaactggagaggagtgtgattgtggaaccccggccgaatgtgtccttgaaggagcagagtgttgtaagaaatgcaccttgactcaagactctcaatgcagtgacggtctttgctgtaaaaagtgcaagtttcagcctatgggcactgtgtgccgagaagcagtaaatgattgtgatattcgtgaaacgtgctcaggaaattcaagccagtgtgcccctaatattcataaaatggatggatattcatgtgatggtgttcagggaatttgctttggaggaagatgcaaaaccagagatagacaatgcaaatacatttgggggcaaaaggtgacagcatcagacaaatattgctatgagaaactgaatattgaagggacggagaagggtaactgtgggaaagacaaagacacatggatacagtgcaacaaacgggatgtgctttgtggttaccttttgtgtaccaatattggcaatatcccaaggcttggagaactcgatggtgaaatcacatctactttagttgtgcagcaaggaagaacattaaactgcagtggtgggcatgttaagcttgaagaagatgtagatcttggctatgtggaagatgggacaccttgtggtccccaaatgatgtgcttagaacacaggtgtcttcctgtggcttctttcaactttagtacttgcttgagcagtaaagaaggcactatttgctcaggaaatggagtttgcagtaatgagctgaagtgtgtgtgtaacagacactggataggttctgattgcaacacttacttccctcacaatgatgatgcaaagactggtatcactctgtctggcaatggtgttgctggcaccaatatcataataggcataattgctggcaccattttagtgctggccctcatattaggaataactgcgtggggttataaaaactatcgagaacagagacagttaccccagggagattatgtaaaaaagcctggagatggtgactctttttatagcgacattcctcccggagtcagcacaaactcagcatctagttctaagaagaggtcaaatgggctctctcattcttggagtgaaaggattccagacacaaaacatatttcagacatctgtgaaaatgggcgacctcgaagtaactcttggcaaggtaacctgggaggcaacaaaaagaaaatcagaggcaaaagatttagacctcggtctaattcaactgagactttatctcctgccaagtctccttcttcatcaactgggtctattgcctccagcagaaaatacccttacccaatgcctccacttcctgatgaggacaagaaagtgaaccgacaaagtgccaggctatgggagacatccatttaagatcaactgtttacatgtgatacatcgaaaactgtttacttcaacttttatagaaacccaggctcatggaatcactgcaaatctatctgct

SEQ ID NO: 104636 - DNA, 2784 bp, Homo sapiens
  Payload ID: 546
  Gene Symbol: ADAM22
  Gene Name: ADAM metallopeptidase domain 22
  Uniprot ID: Q9P0K1
  ENST ID: ENST00000398201
  CDS Start-End: 120-2699
gccggggctgggtggaggtggccgcggggaccccgggggcgcggagcgagggaaacggactcggcggcgccggcatgaggagctgagcgtctcgggcgaggcgggctgacggcagcaccatgcaggcggcagtggctgtgtccgtgcccttcttgctgctctgtgtcctggggacctgccctccggcgcgctgcggccaggcaggagacgcctcattgatggagctagagaagaggaaggaaaaccgcttcgtggagcgccagagcatcgtgccactgcgcctcatctaccgctcgggcggcgaagacgaaagtcggcacgacgcgctcgacacgcgggtgcggggcgacctcggtggcccgcagttgactcatgttgaccaagcaagcttccaggttgatgcctttggaacgtcattcattctcgatgtcgtgctaaatcatgatttgctgtcctctgaatacatagagagacacattgaacatggaggcaagactgtggaagttaaaggaggagagcactgttactaccagggccatatccgaggaaaccctgactcatttgttgcattgtcaacatgccacggacttcatgggatgttctatgacgggaaccacacatatctcattgagccagaagaaaatgacactactcaagaggatttccattttcattcagtttacaaatccagactgtttgaattttccttggatgatcttccatctgaatttcagcaagtaaacattactccatcaaaatttattttgaagccaagaccaaaaaggagtaaacggcagcttcgtcgatatcctcgtaatgtagaagaagaaaccaaatacattgaactgatgattgtgaatgatcaccttatgtttaaaaaacatcggctttccgttgtacataccaatacctatgcgaaatctgtggtgaacatggcagatttaatatataaagaccaacttaagaccaggatagtattggttgctatggaaacctgggcgactgacaacaagtttgccatatctgaaaatccattgatcaccctacgtgagtttatgaaatacaggagggattttatcaaagagaaaagtgatgcagttcaccttttttcgggaagtcaatttgagagtagccggagcggggcagcttatattggtgggatttgctcgttgctgaaaggaggaggcgtgaatgaatttgggaaaactgatttaatggctgttacacttgcccagtcattagcccataatattggtattatctcagacaaaagaaagttagcaagtggtgaatgtaaatgcgaggacacgtggtccgggtgcataatgggagacactggctattatcttcctaaaaagttcacccagtgtaatattgaagagtatcatgacttcctgaatagtggaggtggtgcctgccttttcaacaaaccttctaagcttcttgatcctcctgagtgtggcaatggcttcattgaaactggagaggagtgtgattgtggaaccccggccgaatgtgtccttgaaggagcagagtgttgtaagaaatgcaccttgactcaagactctcaatgcagtgacggtctttgctgtaaaaagtgcaagtttcagcctatgggcactgtgtgccgagaagcagtaaatgattgtgatattcgtgaaacgtgctcaggaaattcaagccagtgtgcccctaatattcataaaatggatggatattcatgtgatggtgttcagggaatttgctttggaggaagatgcaaaaccagagatagacaatgcaaatacatttgggggcaaaaggtgacagcatcagacaaatattgctatgagaaactgaatattgaagggacggagaagggtaactgtgggaaagacaaagacacatggatacagtgcaacaaacgggatgtgctttgtggttaccttttgtgtaccaatattggcaatatcccaaggcttggagaactcgatggtgaaatcacatctactttagttgtgcagcaaggaagaacattaaactgcagtggtgggcatgttaagcttgaagaagatgtagatcttggctatgtggaagatgggacaccttgtggtccccaaatgatgtgcttagaacacaggtgtcttcctgtggcttctttcaactttagtacttgcttgagcagtaaagaaggcactatttgctcaggaaatggagtttgcagtaatgagctgaagtgtgtgtgtaacagacactggataggttctgattgcaacacttacttccctcacaatgatgatgcaaagactggtatcactctgtctggcaatggtgttgctggcaccaatatcataataggcataattgctggcaccattttagtgctggccctcatattaggaataactgcgtggggttataaaaactatcgagaacagagacagttaccccagggagattatgtaaaaaagcctggagatggtgactctttttatagcgacattcctcccggagtcagcacaaactcagcatctagttctaagaagaggtcaaatgggctctctcattcttggagtgaaaggattccagacacaaaacatatttcagacatctgtgaaaatgggcgacctcgaagtaactcttggcaaggtaacctgggaggcaacaaaaagaaaatcagaggcaaaagatttagacctcggtctaattcaactgagtaagtctgaacctctaatggaaaaaggcactccaaggtcctgtgcaaatagtgtcaaaagtaaattaagcagatagtcaaagaactgt

SEQ ID NO: 104637 - DNA, 2697 bp, Homo sapiens
  Payload ID: 546
  Gene Symbol: ADAM22
  Gene Name: ADAM metallopeptidase domain 22
  ENST ID: ENST00000398203
  CDS Start-End: 285-2697
aaagcctgtttttctccttctgaagaggaatggggagaatgggaaaggggtgccctgcttctgggccccgctcctggttgctctcggatgagctggtccaaggctctcgggctggtgtctctgcgtccttcccagttgggttccgagagggagggggcggtggggattttcgtaggggagacgtaggactgcaggatggaggagtgagggtcagggtcattattttcgccttttctctccactccctcctttcccggttcctgcctggaggagacgcctcattgatggagctagagaagaggaaggaaaaccgcttcgtggagcgccagagcatcgtgccactgcgcctcatctaccgctcgggcggcgaagacgaaagtcggcacgacgcgctcgacacgcgggtgcggggcgacctcggtggcccgcagttgactcatgttgaccaagcaagcttccaggttgatgcctttggaacgtcattcattctcgatgtcgtgctaaatcatgatttgctgtcctctgaatacatagagagacacattgaacatggaggcaagactgtggaagttaaaggaggagagcactgttactaccagggccatatccgaggaaaccctgactcatttgttgcattgtcaacatgccacggacttcatgggatgttctatgacgggaaccacacatatctcattgagccagaagaaaatgacactactcaagaggatttccattttcattcagtttacaaatccagactgtttgaattttccttggatgatcttccatctgaatttcagcaagtaaacattactccatcaaaatttattttgaagccaagaccaaaaaggagtaaacggcagcttcgtcgatatcctcgtaatgtagaagaagaaaccaaatacattgaactgatgattgtgaatgatcaccttatgtttaaaaaacatcggctttccgttgtacataccaatacctatgcgaaatctgtggtgaacatggcagatttaatatataaagaccaacttaagaccaggatagtattggttgctatggaaacctgggcgactgacaacaagtttgccatatctgaaaatccattgatcaccctacgtgagtttatgaaatacaggagggattttatcaaagagaaaagtgatgcagttcaccttttttcgggaagtcaatttgagagtagccggagcggggcagcttatattggtgggatttgctcgttgctgaaaggaggaggcgtgaatgaatttgggaaaactgatttaatggctgttacacttgcccagtcattagcccataatattggtattatctcagacaaaagaaagttagcaagtggtgaatgtaaatgcgaggacacgtggtccgggtgcataatgggagacactggctattatcttcctaaaaagttcacccagtgtaatattgaagagtatcatgacttcctgaatagtggaggtggtgcctgccttttcaacaaaccttctaagcttcttgatcctcctgagtgtggcaatggcttcattgaaactggagaggagtgtgattgtggaaccccggccgaatgtgtccttgaaggagcagagtgttgtaagaaatgcaccttgactcaagactctcaatgcagtgacggtctttgctgtaaaaagtgcaagtttcagcctatgggcactgtgtgccgagaagcagtaaatgattgtgatattcgtgaaacgtgctcaggaaattcaagccagtgtgcccctaatattcataaaatggatggatattcatgtgatggtgttcagggaatttgctttggaggaagatgcaaaaccagagatagacaatgcaaatacatttgggggcaaaaggtgacagcatcagacaaatattgctatgagaaactgaatattgaagggacggagaagggtaactgtgggaaagacaaagacacatggatacagtgcaacaaacgggatgtgctttgtggttaccttttgtgtaccaatattggcaatatcccaaggcttggagaactcgatggtgaaatcacatctactttagttgtgcagcaaggaagaacattaaactgcagtggtgggcatgttaagcttgaagaagatgtagatcttggctatgtggaagatgggacaccttgtggtccccaaatgatgtgcttagaacacaggtgtcttcctgtggcttctttcaactttagtacttgcttgagcagtaaagaaggcactatttgctcaggaaatggagtttgcagtaatgagctgaagtgtgtgtgtaacagacactggataggttctgattgcaacacttacttccctcacaatgatgatgcaaagactggtatcactctgtctggcaatggtgttgctggcaccaatatcataataggcataattgctggcaccattttagtgctggccctcatattaggaataactgcgtggggttataaaaactatcgagaacagagacagttaccccagggagattatgtaaaaaagcctggagatggtgactctttttatagcgacattcctcccggagtcagcacaaactcagcatctagttctaagaagaggtcaaatgggctctctcattcttggagtgaaaggattccagacacaaaacatatttcagacatctgtgaaaatgggcgacctcgaagtaactcttggcaaggta

SEQ ID NO: 104638 - DNA, 9334 bp, Homo sapiens
  Payload ID: 546
  Gene Symbol: ADAM22
  Gene Name: ADAM metallopeptidase domain 22
  Uniprot ID: Q9P0K1
  ENST ID: ENST00000398204
  CDS Start-End: 324-2936
cgggcgctcgctccctgccgagctcttgtcgcccgcccgagcctttgccaggggatgaggtgggaggcgctagaaaccacttagctacagccaaccgcccaatgcagcactcgctcgctccccccgccagcggaagcgtccgcgaagcacaatgcagcactgagccgcggtggaggttgcagcgccacggccgccgcagcaccggccggggctgggtggaggtggccgcggggaccccgggggcgcggagcgagggaaacggactcggcggcgccggcatgaggagctgagcgtctcgggcgaggcgggctgacggcagcaccatgcaggcggcagtggctgtgtccgtgcccttcttgctgctctgtgtcctggggacctgccctccggcgcgctgcggccaggcaggagacgcctcattgatggagctagagaagaggaaggaaaaccgcttcgtggagcgccagagcatcgtgccactgcgcctcatctaccgctcgggcggcgaagacgaaagtcggcacgacgcgctcgacacgcgggtgcggggcgacctcggtggcccgcagttgactcatgttgaccaagcaagcttccaggttgatgcctttggaacgtcattcattctcgatgtcgtgctaaatcatgatttgctgtcctctgaatacatagagagacacattgaacatggaggcaagactgtggaagttaaaggaggagagcactgttactaccagggccatatccgaggaaaccctgactcatttgttgcattgtcaacatgccacggacttcatgggatgttctatgacgggaaccacacatatctcattgagccagaagaaaatgacactactcaagaggatttccattttcattcagtttacaaatccagactgtttgaattttccttggatgatcttccatctgaatttcagcaagtaaacattactccatcaaaatttattttgaagccaagaccaaaaaggagtaaacggcagcttcgtcgatatcctcgtaatgtagaagaagaaaccaaatacattgaactgatgattgtgaatgatcaccttatgtttaaaaaacatcggctttccgttgtacataccaatacctatgcgaaatctgtggtgaacatggcagatttaatatataaagaccaacttaagaccaggatagtattggttgctatggaaacctgggcgactgacaacaagtttgccatatctgaaaatccattgatcaccctacgtgagtttatgaaatacaggagggattttatcaaagagaaaagtgatgcagttcaccttttttcgggaagtcaatttgagagtagccggagcggggcagcttatattggtgggatttgctcgttgctgaaaggaggaggcgtgaatgaatttgggaaaactgatttaatggctgttacacttgcccagtcattagcccataatattggtattatctcagacaaaagaaagttagcaagtggtgaatgtaaatgcgaggacacgtggtccgggtgcataatgggagacactggctattatcttcctaaaaagttcacccagtgtaatattgaagagtatcatgacttcctgaatagtggaggtggtgcctgccttttcaacaaaccttctaagcttcttgatcctcctgagtgtggcaatggcttcattgaaactggagaggagtgtgattgtggaaccccggccgaatgtgtccttgaaggagcagagtgttgtaagaaatgcaccttgactcaagactctcaatgcagtgacggtctttgctgtaaaaagtgcaagtttcagcctatgggcactgtgtgccgagaagcagtaaatgattgtgatattcgtgaaacgtgctcaggaaattcaagccagtgtgcccctaatattcataaaatggatggatattcatgtgatggtgttcagggaatttgctttggaggaagatgcaaaaccagagatagacaatgcaaatacatttgggggcaaaaggtgacagcatcagacaaatattgctatgagaaactgaatattgaagggacggagaagggtaactgtgggaaagacaaagacacatggatacagtgcaacaaacgggatgtgctttgtggttaccttttgtgtaccaatattggcaatatcccaaggcttggagaactcgatggtgaaatcacatctactttagttgtgcagcaaggaagaacattaaactgcagtggtgggcatgttaagcttgaagaagatgtagatcttggctatgtggaagatgggacaccttgtggtccccaaatgatgtgcttagaacacaggtgtcttcctgtggcttctttcaactttagtacttgcttgagcagtaaagaaggcactatttgctcaggaaatggagtttgcagtaatgagctgaagtgtgtgtgtaacagacactggataggttctgattgcaacacttacttccctcacaatgatgatgcaaagactggtatcactctgtctggcaatggtgttgctggcaccaatatcataataggcataattgctggcaccattttagtgctggccctcatattaggaataactgcgtggggttataaaaactatcgagaacagaggtcaaatgggctctctcattcttggagtgaaaggattccagacacaaaacatatttcagacatctgtgaaaatgggcgacctcgaagtaactcttggcaaggtaacctgggaggcaacaaaaagaaaatcagaggcaaaagatttagacctcggtctaattcaactgagactttatctcctgccaagtctccttcttcatcaactgggtctattgcctccagcagaaaatacccttacccaatgcctccacttcctgatgaggacaagaaagtgaaccgacaaagtgccaggctatgggagacatccatttaagatcaactgtttacatgtgatacatcgaaaactgtttacttcaacttttatagaaacccaggctcatggaatcactgcaaatctatctgctcttcagacaatacgaagaccctctgagatgctacagaggagaggaagcggagtttcacatctggttaccattttctttttgtcattggcttaggatttaactaaccatgaaaagaactactgaaatattacactataacatggaacaataaaggtactggtatgttaatggataatccgcatgacagataatatgtagaaatattcataaagttaactcacatgacccaaatgtagcaagtttcctaaggtacaatagtggattcagaacttgacgttctgaggcacatcctcactgtaaacagtaatgctatatgcatgaagcttctgtttattgttttccatatttaaggaaacaacatcccataatagaaatgagcatgcagggctaaggcatataggatttttctgcaggactttaaagctttgaaaggccaatatcccataggctaactttaaacatgtatttttatttttgttttgttttttacttttcatatttatattagcatacaaggacaattgtatatatgtaacatttttaaaattttaaaaaaatgcagctgttacacacaagtgtattttgccaaatgcctaaaaattccgtcacaatcacatcatcgtcatccatccagtgatcttcaaagactataagcaggtaatgtaaatatagtggtcaatgctgtaaatgtgtctctccataattcgtatttgtccaaaacatgtgatatccctttaacctgtgcacagtctggaggcagttttattgagtgagtagttgagtgagagaacaaaatgcccagcaaaacttctggcctccacagtttgctgatgcaggagcccactctgctgccgatgggctgctccctggaaatcatctatcccatccgtccatcccatctcatcccagtgagccagcccctcagcagtgtgtgctgctgagattaagcaagtgcaccaaagacacatgagacaacgtactgccagtgagctggtagcttctggtttgccaatactctaaccctttgtggcctgaagttttgttccttggcaaaactttgtagtcacccttatctgtgaaatgaatgacttgttttaacaaaaacaactttgacactgttgattaagaatatttgtcatcactgggatgtgaatcccaacaagtcattctgcactgactctgaagcaagatgacggaagattctactgtttgagttgagcagcttcaaccattcataaagggttaagttagatctaaaccacagagatgcagcatctgcgaagttacactaacagctggtgggggaaagaatctgatgctttgaaacatatatttttaatccataggaaaataagattctattttaaaagacccttctttaaaaccaaagtttgatagctgttataatggcagatctgtcattccaaaagaaagctagctaccctagtgaggctggagattgatgggctcaatcacatggtctgctctgaagtatacttctgatttcctcatttgctgtgtgttcttaagaggaatggaatctgcagacaggttttcagatatactctcttaaatttgatcctctcccatagtatccatggacaaaatccatatcatcttcatatgtaatcaatttgattacatatcatgcccaaactgaagggccgagttagaaggcagcattttatactgtgtgtttatgtcttctgtaatggacctctcttttgaaagtctttgaaatgtttggaaagcaatttaatgatccaaaattacataatgtaaaacagcatttttcatgacaggaagggatgtgattgttgatatgaccataaagcgatccatcaggccaaggtttgggtgagtgttgggcagtgttgccacatagctcaagccaagaacagaagggcagacagattgaaagatgtagcaaataaagtgactttttaccaagatcactgtaacgtgcactgaatgtttcctggtactgagtgtacaaaaggctaatgctataaggtttattttgactataaaagagtttatagatttgaatataaggtgcctcatgtaaatatgcttcctagttacaggtacacaaactctaatttgaaagaatccacaaatggctagctgagaagttaacagatctctatcattcgtctgtgtgtctttcttccctcacctatttttacatgaaattattatttcaaatgaaaatcatgatcatgtgccttttgggagacatggtttctctagaggtatatagtttgtaattacccgccttggtaataaccttcctgtggaactgactaaaaatttttgttttatttgtagagattatgatttgaggtatacagtaactttaatgttctattcttggaatctactctatctcccatgtttaaacattcttagagccatttgtgggattcattgacaaatttatagtctcaagggagagtttcaagaagtatctatatgtatactcatggttggggttctagaggcattacatctaaatatttatgacttttcatccaccgaggtaggtagcattaaatatacaagcacagcattatttctctttaaatatctattttggagagaaactttgaggccgtatcacagtttatatcatgcaactaatatttatatttcccaatccactacaaaatcattgctaagcagaagagagcagttatttggcctttatgttccattgtatgcctttttcccctcttccagttttatgcattgataagactacagattggcaccctgctgcctgagaagttccatttatccatagtcattgcagtgcagtaaaccctgatttaaaggaacatttaagtctctccagtaagtgtgaacaggaaggcatgggatagaagagagtccttatggagtggactggccacatgaactgtcctccagccactctttatttagatgggaagtggcatggtcctctgaacgctgcaggctggaaatgatccccagggcacatgcaatctgtggaaaggaatacatcggacagtgcaacatggtgagggctttcaatttgctgtggttgctgtatttttaacaagacacccggagcttcgattaggaataacctatcattagagttgttcctttaaaaaatgttgatgaataaagcaaatgtgggtttaaaatgccaacttatttttcactttgatattggtgctttattaagtgataccatagtttctctctcttttccctgttactttaaaaagaattttaaaattgtgtttgtatataaggtcagtctggcatagaatttctgaaagtaacattaataggatttctaaagaagttgtcagaaagacaaaattggatattctctgcactttcagagaaggactatttatgtttgaatttcataacaggcttacatttcttttctattgattcccttgcatatctacataatttaatcctgtctattgtcccagatctcttgtggctactttacctgttaccttttttgggattttgttctttatgttttacagttaccttcggaccagaagatatatggtatttttattcacttttttcagtgttttaaaataaggtttgttcatttattcattttatccattcatttcctattgtcgtatagttctaaccatatatatagtactttaaatattttcttatgttattatttaacacaataataaattcttatctaaagaaaagattattttactttattttacttaaaggaaagagaatttattggcaggatattgagtagcttgtagagtatatggaaggggagagccaagttaggaactggcaggagcgaggagggacaagacagctgcctgcacagtctgataggacacatctggctgctgccactggatgcccacatgggcagcgtgttgtaaatatcaccctaccagttggtaagttggcatgaattttccatgaaacacttgactgccatttgcagcatcatatctactttttatgcacctaattatatttttcctttcacttttatgtttttttctaaaactgccacctaaatacctttccactccgttaaatgtatggagtcaagataaatttctcattcttgctctacagtttaagatgtataagaagtaaacacttccgtggaatagggcttaatttggggctcaaatgttttgttttcctcctgagatgtttttgaatggataagactactctggttttggatgcagcaacttttctcctggcatggaagaactaaggactttgataaacagtttcccattgatagtataatataatgaggggcccagtctgctcttgtgaaaattggctgagcggcagcagcccatcccagctgtgtgtgagtagccccgctgttaaaagtacacctgctgggaattgttggcacatgctcatagcatatgctctgtgggggaggtgcttttaattccaagaggagcttttctcccacatctgcggatgcagaacaaagatgcagcaggactttagaaaacaggagtgtttctactgacattttattcattgctttgttagtcccgcaaatggagcaacttctggttgtttgtaagcagaaaaacaaaacattcaaaaccaaaaacctaattagtacttttgtcctttatatccctaggatgctctagggagtagaggtggcaggcatctttatcttcacccactggcacattagcagcttatgcaacttaggaagtcactgggagatgagtcctaaaagcctgaatttcaggatggggaggagataagaagcagagaactttgggagaccatggggcatttagtcctggcatagacacagaatggatattcacaggaagattcctgaggccagatatgcaggagagcacacattgtcacaaggggtgtggtgggaagagaggtgctggatgcctaagacagacttctgtgcttggcagattgactgagtgttgactctgaatactttgtggtccagtccataataggccagtcactcctgcctgatgcatccctgttgcactgttcataaaacctgtatcatatggggaagcttcaaggctggcaggcttttcatcaagtaatcatcattccatgttcctacgtatccttgaaatcaaaaccaggcaatatgtgtgtttttggttttgttttacaaaaaggcatacaatgagacgaattcttaagataatgcacatacagaatcatcaataaagtttcaaagagtttatgaagaaaaggtattttcctttcttgtaaaaaatgttatatatatataatattctgatctgcattcaccttagggcttagcctcttattttatgaattttcaggctgtgatttgtgttggatggctaagctctaaaataatgcaaatagccccaatctttaaatatagcggtgctaagttgaacaagtaacacaatacagaaaatgctgatatgaatacttagtaataatacaaaagttcctgctaaattatatatgtgtatcactgcctgactagaaaccccacttttcttttctaatccagcacaaaatcaaactctgattctacaaccagtctttttaaagggcaaaaatgactcaacacctttgttttgtatggaaaacttttttttttacactaactgcaaaactgctttaaaaaaaggcttattcaggatagataagcatgtactccttttttaacttgctggaagacttgcccctccaaactagcacccccaaaagacaacttctttcagaaacggggtgttttacctaaacatagtagcttacatgttagccagcagtaggtcggcactagtgttttccacggttatcacctttgacaggtgatgtgcatctatagatagtggaagccaccccatgaggaggtgttaatagcagcatggtttcacttttggtaatcaggtaatcatgtgtatatacttagattcgcattattttaacatttctctgctactctgcacttcaggttcgttaagctattttaataattactggggttatggcaaacaccaatggaaatgtatatggcaactgctttcctgagcaagtgtgatttgttttatggctgttcaagttataaaattgttcttacattgtaggtaaacaaaatcttgatgtttttaaaggtcactgtaacttaaggttcaaatttctggcacagttttattagtattcacttcggaagctaataagataccatggttttctatgttactcccattgtaacattagtaaagtgactttcaataaaagatttatgttattttga

SEQ ID NO: 104639 - DNA, 9144 bp, Homo sapiens
  Payload ID: 546
  Gene Symbol: ADAM22
  Gene Name: ADAM metallopeptidase domain 22
  Uniprot ID: Q9P0K1
  ENST ID: ENST00000398209
  CDS Start-End: 47-2746
catgaggagctgagcgtctcgggcgaggcgggctgacggcagcaccatgcaggcggcagtggctgtgtccgtgcccttcttgctgctctgtgtcctggggacctgccctccggcgcgctgcggccaggcaggagacgcctcattgatggagctagagaagaggaaggaaaaccgcttcgtggagcgccagagcatcgtgccactgcgcctcatctaccgctcgggcggcgaagacgaaagtcggcacgacgcgctcgacacgcgggtgcggggcgacctcggtggcccgcagttgactcatgttgaccaagcaagcttccaggttgatgcctttggaacgtcattcattctcgatgtcgtgctaaatcatgatttgctgtcctctgaatacatagagagacacattgaacatggaggcaagactgtggaagttaaaggaggagagcactgttactaccagggccatatccgaggaaaccctgactcatttgttgcattgtcaacatgccacggacttcatgggatgttctatgacgggaaccacacatatctcattgagccagaagaaaatgacactactcaagaggatttccattttcattcagtttacaaatccagactgtttgaattttccttggatgatcttccatctgaatttcagcaagtaaacattactccatcaaaatttattttgaagccaagaccaaaaaggagtaaacggcagcttcgtcgatatcctcgtaatgtagaagaagaaaccaaatacattgaactgatgattgtgaatgatcaccttatgtttaaaaaacatcggctttccgttgtacataccaatacctatgcgaaatctgtggtgaacatggcagatttaatatataaagaccaacttaagaccaggatagtattggttgctatggaaacctgggcgactgacaacaagtttgccatatctgaaaatccattgatcaccctacgtgagtttatgaaatacaggagggattttatcaaagagaaaagtgatgcagttcaccttttttcgggaagtcaatttgagagtagccggagcggggcagcttatattggtgggatttgctcgttgctgaaaggaggaggcgtgaatgaatttgggaaaactgatttaatggctgttacacttgcccagtcattagcccataatattggtattatctcagacaaaagaaagttagcaagtggtgaatgtaaatgcgaggacacgtggtccgggtgcataatgggagacactggctattatcttcctaaaaagttcacccagtgtaatattgaagagtatcatgacttcctgaatagtggaggtggtgcctgccttttcaacaaaccttctaagcttcttgatcctcctgagtgtggcaatggcttcattgaaactggagaggagtgtgattgtggaaccccggccgaatgtgtccttgaaggagcagagtgttgtaagaaatgcaccttgactcaagactctcaatgcagtgacggtctttgctgtaaaaagtgcaagtttcagcctatgggcactgtgtgccgagaagcagtaaatgattgtgatattcgtgaaacgtgctcaggaaattcaagccagtgtgcccctaatattcataaaatggatggatattcatgtgatggtgttcagggaatttgctttggaggaagatgcaaaaccagagatagacaatgcaaatacatttgggggcaaaaggtgacagcatcagacaaatattgctatgagaaactgaatattgaagggacggagaagggtaactgtgggaaagacaaagacacatggatacagtgcaacaaacgggatgtgctttgtggttaccttttgtgtaccaatattggcaatatcccaaggcttggagaactcgatggtgaaatcacatctactttagttgtgcagcaaggaagaacattaaactgcagtggtgggcatgttaagcttgaagaagatgtagatcttggctatgtggaagatgggacaccttgtggtccccaaatgatgtgcttagaacacaggtgtcttcctgtggcttctttcaactttagtacttgcttgagcagtaaagaaggcactatttgctcaggaaatggagtttgcagtaatgagctgaagtgtgtgtgtaacagacactggataggttctgattgcaacacttacttccctcacaatgatgatgcaaagactggtatcactctgtctggcaatggtgttgctggcaccaatatcataataggcataattgctggcaccattttagtgctggccctcatattaggaataactgcgtggggttataaaaactatcgagaacagaggtcaaatgggctctctcattcttggagtgaaaggattccagacacaaaacatatttcagacatctgtgaaaatgggcgacctcgaagtaactcttggcaaggtaacctgggaggcaacaaaaagaaaatcagaggcaaaagatttagacctcggtctaattcaactgagtatttaaacccatggttcaaaagagactataatgtagctaagtgggtagaagatgtgaataaaaacactgaaggaccatactttaggactttatctcctgccaagtctccttcttcatcaactgggtctattgcctccagcagaaaatacccttacccaatgcctccacttcctgatgaggacaagaaagtgaaccgacaaagtgccaggctatgggagacatccatttaagatcaactgtttacatgtgatacatcgaaaactgtttacttcaacttttatagaaacccaggctcatggaatcactgcaaatctatctgctcttcagacaatacgaagaccctctgagatgctacagaggagaggaagcggagtttcacatctggttaccattttctttttgtcattggcttaggatttaactaaccatgaaaagaactactgaaatattacactataacatggaacaataaaggtactggtatgttaatggataatccgcatgacagataatatgtagaaatattcataaagttaactcacatgacccaaatgtagcaagtttcctaaggtacaatagtggattcagaacttgacgttctgaggcacatcctcactgtaaacagtaatgctatatgcatgaagcttctgtttattgttttccatatttaaggaaacaacatcccataatagaaatgagcatgcagggctaaggcatataggatttttctgcaggactttaaagctttgaaaggccaatatcccataggctaactttaaacatgtatttttatttttgttttgttttttacttttcatatttatattagcatacaaggacaattgtatatatgtaacatttttaaaattttaaaaaaatgcagctgttacacacaagtgtattttgccaaatgcctaaaaattccgtcacaatcacatcatcgtcatccatccagtgatcttcaaagactataagcaggtaatgtaaatatagtggtcaatgctgtaaatgtgtctctccataattcgtatttgtccaaaacatgtgatatccctttaacctgtgcacagtctggaggcagttttattgagtgagtagttgagtgagagaacaaaatgcccagcaaaacttctggcctccacagtttgctgatgcaggagcccactctgctgccgatgggctgctccctggaaatcatctatcccatccgtccatcccatctcatcccagtgagccagcccctcagcagtgtgtgctgctgagattaagcaagtgcaccaaagacacatgagacaacgtactgccagtgagctggtagcttctggtttgccaatactctaaccctttgtggcctgaagttttgttccttggcaaaactttgtagtcacccttatctgtgaaatgaatgacttgttttaacaaaaacaactttgacactgttgattaagaatatttgtcatcactgggatgtgaatcccaacaagtcattctgcactgactctgaagcaagatgacggaagattctactgtttgagttgagcagcttcaaccattcataaagggttaagttagatctaaaccacagagatgcagcatctgcgaagttacactaacagctggtgggggaaagaatctgatgctttgaaacatatatttttaatccataggaaaataagattctattttaaaagacccttctttaaaaccaaagtttgatagctgttataatggcagatctgtcattccaaaagaaagctagctaccctagtgaggctggagattgatgggctcaatcacatggtctgctctgaagtatacttctgatttcctcatttgctgtgtgttcttaagaggaatggaatctgcagacaggttttcagatatactctcttaaatttgatcctctcccatagtatccatggacaaaatccatatcatcttcatatgtaatcaatttgattacatatcatgcccaaactgaagggccgagttagaaggcagcattttatactgtgtgtttatgtcttctgtaatggacctctcttttgaaagtctttgaaatgtttggaaagcaatttaatgatccaaaattacataatgtaaaacagcatttttcatgacaggaagggatgtgattgttgatatgaccataaagcgatccatcaggccaaggtttgggtgagtgttgggcagtgttgccacatagctcaagccaagaacagaagggcagacagattgaaagatgtagcaaataaagtgactttttaccaagatcactgtaacgtgcactgaatgtttcctggtactgagtgtacaaaaggctaatgctataaggtttattttgactataaaagagtttatagatttgaatataaggtgcctcatgtaaatatgcttcctagttacaggtacacaaactctaatttgaaagaatccacaaatggctagctgagaagttaacagatctctatcattcgtctgtgtgtctttcttccctcacctatttttacatgaaattattatttcaaatgaaaatcatgatcatgtgccttttgggagacatggtttctctagaggtatatagtttgtaattacccgccttggtaataaccttcctgtggaactgactaaaaatttttgttttatttgtagagattatgatttgaggtatacagtaactttaatgttctattcttggaatctactctatctcccatgtttaaacattcttagagccatttgtgggattcattgacaaatttatagtctcaagggagagtttcaagaagtatctatatgtatactcatggttggggttctagaggcattacatctaaatatttatgacttttcatccaccgaggtaggtagcattaaatatacaagcacagcattatttctctttaaatatctattttggagagaaactttgaggccgtatcacagtttatatcatgcaactaatatttatatttcccaatccactacaaaatcattgctaagcagaagagagcagttatttggcctttatgttccattgtatgcctttttcccctcttccagttttatgcattgataagactacagattggcaccctgctgcctgagaagttccatttatccatagtcattgcagtgcagtaaaccctgatttaaaggaacatttaagtctctccagtaagtgtgaacaggaaggcatgggatagaagagagtccttatggagtggactggccacatgaactgtcctccagccactctttatttagatgggaagtggcatggtcctctgaacgctgcaggctggaaatgatccccagggcacatgcaatctgtggaaaggaatacatcggacagtgcaacatggtgagggctttcaatttgctgtggttgctgtatttttaacaagacacccggagcttcgattaggaataacctatcattagagttgttcctttaaaaaatgttgatgaataaagcaaatgtgggtttaaaatgccaacttatttttcactttgatattggtgctttattaagtgataccatagtttctctctcttttccctgttactttaaaaagaattttaaaattgtgtttgtatataaggtcagtctggcatagaatttctgaaagtaacattaataggatttctaaagaagttgtcagaaagacaaaattggatattctctgcactttcagagaaggactatttatgtttgaatttcataacaggcttacatttcttttctattgattcccttgcatatctacataatttaatcctgtctattgtcccagatctcttgtggctactttacctgttaccttttttgggattttgttctttatgttttacagttaccttcggaccagaagatatatggtatttttattcacttttttcagtgttttaaaataaggtttgttcatttattcattttatccattcatttcctattgtcgtatagttctaaccatatatatagtactttaaatattttcttatgttattatttaacacaataataaattcttatctaaagaaaagattattttactttattttacttaaaggaaagagaatttattggcaggatattgagtagcttgtagagtatatggaaggggagagccaagttaggaactggcaggagcgaggagggacaagacagctgcctgcacagtctgataggacacatctggctgctgccactggatgcccacatgggcagcgtgttgtaaatatcaccctaccagttggtaagttggcatgaattttccatgaaacacttgactgccatttgcagcatcatatctactttttatgcacctaattatatttttcctttcacttttatgtttttttctaaaactgccacctaaatacctttccactccgttaaatgtatggagtcaagataaatttctcattcttgctctacagtttaagatgtataagaagtaaacacttccgtggaatagggcttaatttggggctcaaatgttttgttttcctcctgagatgtttttgaatggataagactactctggttttggatgcagcaacttttctcctggcatggaagaactaaggactttgataaacagtttcccattgatagtataatataatgaggggcccagtctgctcttgtgaaaattggctgagcggcagcagcccatcccagctgtgtgtgagtagccccgctgttaaaagtacacctgctgggaattgttggcacatgctcatagcatatgctctgtgggggaggtgcttttaattccaagaggagcttttctcccacatctgcggatgcagaacaaagatgcagcaggactttagaaaacaggagtgtttctactgacattttattcattgctttgttagtcccgcaaatggagcaacttctggttgtttgtaagcagaaaaacaaaacattcaaaaccaaaaacctaattagtacttttgtcctttatatccctaggatgctctagggagtagaggtggcaggcatctttatcttcacccactggcacattagcagcttatgcaacttaggaagtcactgggagatgagtcctaaaagcctgaatttcaggatggggaggagataagaagcagagaactttgggagaccatggggcatttagtcctggcatagacacagaatggatattcacaggaagattcctgaggccagatatgcaggagagcacacattgtcacaaggggtgtggtgggaagagaggtgctggatgcctaagacagacttctgtgcttggcagattgactgagtgttgactctgaatactttgtggtccagtccataataggccagtcactcctgcctgatgcatccctgttgcactgttcataaaacctgtatcatatggggaagcttcaaggctggcaggcttttcatcaagtaatcatcattccatgttcctacgtatccttgaaatcaaaaccaggcaatatgtgtgtttttggttttgttttacaaaaaggcatacaatgagacgaattcttaagataatgcacatacagaatcatcaataaagtttcaaagagtttatgaagaaaaggtattttcctttcttgtaaaaaatgttatatatatataatattctgatctgcattcaccttagggcttagcctcttattttatgaattttcaggctgtgatttgtgttggatggctaagctctaaaataatgcaaatagccccaatctttaaatatagcggtgctaagttgaacaagtaacacaatacagaaaatgctgatatgaatacttagtaataatacaaaagttcctgctaaattatatatgtgtatcactgcctgactagaaaccccacttttcttttctaatccagcacaaaatcaaactctgattctacaaccagtctttttaaagggcaaaaatgactcaacacctttgttttgtatggaaaacttttttttttacactaactgcaaaactgctttaaaaaaaggcttattcaggatagataagcatgtactccttttttaacttgctggaagacttgcccctccaaactagcacccccaaaagacaacttctttcagaaacggggtgttttacctaaacatagtagcttacatgttagccagcagtaggtcggcactagtgttttccacggttatcacctttgacaggtgatgtgcatctatagatagtggaagccaccccatgaggaggtgttaatagcagcatggtttcacttttggtaatcaggtaatcatgtgtatatacttagattcgcattattttaacatttctctgctactctgcacttcaggttcgttaagctattttaataattactggggttatggcaaacaccaatggaaatgtatatggcaactgctttcctgagcaagtgtgatttgttttatggctgttcaagttataaaattgttcttacattgtaggtaaacaaaatcttgatgtttttaaaggtcactgtaacttaaggttcaaatttctggcacagttttattagtattcacttcggaagctaataagataccatggttttctatgttactcccattgtaacattagtaaagtgactttcaataaaagatttatgttattttga

SEQ ID NO: 104640 - DNA, 2576 bp, Homo sapiens
  Payload ID: 546
  Gene Symbol: ADAM22
  Gene Name: ADAM metallopeptidase domain 22
  ENST ID: ENST00000439864
  CDS Start-End: 216-1244
actcgctcgctccccccgccagcggaagcgtccgcgaagcacaatgcagcactgagccgcggtggaggttgcagcgccacggccgccgcagcaccggccggggctgggtggaggtggccgcggggaccccgggggcgcggagcgagggaaacggactcggcggcgccggcatgaggagctgagcgtctcgggcgaggcgggctgacggcagcaccatgcaggcggcagtggctgtgtccgtgcccttcttgctgctctgtgtcctggggacctgccctccggcgcgctgcggccaggcaggagacgcctcattgatggagctagagaagaggaaggaaaaccgcttcgtggagcgccagagcatcgtgccactgcgcctcatctaccgctcgggcggcgaagacgaaagtcggcacgacgcgctcgacacgcgggtgcggggcgacctcggtggcccgcagttgactcatgttgaccaagcaagcttccaggttgatgcctttggaacgtcattcattctcgatgtcgtgctaaatcatgatttgctgtcctctgaatacatagagagacacattgaacatggaggcaagactgtggaagttaaaggaggagagcactgttactaccagggccatatccgaggaaaccctgactcatttgttgcattgtcaacatgccacggacttcatgggatgttctatgacgggaaccacacatatctcattgagccagaagaaaatgacactactcaagaggatttccattttcattcagtttacaaatccagactgtttgaattttccttggatgatcttccatctgaatttcagcaagtaaacattactccatcaaaatttattttgaagccaagaccaaaaaggagtaaacggcagcttcgtcgatatcctcgtaatgtagaagaagaaaccaaatacattgaactgatgattgtgaatgatcaccttatgtttaaaaaacatcggctttccgttgtacataccaatacctatgcgaaatctgtggtgaacatggcagatttaatatataaagaccaacttaagaccaggatagtattggttgctatggaaacctgggcgactgacaacaagtttgccatatctgaaaatccattgatcaccctacgtgagtttatgaaatacaggagggattttatcaaagagaaaagtgatgcagttcaccttttttcgtacgtaacttctgtaatgatgtattactttttttgattccatgttaaatgctttattgtgactgaaatgtatcctttctgctacataacacaattaggatttgacatggcagatggcagatagatttggaaaaagttttcaagtatagattgcttaaaattgccatgaaaatgtaaaagttttaattttgagttattttattatttaatgtttaatttttcaagatatttaaatagagcatttactgagtaaaaatactgctaatactcatatatagtattcttaactacagataaattatattctttaaagttactgtcttttaaatgttaatgttttctctgtttttggttctaagatgagagcttagtatttctggaatttatttttaattttttctcactcttatgttctttttttgatagcatgcatatttgacgtaatagcaaattatatatagtagaattttaaaaatctatcatctaaagtcagagctgttgaagaaagttataaaaggaagaaaagatgtattttggggtaactttatatataattccaaatttagagaaaagttgcaagaatactacaaggaaattgcatatgccctctattcagattcatcaattattcacattttccccatttgtttcataattttcttccattctccctcccttccttccattcatccatccttcagttttttttttgtttttttttgttttttttcctgaacctcttgaaagtaagttgaagacacttactggggatttattattaaatagtatatattctctaagagtaaaaagacattctcttatataaccacagtaaattattaaaaccagaaaatttaacacaaacataatacttttatgtaacccatggtctatattcaaatttcaccaattacctcaataatgtcttttaaagctaattttccccatccaaatccaatccaggatcacacattgcatttaatcatcatgtctctttagtctcctttaatctgaaagatttcctcagctttcctttgtctattttgagtttaatacttttgaagagtataggccaattattttattgactgttcctcattatgggaatgcctgatgttaagatatgtatttttggcagaaataccagagaagtgattttgtgtctgtctcagagtacatcatatcaaccaattattttttaatagatatacttcaatttaagatatttattaatcttgcaagaaaacatccctcataaacctttttctttggttacatgtataaacaattttcacattcttcccttgcaatgtgaatatattgtatagaaatcttatgtatagagaaaataaatgtagtaaactaataa

SEQ ID NO: 104641 - DNA, 1259 bp, Homo sapiens
  Payload ID: 546
  Gene Symbol: ADAM22
  Gene Name: ADAM metallopeptidase domain 22
  ENST ID: ENST00000426930
  CDS Start-End: 1-993
gaagaagatgtagatcttggctatgtggaagatgggacaccttgtggtccccaaatgatgtgcttagaacacaggtgtcttcctgtggcttctttcaactttagtacttgcttgagcagtaaagaaggcactatttgctcaggaaatggagtttgcagtaatgagctgaagtgtgtgtgtaacagacactggataggttctgattgcaacacttacttccctcacaatgatgatgcaaagactggtatcactctgtctggcaatggtgttgctggcaccaatatcataataggcataattgctggcaccattttagtgctggccctcatattaggaataactgcgtggggttataaaaactatcgagaacagagacagttaccccagggagattatgtaaaaaagcctggagatggtgactctttttatagcgacattcctcccggagtcagcacaaactcagcatctagttctaagaagaggtcaaatgggctctctcattcttggagtgaaaggattccagacacaaaacatatttcagacatctgtgaaaatgggcgacctcgaagtaactcttggcaaggtaacctgggaggcaacaaaaagaaaatcagaggcaaaagatttagacctcggtctaattcaactgagagggagccccaagcacctgagcctgggcactccctcgcccagacagtcccatcccaaggcataagcccagggggctctgacagcccccagacagggagtctggatcacaggtatttaaacccatggttcaaaagagactataatgtagctaagtgggtagaagatgtgaataaaaacactgaaggaccatactttaggactttatctcctgccaagtctccttcttcatcaactgggtctattgcctccagcagaaaatacccttacccaatgcctccacttcctgatgaggacaagaaagtgaaccgacaaagtgccaggctatgggagacatccatttaagatcaactgtttacatgtgatacatcgaaaactgtttacttcaacttttatagaaacccaggctcatggaatcactgcaaatctatctgctcttcagacaatacgaagaccctctgagatgctacagaggagaggaagcggagtttcacatctggttaccattttctttttgtcattggcttaggatttaactaaccatgaaaagaactactgaaatattacactataacatggaacaataaaggtactggtatgttaatggataa

SEQ ID NO: 104642 - DNA, 793 bp, Homo sapiens
  Payload ID: 546
  Gene Symbol: ADAM22
  Gene Name: ADAM metallopeptidase domain 22
  ENST ID: ENST00000413139
  CDS Start-End: 1-793
gtgtaacagacactggataggttctgattgcaacacttacttccctcacaatgatgatgcaaagactggtatcactctgtctggcaatggtgttgctggcaccaatatcataataggcataattgctggcaccattttagtgctggccctcatattaggaataactgcgtggggttataaaaactatcgagaacagagacagttaccccagggagattatgtaaaaaagcctggagatggtgactctttttatagcgacattcctcccggagtcagcacaaactcagcatctagttctaagaagaggtctgcttttctgtcgcattttcagatttctacctgttccatcacacattattccattagtcagaacatttcattattttgcagcaggtcaaatgggctctctcattcttggagtgaaaggattccagacacaaaacatatttcagacatctgtgaaaatgggcgacctcgaagtaactcttggcaaggtaacctgggaggcaacaaaaagaaaatcagaggcaaaagatttagacctcggtctaattcaactgagtatttaaacccatggttcaaaagagactataatgtagctaagtgggtagaagatgtgaataaaaacactgaaggaccatactttaggactttatctcctgccaagtctccttcttcatcaactgggtctattgcctccagcagaaaatacccttacccaatgcctccacttcctgatgaggacaagaaagtgaaccgacaaagtgccaggctatgggagacatccatttaa

SEQ ID NO: 104643 - DNA, 726 bp, Homo sapiens
  Payload ID: 546
  Gene Symbol: ADAM22
  Gene Name: ADAM metallopeptidase domain 22
  ENST ID: ENST00000412441
  CDS Start-End: 138-726
acggccgccgcagcaccggccggggctgggtggaggtggccgcggggaccccgggggcgcggagcgagggaaacggactcggcggcgccggcatgaggagctgagcgtctcgggcgaggcgggctgacggcagcaccatgcaggcggcagtggctgtgtccgtgcccttcttgctgctctgtgtcctggggacctgccctccggcgcgctgcggccaggcaggagacgcctcattgatggagctagagaagaggaaggaaaaccgcttcgtggagcgccagagcatcgtgccactgcgcctcatctaccgctcgggcggcgaagacgaaagtcggcacgacgcgctcgacacgcgggtgcggggcgacctcggtggcccgcagattcagatgtttttgaagtcagaatcccagaagaccatataccagatacagttgactcatgttgaccaagcaagcttccaggttgatgcctttggaacgtcattcattctcgatgtcgtgctaaatcatgatttgctgtcctctgaatacatagagagacacattgaacatggaggcaagactgtggaagttaaaggaggagagcactgttactaccagggccatatccgaggaaaccctgactcatttgttgcattgtcaacatgccacggacttcatgggatgttctatgacgggaaccacacatatctcattgagccagaagaaaatgacactactcaag

SEQ ID NO: 104644 - DNA, 6330 bp, Homo sapiens
  Payload ID: 547
  Gene Symbol: ADAM23
  Gene Name: ADAM metallopeptidase domain 23
  Uniprot ID: O75077
  ENST ID: ENST00000264377
  CDS Start-End: 329-2827
ggcccggcggcagcccccgcagtcgctgaagcggccgcgcccgccgggggagggagtagccgctggggaggctccaagttggcggagcggcgaggacccctggactcctctgcgtcccgccccgggagtggctgcgaggctaggcgagccgggaaagggggcgccgcccagccccgagccccgcgccccgtgccccgagcccggagccccctgcccgccgcggcaccatgcgcgccgagccggcgtgaccggctccgcccgcggccgccccgcagctagcccggcgctctcgccggccacacggagcggcgcccgggagctatgagccatgaagccgcccggcagcagctcgcggcagccgcccctggcgggctgcagccttgccggcgcttcctgcggcccccaacgcggccccgccggctcggtgcctgccagcgccccggcccgcacgccgccctgccgcctgcttctcgtccttctcctgctgcctccgctcgccgcctcgtcccggccccgcgcctggggggctgctgcgcccagcgctccgcattggaatgaaactgcagaaaaaaatttgggagtcctggcagatgaagacaatacattgcaacagaatagcagcagtaatatcagttacagcaatgcaatgcagaaagaaatcacactgccttcaagactcatatattacatcaaccaagactcggaaagcccttatcacgttcttgacacaaaggcaagacaccagcaaaaacataataaggctgtccatctggcccaggcaagcttccagattgaagccttcggctccaaattcattcttgacctcatactgaacaatggtttgttgtcttctgattatgtggagattcactacgaaaatgggaaaccacagtactctaagggtggagagcactgttactaccatggaagcatcagaggcgtcaaagactccaaggtggctctgtcaacctgcaatggacttcatggcatgtttgaagatgataccttcgtgtatatgatagagccactagagctggttcatgatgagaaaagcacaggtcgaccacatataatccagaaaaccttggcaggacagtattctaagcaaatgaagaatctcactatggaaagaggtgaccagtggccctttctctctgaattacagtggttgaaaagaaggaagagagcagtgaatccatcacgtggtatatttgaagaaatgaaatatttggaacttatgattgttaatgatcacaaaacgtataagaagcatcgctcttctcatgcacataccaacaactttgcaaagtccgtggtcaaccttgtggattctatttacaaggagcagctcaacaccagggttgtcctggtggctgtagagacctggactgagaaggatcagattgacatcaccaccaaccctgtgcagatgctccatgagttctcaaaataccggcagcgcattaagcagcatgctgatgctgtgcacctcatctcgcgggtgacatttcactataagagaagcagtctgagttactttggaggtgtctgttctcgcacaagaggagttggtgtgaatgagtatggtcttccaatggcagtggcacaagtattatcgcagagcctggctcaaaaccttggaatccaatgggaaccttctagcagaaagccaaaatgtgactgcacagaatcctggggtggctgcatcatggaggaaacaggggtgtcccattctcgaaaattttcaaagtgcagcattttggagtatagagactttttacagagaggaggtggagcctgccttttcaacaggccaacaaagctatttgagcccacggaatgtggaaatggatacgtggaagctggggaggagtgtgattgtggttttcatgtggaatgctatggattatgctgtaagaaatgttccctctccaacggggctcactgcagcgacgggccctgctgtaacaatacctcatgtctttttcagccacgagggtatgaatgccgggatgctgtgaacgagtgtgatattactgaatattgtactggagactctggtcagtgcccaccaaatcttcataagcaagacggatatgcatgcaatcaaaatcagggccgctgctacaatggcgagtgcaagaccagagacaaccagtgtcagtacatctggggaacaaaggctgcagggtctgacaagttctgctatgaaaagctgaatacagaaggcactgagaagggaaactgcgggaaggatggagaccggtggattcagtgcagcaaacatgatgtgttctgtggattcttactctgtaccaatcttactcgagctccacgtattggtcaacttcagggtgagatcattccaacttccttctaccatcaaggccgggtgattgactgcagtggtgcccatgtagttttagatgatgatacggatgtgggctatgtagaagatggaacgccatgtggcccgtctatgatgtgtttagatcggaagtgcctacaaattcaagccctaaatatgagcagctgtccactcgattccaagggtaaagtctgttcgggccatggggtgtgtagtaatgaagccacctgcatttgtgatttcacctgggcagggacagattgcagtatccgggatccagttaggaaccttcacccccccaaggatgaaggacccaagggtcctagtgccaccaatctcataataggctccatcgctggtgccatcctggtagcagctattgtccttgggggcacaggctggggatttaaaaatgtcaagaagagaaggttcgatcctactcagcaaggccccatctgaatcagctgcgctggatggacaccgccttgcactgttggattctgggtatgacatactcgcagcagtgttactggaactattaagtttgtaaacaaaacctttgggtggtaatgactacggagctaaagttggggtgacaaggatggggtaaaagaaaactgtctcttttggaaataatgtcaaagaacacctttcaccacctgtcagtaaacgggggagggggcaaaagaccatgctataaaaagaactgttccagaatcttttttttccctaatggacgaaggaacaacacacacacaaaaattaaatgcaataaaggaatcattaaaaaaaatagtaaatgattttttttccctcagcctgctggcacttaatatcttctaaatgatttggcatgatttttttttctttactaccgatgacaaactccagtggcatgaagatctaattttcaaaagggtaaaaactgcatggcatatatacaacaagctagcaagccaattctcagcaaaacctgcaacagaattcctaaagtgaagatgacagatgaacacaaagaagctgcctgggcctcttcacttaaacatgtccccacaccccatcctctcggagccccacttcttaccccccacctcccaccctctataatccccactccccattggagaccaggccagggcagaactccacggaccttgctcttgttgattcactttccccattgtgttttctcctggactgagcatcctttggaaatgggagctggaatttgaacaatgatgctattgtatagttcttttataaatgtaaatatggaaataagagattttgacacatcattttcacttgtctgtattgagatattttccttgtaaaggttctctgtaaacttgagttgattttttgctccccatcttttttgtttcttgtctctctttctctgtctctgtccttctctcttgtaacgtgttatacaatgactcttgggcttgcttaaaaagacagatatagccacagatgcagggagtttgggcacaaaacacgtgcagtttaaagttggtgtgcgttaaaccaaaaataaaaggggggacataaacaacaaaataacccatatcaaagacacaaaattatgtaaatggaaatatatgtactaagtttcgaaaattttttgatgtcattataaacctatgtaaataatgtaagaaagtagacaccctttcagattaatcacaaaagtgccaagctcatgattttggttttcggttttgacaattttctttccctgtctttaatgtgaaaggaggataaacttaaagccttaaataaaaaaatttttttaaatgttaaaagcttggaaaaaattaagctttccattttatttgtatttgttagtgtcaatatttcatccatgctcattttcctgcctcaaaatatatatggtagaaccctattggaaaagtggtaatgggaatagaaggagcagttacctttgtatccgcattgttaaaataggcttttatgctgtgctgtgctttcaagaaaccttgtttgacctctggcattttactgatcagtggaccgttgcactggattataatgggattctactatatacaaatccacattgttcttctccctccagccagatttgcagatgtaatctgggctttccaagtccctctgagtttccttcacttttactgatttttttcttctaaatatggtcaagatagcttctgtcacatgttaagtaaataagctgaagaaatttggtcccggctttgttttaatgtacaaaccggtatgtgatcacttcagtgagcatccctctatagatgggctttagtaaagactgtcccaaagagcccctacttctctaatgcccccccccttttttttttaggaaaagaacatgcagttttactcatcacttcttcatgacaccaaatccattgctaggtttagctcctggtcccttttcagcaagattcatgttatccgtcttacaactttgattttggaaagtattatgtcctaaaaatgcactgcttaacacagtggggtttttttcccccgaggtgtctttaactggggaagtaccacaaacatagagcagagactttaatttctatattctacaatagaccatcaccaaacatcttatcatgttgttgctttctgagtaataggtgctacgcaggtaggcgggctttctctaggactaggtgtacgtttattttgtaataacagggctatctacaaggcctctcagccttactcctggcttcataggacacaggtagcatccctctagtcattggcaatggctctttcagctcggaggaagcttggaggaaactcagattacttggtatcttttcctgttgctgcattgcttagtgtttccttgttgctgggtcctactctctagtagatactaaactgctgtgaagtacaccatacacatttcactaagattccagagccaccttggtgacataacagaaacaaaatcatgttggttacaaaacaaattaaatctctattgttaacttttaagcatttcacaaacaacattgtaaatgtgcgatgttacgttttaaatcagaccacagtggtccccaaatattatgtacatatggcaaatgtcagtgtaactttttgttacactggcaatttcataggtaatcgaacctatgctccaatgttaaattatttgtgtatatgtaaaatacacaagctttaagctatgtgtgtatgaatatgaaagttaatgcaaccatatcaattgtaaaaatggattataattatttttgatggtattaggttatgtagtttcaaactctttgctgtattttgttttgcacctgccattcatttgctaatttttgtggcgtggagattcttttttattaatttgagctcacagcacaagtgtatcactgtttaatgttacccaacaagagttagtgttaagtgatgatcaagttcccatttcacctgctctacttttgctgcattaattaatgacacccggatgaggagacgtgcgctaacttcattgctcatctgggatagtgcatgagcccattgaattagagctgctcctactagataactgagcagtacacataagtgcatgttatgaaacatgaatcacatagagcagtggagttttaccaagtggtgtgtgtggtttttgttttttactatgcaaagatgggaaatgcacaaacttttcaaagactagtgtctgaagaactttacaaacaatacttgaaccctttctttaaagttatcccatcatgttttatagtcattgttgcttccattgttagtttccattttcaagtgctttgtaattttttaagtgcactacctgaaattttgtttgaaattaataaattcattcgtatcttgttggctgcctatgaatggagattcagtagtcattgtatgcatctttaagtcaaatgtgtattaaaactttcgttaacgtagaa

SEQ ID NO: 104645 - DNA, 2714 bp, Homo sapiens
  Payload ID: 547
  Gene Symbol: ADAM23
  Gene Name: ADAM metallopeptidase domain 23
  ENST ID: ENST00000374415
  CDS Start-End: 1-2499
atgaagccgcccggcagcagctcgcggcagccgcccctggcgggctgcagccttgccggcgcttcctgcggcccccaacgcggccccgccggctcggtgcctgccagcgccccggcccgcacgccgccctgccgcctgcttctcgtccttctcctgctgcctccgctcgccgcctcgtcccggccccgcgcctggggggctgctgcgcccagcgctccgcattggaatgaaactgcagaaaaaaatttgggagtcctggcagatgaagacaatacattgcaacagaatagcagcagtaatatcagttacagcaatgcaatgcagaaagaaatcacactgccttcaagactcatatattacatcaaccaagactcggaaagcccttatcacgttcttgacacaaaggcaagacaccagcaaaaacataataaggctgtccatctggcccaggcaagcttccagattgaagccttcggctccaaattcattcttgacctcatactgaacaatggtttgttgtcttctgattatgtggagattcactacgaaaatgggaaaccacagtactctaagggtggagagcactgttactaccatggaagcatcagaggcgtcaaagactccaaggtggctctgtcaacctgcaatggacttcatggcatgtttgaagatgataccttcgtgtatatgatagagccactagagctggttcatgatgagaaaagcacaggtcgaccacatataatccagaaaaccttggcaggacagtattctaagcaaatgaagaatctcactatggaaagaggtgaccagtggccctttctctctgaattacagtggttgaaaagaaggaagagagcagtgaatccatcacgtggtatatttgaagaaatgaaatatttggaacttatgattgttaatgatcacaaaacgtataagaagcatcgctcttctcatgcacataccaacaactttgcaaagtccgtggtcaaccttgtggattctatttacaaggagcagctcaacaccagggttgtcctggtggctgtagagacctggactgagaaggatcagattgacatcaccaccaaccctgtgcagatgctccatgagttctcaaaataccggcagcgcattaagcagcatgctgatgctgtgcacctcatctcgcgggtgacatttcactataagagaagcagtctgagttactttggaggtgtctgttctcgcacaagaggagttggtgtgaatgagtatggtcttccaatggcagtggcacaagtattatcgcagagcctggctcaaaaccttggaatccaatgggaaccttctagcagaaagccaaaatgtgactgcacagaatcctggggtggctgcatcatggaggaaacaggggtgtcccattctcgaaaattttcaaagtgcagcattttggagtatagagactttttacagagaggaggtggagcctgccttttcaacaggccaacaaagctatttgagcccacggaatgtggaaatggatacgtggaagctggggaggagtgtgattgtggttttcatgtggaatgctatggattatgctgtaagaaatgttccctctccaacggggctcactgcagcgacgggccctgctgtaacaatacctcatgtctttttcagccacgagggtatgaatgccgggatgctgtgaacgagtgtgatattactgaatattgtactggagactctggtcagtgcccaccaaatcttcataagcaagacggatatgcatgcaatcaaaatcagggccgctgctacaatggcgagtgcaagaccagagacaaccagtgtcagtacatctggggaacaaaggctgcagggtctgacaagttctgctatgaaaagctgaatacagaaggcactgagaagggaaactgcgggaaggatggagaccggtggattcagtgcagcaaacatgatgtgttctgtggattcttactctgtaccaatcttactcgagctccacgtattggtcaacttcagggtgagatcattccaacttccttctaccatcaaggccgggtgattgactgcagtggtgcccatgtagttttagatgatgatacggatgtgggctatgtagaagatggaacgccatgtggcccgtctatgatgtgtttagatcggaagtgcctacaaattcaagccctaaatatgagcagctgtccactcgattccaagggtaaagtctgttcgggccatggggtgtgtagtaatgaagccacctgcatttgtgatttcacctgggcagggacagattgcagtatccgggatccagttaggaaccttcacccccccaaggatgaaggacccaaggtgaatatggccacaagcaggctaataggggccgtggccggcaccattctggccctgggggtgatttttggaggcacagggtggggaatagaaaatgtcaagaagagaaggttcgatcctactcagcaaggccccatctgaatcagctgcgctggatggacaccgccttgcactgttggattctgggtatgacatactcgcagcagtgttactggaactattaagtttgtaaacaaaacctttgggtggtaatgactacggagctaaagttggggtgacaaggatggggtaaaagaaaactgtctcttttggaaataatgtcaaagaacacctttcaccacctgtcagtaaacggg

SEQ ID NO: 104646 - DNA, 460 bp, Homo sapiens
  Payload ID: 547
  Gene Symbol: ADAM23
  Gene Name: ADAM metallopeptidase domain 23
  ENST ID: ENST00000444281
  CDS Start-End: 1-323
tacaaattcaagccctaaatatgagcagctgtccactcgattccaagggtaaagtctgttcgggccatggggtgtgtagtaatgaagccacctgcatttgtgatttcacctgggcagggacagattgcagtatccgggatccagttaggaaccttcacccccccaaggatgaaggacccaaggaaatgtcaagaagagaaggttcgatcctactcagcaaggccccatctgaatcagctgcgctggatggacaccgccttgcactgttggattctgggtatgacatactcgcagcagtgttactggaactattaagtttgtaaacaaaacctttgggtggtaatgactacggagctaaagttggggtgacaaggatggggtaaaagaaaactgtctcttttggaaataatgtcaaagaacacctttcaccacctgtcagtaaacgggggagggggcaaaa

SEQ ID NO: 104647 - DNA, 7052 bp, Homo sapiens
  Payload ID: 548
  Gene Symbol: ADAM28
  Gene Name: ADAM metallopeptidase domain 28
  Uniprot ID: Q9UKQ2
  ENST ID: ENST00000265769
  CDS Start-End: 111-2438
gaatgaaccagggagtttcattctgtctcactggagaggaggcagggacagacccagcagcacccacctgagcgagaagagcagacaccgtgctcctggaatcacccagcatgttgcaaggtctcctgccagtcagtctcctcctctctgttgcagtaagtgctataaaagaactccctggggtgaagaagtatgaagtggtttatcctataagacttcatccactgcataaaagagaggccaaagagccagagcaacaggaacaatttgaaactgaattaaagtataaaatgacaattaatggaaaaattgcagtgctttatttgaaaaaaaacaagaacctccttgcaccaggctacacggaaacatattataattccactggaaaggagatcaccacaagcccacaaattatggatgattgttattatcaaggacatattcttaatgaaaaggtttctgacgctagcatcagcacatgtaggggtctaaggggctacttcagtcagggggatcaaagatactttattgaacctttaagccccatacatcgggatggacaggagcatgcactcttcaagtataaccctgatgaaaagaattatgacagcacctgtgggatggatggtgtgttgtgggcccacgatttgcagcagaacattgccctacctgccaccaaactagtaaaattgaaagacaggaaggttcaggaacatgagaaatacatagaatattatttggtcctggataatggtgagtttaaaaggtacaatgagaatcaagatgagatcagaaagagggtatttgagatggctaattatgtcaacatgctttataaaaagctcaatactcatgtggccttagttggtatggaaatctggactgacaaggataagataaagataaccccaaatgcaagcttcaccttggagaatttttctaaatggagggggagtgttctctcaagaagaaagcgtcatgatattgctcagttaatcacagcaacagaacttgctggaacgactgtgggtcttgcatttatgtctacaatgtgttctccttattctgttggcgttgttcaggaccacagcgataatcttcttagagttgcagggacaatggcacatgaaatgggccacaactttggaatgtttcatgacgactattcttgcaagtgtccttctacaatatgtgtgatggacaaagcactgagcttctatatacccacagacttcagttcctgcagccgtctcagctatgacaagttttttgaagataaattatcaaattgcctctttaatgctccattgcctacagatatcatatccactccaatttgtgggaaccagttggtggaaatgggagaggactgtgattgtgggacatctgaggaatgtaccaatatttgctgtgatgctaagacatgtaaaatcaaagcaacttttcaatgtgcattaggagaatgttgtgaaaaatgccaatttaaaaaggctgggatggtgtgcagaccagcaaaagatgagtgcgacctgcctgaaatgtgtaatggtaaatctggtaattgtcctgatgatagattccaagtcaatggcttcccttgccatcacgggaagggccactgcttgatggggacatgccccacactgcaggagcagtgcacagagctgtggggaccaggaactgaggttgcagataagtcatgttacaacaggaatgaaggtgggtcaaagtacgggtactgtcgcagagtggatgacacactcattccctgcaaagcaaatgataccatgtgtgggaagttgttctgtcaaggtgggtcggataatttgccctggaaaggacggatagtgactttcctgacatgtaaaacatttgatcctgaagacacaagtcaagaaataggcatggtggccaatggaactaagtgtggcgataacaaggtttgcattaatgcagaatgtgtggatattgagaaagcctacaaatcaaccaattgctcatctaagtgcaaaggacatgctgtgtgtgaccatgagctccagtgtcaatgtgaggaaggatggatccctcccgactgcgatgactcctcagtggtcttccacttctccattgtggttggggtgctgttcccaatggcggtcatttttgtggtggttgctatggtaatccggcaccagagctccagagaaaagcagaagaaagatcagaggccactatctaccactggcaccaggccacacaaacagaagaggaaaccccagatggtaaaggctgttcaaccccaagagatgagtcagatgaagccccatgtgtatgatctgccagtagaaggcaatgagcccccagcctcttttcataaagacacaaacgcacttccccctactgttttcaaggataatccagtgtctacacctaaggactcaaatccaaaagcatgaagcaacagctaagcaagaactaatggctaaattatcaacttggaaaactggaaaatctggatggcagagaaatatactatctatctcaccagtatttgctctcgactcaagaaggttaacattttctgattcatgttagactttgaagagactaaagaaaattttcaagaggaacatatgcctgagaacctttgcatgaatttaaaatttcaattatccattcttataagaaggaagatgattgtaaagaaatatctccgaagttaaaatctgtaataggaattgattcattctctaatgaaaacaaaacataaaaacatcacactaatcttggaggaataagaaaaattgtacatccattaaatgtacaattgattgcaacatcttgattgttttaaccattaacttgtcaaattacaatcacagttaagaaaatgatgtaaaattctgttttgtggatctctttcctagattagcttctgaaatcattattagctatatcatttgaggttttctacaatttggtataactaagaatttaaaaatgttttatcatatatatttgtataattaattactggcatggttaaagtggttttcactttttaaatggagaaaatttcagttaaattaataggataaaccaggttgcgaactggtgacctgtaggccatgtttgcactgcaaatatatttggtctgaatgatattgatattggacacatagtacttttacatgttttgaatgtattgctaatatttaaaaattgagagatcttgcataaacaatagattcccagctttgtcagatgtaatctaaaagtaatccgatgctttgtcaacaacagacttacattgcccatagcaaccgtcagcttagttgatgggtaatgtagcaaacactattggtttcctaccaaataatcccctttttcctggcttttagaacaataattttgttcacctgcccacttctaggaaagaatatcctatctaatctatctatctcagggataaatccctatccttttaagtaagtcaagtcaattaaaataacctcatttttccttgctagtggtcgacttggagatgattttataatcctccccctccctttttttttttgctagtaagacgacagaggaattatgttacaacacttctggaaaatttttcctcgtctctttttctggatatgggcatctgaatactctagctggtactgctgcgctccacacggtgattatgaaggctgaaaaagatagatagagcagaaagatgaaaagaataaaacctggcctttcaatgatgtcatggaattggtagatcagtgactgctggagttacctcacactttcttggtactccttattatatgagccatacattttccttgttgtttaagccattttgaattggattttctctcactttcaacagagatcatcctaactagtaaagtagctgtttccataatcagggaacatgctttagttcatcatcacagctacagtttttcttgtatttgtctgcttcacccatttctatcaatcacttacctggtccccacaggcctgtcgcttcatgaggaactttatggttcatttacccttgcagtatgaggttctagataagcccactctggcctcaaaagtgaagctcagtcctcaggaaatccagagtccactgatcaaatcactgtcaaggatacaggctttttctccatgtggcatttgcagaagaacaactttaaaagtagagctttatctgccctgtgaggtttcagaagaccctcccctgacccagaaataaatccctatttcctggaaagccattatgtactcgtgaccaacttgtgaacttttctgtgttgttgttgttgttttttaaatatctgtccccagtaatagattcacctaatccttttttatactgatggaatggaaatcttaaatctatgaatcctcaactagccatgtaccataacccaagcaaaaactaaaccatacactctcaaaagcagtggcatgtgaacatgcctgcaagttcctaaatgatgtcactaggtccctgatgcagatgcatcatacgtcctatttgaagagaagaaatgcagtacaatgacaggaaaaccattattttatcatagaactgcgaacccaagtcctacaatgtttccctttcagctcaactgcagaatagtttagaacagactttttgatttcacaatactgtttccacacttacttatatccgtaactttctaactttaagggaattccgcttatttgacatttaactacctcagatatgccaccaaacctgttttcatcattagttatttttaccttgtctactttaaaacagtgaaattattaggttaaattatgtttttatccagttactctaagataccttagtgtttgtctacttattacaactcaccaaattactggttttatatggcctttgggaaggcttttagctttttataaaataatgaagtatgcatgaaaagaaagcaaattttagttggttgcagtcagagaatatggaaagggttattattataattaggattttattattcacattggaaatcactgctatgtgttaaggaattgaaggtggcctctggctagcagccattaagaaaatgagcccctgagttcaacgaccctcaaatgaagtgaagtctaccaataaccactgaataagcttggaattttagattccttcccagctgaatcttgacttcagccttgtgagacaccctgaagtagaggatgcagctaaattttgtccagattacacacccacagaaactgtatgataattaatatgtgttgtttaaagttgttatggtttggagatatttgttatgcagcaatagatagctgatacaaggaagtagagaacaaacattttctattagtctgttttcacatggctataaagaataccacctgagactgggtaatttataaagaaaggaggattaattgactcagatttccacatggcctaggaggcctcaggaaacttacaatcatgatgaaagaggaagcagaaacatctcatatgatggaagatgtgtatgaaggaggaactgtcaaacacttataaaaccatcagatctcttgagagcttactatctcgacaaaagcatgggggaaaccacccccatgatccaatcacctcccacctggtccctccctcaacatgtggagattatagcaattaaaaaaatgagatttggggggatggacacagagccaaaccatataatgttttaaatgctccagataggtttaggtaaaattaactatatttaataggctttcatcactgcaaaactttttttcctttctttgtgtctctagtctcttccatttgttctcccttctttactagcaccgaggatttgcttgaaatctctgatagccagtattctcatttatcatattctttctcactttgtgtttccttggtaattttggataactccttaaatttatcttccaaattactggtttttatattctgtactgtcagtcctcctgttcactaatttcaaaatttatagttgtttctcttgtttacttatatagttgtttctcttgtttacttaataacattctcttctttcctatcagtttaattttataaaggctaaccaattaactgtttttaacttatatttccagatattttaaaaattaaagcaaaatgtgtataaactttattactgcttcccacagtaaatatttttcagaagtacatgctttctcagccacttgactagtatgttccccatcattcaaagacaccattatttcctaagtgttatattgctatttttcagttggtgcatccaatattattatcagctttaatattgtttcatcatatgtcattgttcaaagaatccatctcttgagcgtaagctaaataatttgcatacactagcatctggatgtaatatggaaaaatatggaaatggttggggtgataagcaagtcttgcatattcttttctcctcaattttttttctccaaagtgggccaagccaagagtggcacagctgtgtggagatactgagctccaccttgtcagggaagatcccaactcaggagaaaacacctctaacaaaatctgtagccacgttggcacatctgcccttgaattcactttgtctcttttgctgcttccataaaaaggctttcccttgacaatgttaggcactttttagcaactaggcctgggtggtctgctacaatgcccaacacttaatacagtatcactattactgttagtagtatgctaagcgaatactattgttataaaaaaaatcctaagcatgaaaattacggtatacaatttattgtgaaggcaacttcttgtgaacattaaacggtttatctccttcacctcatattaaagtccatactcttgggatatatctgacatctcaatattaaatgactaagatgactaagtcgtttatgttgctcccacctcacacaaagttaaaactatttgttactttaaatagtttgacaatgttattttaaaatctggacaaatcacaaatataaaatacttatttaatttt

SEQ ID NO: 104648 - DNA, 2085 bp, Homo sapiens
  Payload ID: 548
  Gene Symbol: ADAM28
  Gene Name: ADAM metallopeptidase domain 28
  Uniprot ID: Q9UKQ2
  ENST ID: ENST00000437154
  CDS Start-End: 40-1662
gcgagaagagcagacaccgtgctcctggaatcacccagcatgttgcaaggtctcctgccagtcagtctcctcctctctgttgcagtaagtgctataaaagaactccctggggtgaagaagtatgaagtggtttatcctataagacttcatccactgcataaaagagaggccaaagagccagagcaacaggaacaatttgaaactgaattaaagtataaaatgacaattaatggaaaaattgcagtgctttatttgaaaaaaaacaagaacctccttgcaccaggctacacggaaacatattataattccactggaaaggagatcaccacaagcccacaaattatggatgattgttattatcaaggacatattcttaatgaaaaggtttctgacgctagcatcagcacatgtaggggtctaaggggctacttcagtcagggggatcaaagatactttattgaacctttaagccccatacatcgggatggacaggagcatgcactcttcaagtataaccctgatgaaaagaattatgacagcacctgtgggatggatggtgtgttgtgggcccacgatttgcagcagaacattgccctacctgccaccaaactagtaaaattgaaagacaggaaggttcaggaacatgagaaatacatagaatattatttggtcctggataatggtgagtttaaaaggtacaatgagaatcaagatgagatcagaaagagggtatttgagatggctaattatgtcaacatgctttataaaaagctcaatactcatgtggccttagttggtatggaaatctggactgacaaggataagataaagataaccccaaatgcaagcttcaccttggagaatttttctaaatggagggggagtgttctctcaagaagaaagcgtcatgatattgctcagttaatcacagcaacagaacttgctggaacgactgtgggtcttgcatttatgtctacaatgtgttctccttattctgttggcgttgttcaggaccacagcgataatcttcttagagttgcagggacaatggcacatgaaatgggccacaactttggaatgtttcatgacgactattcttgcaagtgtccttctacaatatgtgtgatggacaaagcactgagcttctatatacccacagacttcagttcctgcagccgtctcagctatgacaagttttttgaagataaattatcaaattgcctctttaatgctccattgcctacagatatcatatccactccaatttgtgggaaccagttggtggaaatgggagaggactgtgattgtgggacatctgaggaatgtaccaatatttgctgtgatgctaagacatgtaaaatcaaagcaacttttcaatgtgcattaggagaatgttgtgaaaaatgccaatttaaaaaggctgggatggtgtgcagaccagcaaaagatgagtgcgacctgcctgaaatgtgtaatggtaaatctggtaattgtcctgatgatagattccaagtcaatggcttcccttgccatcacgggaagggccactgcttgatggggacatgccccacactgcaggagcagtgcacagagctgtggggaccaggtaggaggacaaatcctttcccctgtgcatgtgcgaaggaaaatcatttcagatgacagtgtttaaccatggtcaaaggaccattctgtcctatccttcttagaagctttgaactcaaaatcatggaaaggttttaagatttgaggttggttttagggttgctagatttagcaagtaaaaataaggatggccccgttaaattttaacttaaaattaacaagttttttgttaattttttgttttttgtctcagcatcagtatatcccatgcaatatttgaggtgtgctcatactaaaattatttgtgtatctgaaattcaaattaaactgggtgtctttttcttttcatctggcaaccctactaagatcataaacccttggaaatctgtgtgtgtgcgggtgtgtgtgtgtgtgtgtgtgcaggggtggcagaagtactgtgggatgggacagaaataagaaaagatggaaaaaagaaaa

SEQ ID NO: 104649 - DNA, 1828 bp, Homo sapiens
  Payload ID: 548
  Gene Symbol: ADAM28
  Gene Name: ADAM metallopeptidase domain 28
  ENST ID: ENST00000521629
  CDS Start-End: 1-1162
cttctatatacccacagacttcagttcctgcagccgtctcagctatgacaagttttttgaagataaattatcaaattgcctctttaatgctccattgcctacagatatcatatccactccaatttgtgggaaccagttggtggaaatgggagaggactgtgattgtgggacatctgaggaatgtaccaatatttgctgtgatgctaagacatgtaaaatcaaagcaacttttcaatgtgcattaggagaatgttgtgaaaaatgccaatttaaaaaggctgggatggtgtgcagaccagcaaaagatgagtgcgacctgcctgaaatgtgtaatggtaaatctggtaattgtcctgatgatagattccaagtcaatggcttcccttgccatcacgggaagggccactgcttgatggggacatgccccacactgcaggagcagtgcacagagctgtggggaccaggaactgaggttgcagataagtcatgttacaacaggaatgaaggtgggtcaaagtacgggtactgtcgcagagtggatgacacactcattccctgcaaagcaaatgataccatgtgtgggaagttgttctgtcaaggtgggtcggataatttgccctggaaaggacggatagtgactttcctgacatgtaaaacatttgatcctgaagacacaagtcaagaaataggcatggtggccaatggaactaagtgtggcgataacaaggtttgcattaatgcagaatgtgtggatattgagaaagcctacaaatcaaccaattgctcatctaagtgcaaaggacatgctgtgtgtgaccatgagctccagtgtcaatgtgaggaaggatggatccctcccgactgcgatgactcctcagtggtcttccacttctccattgtggttggggtgctgttcccaatggcggtcatttttgtggtggttgctatggtaatccggcaccagagctccagagaaaagcagaagaaagatcagaggccactatctaccactggcaccaggccacacaaacagaagaggaaaccccagatggtaaaggctgttcaaccccaagagatgagtcagatgaagccccatgtgtatgatctgccagtagaaggcaatgagcccccagcctcttttgactcaaatccaaaagcatgaagcaacagctaagcaagaactaatggctaaattatcaacttggaaaactggaaaatctggatggcagagaaatatactatctatctcaccagtatttgctctcgactcaagaaggttaacattttctgattcatgttagactttgaagagactaaagaaaattttcaagaggaacatatgcctgagaacctttgcatgaatttaaaatttcaattatccattcttataagaaggaagatgattgtaaagaaatatctccgaagttaaaatctgtaataggaattgattcattctctaatgaaaacaaaacataaaaacatcacactaatcttggaggaataagaaaaattgtacatccattaaatgtacaattgattgcaacatcttgattgttttaaccattaacttgtcaaattacaatcacagttaagaaaatgatgtaaaattctgttttgtggatctctttcctagattagcttctgaaatcattattagctatatcatttgaggttttctacaatttggtataactaagaatttaaaaatgttttatcatatatatttgtataattaattactggcatggttaaagtggttttcactttttaaatggagaaaatttcagttaaattaataggataaaccaggttgcgaactggtgacctg

SEQ ID NO: 104650 - DNA, 2543 bp, Homo sapiens
  Payload ID: 548
  Gene Symbol: ADAM28
  Gene Name: ADAM metallopeptidase domain 28
  ENST ID: ENST00000520448
  CDS Start-End: 82-735
actggagaggaggcagggacagacccagcagcacccacctgagcgagaagagcagacaccgtgctcctggaatcacccagcatgttgcaaggtctcctgccagtcagtctcctcctctctgttgcagtaagtgctataaaagaactccctggggtgaagaagtatgaagtggtttatcctataagacttcatccactgcataaaagagaggccaaagagccagagcaacaggaacaatttgaaactgaattaaagtataaaatgacaattaatggaaaaattgcagtgctttatttgaaaaaaaacaagaacctccttgcaccaggctacacggaaacatattataattccactggaaaggagatcaccacaagcccacaaattatggatgattgttattatcaaggacatattcttaatgaaaaggtttctgacgctagcatcagcacatgtaggggtctaaggggctacttcagtcagggggatcaaagatactttattgaacctttaagccccatacatcgggatggacaggagcatgcactcttcaagtataaccctgatgaaaagaattatgacagcacctgtgggatggatggtgtgttgtgggcccacgatttgcagcagaacattgccctacctgccaccaaactagtaaaattgaaagacaggaaggttcaggaacatgagaaatacatagaatattatttggtcctggataatggtgagttttaaacagtttgctgggagatgtcactgggtttttcaatgaacgcacatgaagcatggaagcaaagtcaagacatttgagaccaatgtggctgactggctcccaaaggatgaccacaacttttgctacatagctttataaaaagctcaatactcatgtggccttagttggtatggaaatctggactgacaaggataagataaagataaccccaaatgcaagcttcaccttggagaatttttctaaatggagggggagtgttctctcaagaagaaagcgtcatgatattgctcagttaatcacagcaacagaacttgctggaacgactgtgggtcttgcatttatgtctacaatgtgttctccttattctgttggcgttgttcaggaccacagcgataatcttcttagagttgcagggacaatggcacatgaaatgggccacaactttggaatgtttcatgacgactattcttgcaagtgtccttctacaatatgtgtgatggacaaagcactgagcttctatatacccacagacttcagttcctgcagccgtctcagctatgacaagttttttgaagataaattatcaaattgcctctttaatgctccattgcctacagatatcatatccactccaatttgtgggaaccagttggtggaaatgggagaggactgtgattgtgggacatctgaggaatgtaccaatatttgctgtgatgctaagacatgtaaaatcaaagcaacttttcaatgtgcattaggagaatgttgtgaaaaatgccaatttaaaaaggctgggatggtgtgcagaccagcaaaagatgagtgcgacctgcctgaaatgtgtaatggtaaatctggtaattgtcctgatgatagattccaagtcaatggcttcccttgccatcacgggaagggccactgcttgatggggacatgccccacactgcaggagcagtgcacagagctgtggggaccaggaactgaggttgcagataagtcatgttacaacaggaatgaaggtgggtcaaagtacgggtactgtcgcagagtggatgacacactcattccctgcaaagcaaatgataccatgtgtgggaagttgttctgtcaaggtgggtcggataatttgccctggaaaggacggatagtgactttcctgacatgtaaaacatttgatcctgaagacacaagtcaagaaataggcatggtggccaatggaactaagtgtggcgataacaaggtttgcattaatgcagaatgtgtggatattgagaaagcctacaaatcaaccaattgctcatctaagtgcaaaggacatgctgtgtgtgaccatgagctccagtgtcaatgtgaggaaggatggatccctcccgactgcgatgactcctcagtggtcttccgtagacttctccattgtggttggggtgctgttcccaatggcggtcatttttgtggtggttgctatggtaatccggcaccagagctccagagaaaagcagaagaaagatcagaggccactatctaccactggcaccaggccacacaaacagaagaggaaaccccagatggtaaaggctgttcaaccccaagagatgagtcagatgaagccccatgtgtatgatctgccagtagaaggcaatgagcccccagcctcttttcataaagacacaaacgcacttccccctactgttttcaaggataatccagtgtctacacctaaggactcaaatccaaaagcatgaagcaacagctaagcaagaactaatggctaaattatcaacttggaaaactggaaaatctggatggcaga

SEQ ID NO: 104651 - DNA, 684 bp, Homo sapiens
  Payload ID: 548
  Gene Symbol: ADAM28
  Gene Name: ADAM metallopeptidase domain 28
  ENST ID: ENST00000518326
  CDS Start-End: 1-523
gaaaggacggatagtgactttcctgacatgtaaaacatttgatcctgaagacacaagtcaagaaataggcatggtggccaatggaactaagtgtggcgataacaaggtttgcattaatgcagaatgtgtggatattgagaaagcctacaaatcaaccaattgctcatctaagtgcaaaggacatgctgtgtgtgaccatgagctccagtgtcaatgtgaggaaggatggatccctcccgactgcgatgactcctcagtggtcttccacttctccattgtggttggggtgctgttcccaatggcggtcatttttgtggtggttgctatggtaatccggcaccagagctccagagaaaagcagaagaaagatcagaggccactatctaccactggcaccaggccacacaaacagaagaggaaaccccagatggtaaaggctgttcaaccccaagaggtgaactatatagtctgggctgtgattaccatggccccactttgcgtttctctcacactcttatcctgactacctatctatcatttctacccagcagcgttttgcagtaacacattcagaaatgtctcctttgccttttgttaaaggcaaaagagtccctaaaatgccgaggctactttgccggggttcatgaaatgcaaacagaataaagagaacaaagaatgcacata

SEQ ID NO: 104652 - DNA, 582 bp, Homo sapiens
  Payload ID: 548
  Gene Symbol: ADAM28
  Gene Name: ADAM metallopeptidase domain 28
  ENST ID: ENST00000523379
  CDS Start-End: 82-258
actggagaggaggcagggacagacccagcagcacccacctgagcgagaagagcagacaccgtgctcctggaatcacccagcatgttgcaaggtctcctgccagtcagtctcctcctctctgttgcagtaagtgctataaaagaactccctggggtgaagaagtatgaagtggtttatcctataagacttcatccactgcataaaagagaggccaaagagccagagcaacagttcctgtcatccatgaaaataagctgagtccatcaacctctacttatctaggcccacatttgggggaaatttatagcctgggattactgacagcagagcagacctcaacaactgaggatttaagcaaagaacaatttgaaactgaattaaagtataaaatgacaattaatggaaaaattgcagtgctttatttgaaaaaaaacaagaacctccttgcaccaggctacacggaaacatattataattccactggaaaggagatcaccacaagcccacaaattatggatgattgttattatcaaggacatattcttaatgaaaaggtttctgacgctagcatcagcacatgta

SEQ ID NO: 104653 - DNA, 3325 bp, Homo sapiens
  Payload ID: 549
  Gene Symbol: ADAM29
  Gene Name: ADAM metallopeptidase domain 29
  Uniprot ID: Q9UKF5
  ENST ID: ENST00000359240
  CDS Start-End: 671-3133
gtgacatcacatccactaaccaaatggggtggtgtgagtatctcctataaaataaaagctctcctgatggcctgttcctgcacatttcctgaggacgccctcgatcacaagcagcttgctggatgaataaaggaaagaaggtttatatacactaataatagaaatgttttgggatggttcatgatttcgaaaagcttcagagaaaataaagatgcttaatgttagagtacaaaacattctccctgcagtctcacgaactgtgaacaaaaactgaagtgaaaactcatagtgcataactcgtcaatactcctgtgatcgtataaccatcagcaagaaaacaaatttgattgagcccccatccagtcctctttgcgtggaatcagacctcttttgcagtggaaaggagcagagaatgtgactttcctgaacaacaggagcaagaatcaatgccagattctcttctctaaaaataatcaatttgttactacagtgctgcagctctgatggttcaactctgccaaaagatggatctttaatgattagcactacacactgaccaactcagaagaaggagccacaccacctgtgactccagccctgacttctgctctggaccagtgtttccataacagggacttcaaaatcactgtgatttgaagcctttttgaacatgaagatgttactcctgctgcattgccttggggtgtttctgtcctgttctggacacatccaggatgagcacccccaatatcacagccctccggatgtggtgattcctgtgaggataactggcaccaccagaggcatgacacctccaggctggctctcctatatcctgccctttggaggccagaaacacattatccacataaaggtcaagaagcttttgttttccaaacacctccctgtgttcacctacacagaccagggtgctatccttgaggaccagccatttgtccagaataactgctactatcatggttatgtggaaggggacccagaatccctggtttccctcagtacctgttttgggggttttcaaggaatattacagataaatgactttgcttatgaaatcaagcccctagcattttctaccacgtttgaacatctggtatacaagatggacagtgaggagaaacaattttcaaccatgagatccggatttatgcaaaatgaaataacatgccgaatggaatttgaagaaattgataattccactcagaagcaaagttcttatgtgggctggtggatccattttaggattgttgaaattgtagtcgtcattgataattatctgtacattcgttatgaaaggaacgactcaaagttgctggaggatctatatgttattgttaatatagtggattccattttggatgtcattggtgttaaggtgttattatttggtttggagatctggaccaataaaaacctcattgtagtagatgatgtaaggaaatctgtgcacctgtattgcaagtggaagtcggagaacattacgccccggatgcaacatgacacctcacatcttttcacaactctaggattaagagggttaagtggcataggagcttttagaggaatgtgtacaccacaccgtagttgtgcaattgttactttcatgaacaaaactttgggcactttttcaattgcagtggctcatcatctaggtcataatttgggcatgaaccatgatgaggatacatgtcgttgttcacaacctagatgcataatgcatgaaggcaacccaccaataactaaatttagcaattgtagttatggtgatttttgggaatatactgtagagaggacaaagtgtttgcttgaaacagtacacacaaaggacatctttaatgtgaagcgctgtgggaatggtgttgttgaagaaggagaagagtgtgactgtggacctttaaagcattgtgcaaaagatccctgctgtctgtcaaattgcactctgactgatggttctacttgtgcttttgggctttgttgcaaagactgcaagttcctaccatcagggaaagtgtgtagaaaggaggtcaatgaatgtgatcttccagagtggtgcaatggtacttcccataagtgcccagatgacttttatgtggaagatggaattccctgtaaggagaggggctactgctatgaaaagagctgtcatgaccgcaatgaacagtgtaggaggatttttggtgcaggcgcaaatactgcaagtgagacttgctacaaagaattgaacaccttaggtgaccgtgttggtcactgtggtatcaaaaatgctacatatataaagtgtaatatctcagatgtccagtgtggaagaattcagtgtgagaatgtgacagaaattcccaatatgagtgatcatactactgtgcattgggctcgcttcaatgacataatgtgctggagtactgattaccatttggggatgaagggacctgatattggtgaagtgaaagatggaacagagtgtgggatagatcatatatgcatccacaggcactgtgtccatataaccatcttgaatagtaattgctcacctgcattttgtaacaagaggggcatctgcaacaataaacatcactgccattgcaattatctgtgggaccctcccaactgcctgataaaaggctatggaggtagtgttgacagtggcccaccccctaagagaaagaagaaaaagaagttctgttatctgtgtatattgttgcttattgttttgtttattttattatgttgtctttatcgactttgtaaaaaaagtaaaccaataaaaaagcagcaagatgttcaaactccatctgcaaaagaagaggaaaaaattcagcgtcgacctcatgagttacctccccagagtcaaccttgggtgatgccttcccagagtcaacctcctgtgacgccttcccagagtcatcctcaggtgatgccttcccagagtcaacctcctgtgacaccctcccagagtcaacctcgggtgatgccttctcagagtcaacctcctgtgatgccttcccagagtcatcctcagttgacgccttcccagagtcaacctcctgtgacaccctcccagaggcaacctcagttgatgccttcccagagtcaacctcctgtgacgccctcctagagccaacctcagttgatgccttcccagagtcaacctcctgtgacgccctcccagagccaacctcgggtgacaccctcccagagtcaacctcatgtgacaccttaccggagtaaaagtggtaaacaaaagcaatcagtaccaattccaaaaactgtatccagaaaaggtacattaaaaaaataattcctagta

SEQ ID NO: 104654 - DNA, 3171 bp, Homo sapiens
  Payload ID: 549
  Gene Symbol: ADAM29
  Gene Name: ADAM metallopeptidase domain 29
  Uniprot ID: Q9UKF5
  ENST ID: ENST00000404450
  CDS Start-End: 517-2979
aaaataaaagctctcctgatggcctgttcctgcacatttcctgaggacgccctcgatcacaagcaggttagagtacaaaacattctccctgcagtctcacgaactgtgaacaaaaactgaagtgaaaactcatagtgcataactcgtcaatactcctgtgatcgtataaccatcagcaagaaaacaaatttgattgagcccccatccagtcctctttgcgtggaatcagacctcttttgcagtggaaaggagcagagaatgtgactttcctgaacaacaggagcaagaatcaatgccagattctcttctctaaaaataatcaatttgttactacagtgctgcagctctgatggttcaactctgccaaaagatggatctttaatgattagcactacacactgaccaactcagaagaaggagccacaccacctgtgactccagccctgacttctgctctggaccagtgtttccataacagggacttcaaaatcactgtgatttgaagcctttttgaacatgaagatgttactcctgctgcattgccttggggtgtttctgtcctgttctggacacatccaggatgagcacccccaatatcacagccctccggatgtggtgattcctgtgaggataactggcaccaccagaggcatgacacctccaggctggctctcctatatcctgccctttggaggccagaaacacattatccacataaaggtcaagaagcttttgttttccaaacacctccctgtgttcacctacacagaccagggtgctatccttgaggaccagccatttgtccagaataactgctactatcatggttatgtggaaggggacccagaatccctggtttccctcagtacctgttttgggggttttcaaggaatattacagataaatgactttgcttatgaaatcaagcccctagcattttctaccacgtttgaacatctggtatacaagatggacagtgaggagaaacaattttcaaccatgagatccggatttatgcaaaatgaaataacatgccgaatggaatttgaagaaattgataattccactcagaagcaaagttcttatgtgggctggtggatccattttaggattgttgaaattgtagtcgtcattgataattatctgtacattcgttatgaaaggaacgactcaaagttgctggaggatctatatgttattgttaatatagtggattccattttggatgtcattggtgttaaggtgttattatttggtttggagatctggaccaataaaaacctcattgtagtagatgatgtaaggaaatctgtgcacctgtattgcaagtggaagtcggagaacattacgccccggatgcaacatgacacctcacatcttttcacaactctaggattaagagggttaagtggcataggagcttttagaggaatgtgtacaccacaccgtagttgtgcaattgttactttcatgaacaaaactttgggcactttttcaattgcagtggctcatcatctaggtcataatttgggcatgaaccatgatgaggatacatgtcgttgttcacaacctagatgcataatgcatgaaggcaacccaccaataactaaatttagcaattgtagttatggtgatttttgggaatatactgtagagaggacaaagtgtttgcttgaaacagtacacacaaaggacatctttaatgtgaagcgctgtgggaatggtgttgttgaagaaggagaagagtgtgactgtggacctttaaagcattgtgcaaaagatccctgctgtctgtcaaattgcactctgactgatggttctacttgtgcttttgggctttgttgcaaagactgcaagttcctaccatcagggaaagtgtgtagaaaggaggtcaatgaatgtgatcttccagagtggtgcaatggtacttcccataagtgcccagatgacttttatgtggaagatggaattccctgtaaggagaggggctactgctatgaaaagagctgtcatgaccgcaatgaacagtgtaggaggatttttggtgcaggcgcaaatactgcaagtgagacttgctacaaagaattgaacaccttaggtgaccgtgttggtcactgtggtatcaaaaatgctacatatataaagtgtaatatctcagatgtccagtgtggaagaattcagtgtgagaatgtgacagaaattcccaatatgagtgatcatactactgtgcattgggctcgcttcaatgacataatgtgctggagtactgattaccatttggggatgaagggacctgatattggtgaagtgaaagatggaacagagtgtgggatagatcatatatgcatccacaggcactgtgtccatataaccatcttgaatagtaattgctcacctgcattttgtaacaagaggggcatctgcaacaataaacatcactgccattgcaattatctgtgggaccctcccaactgcctgataaaaggctatggaggtagtgttgacagtggcccaccccctaagagaaagaagaaaaagaagttctgttatctgtgtatattgttgcttattgttttgtttattttattatgttgtctttatcgactttgtaaaaaaagtaaaccaataaaaaagcagcaagatgttcaaactccatctgcaaaagaagaggaaaaaattcagcgtcgacctcatgagttacctccccagagtcaaccttgggtgatgccttcccagagtcaacctcctgtgacgccttcccagagtcatcctcaggtgatgccttcccagagtcaacctcctgtgacaccctcccagagtcaacctcgggtgatgccttctcagagtcaacctcctgtgatgccttcccagagtcatcctcagttgacgccttcccagagtcaacctcctgtgacaccctcccagaggcaacctcagttgatgccttcccagagtcaacctcctgtgacgccctcctagagccaacctcagttgatgccttcccagagtcaacctcctgtgacgccctcccagagccaacctcgggtgacaccctcccagagtcaacctcatgtgacaccttaccggagtaaaagtggtaaacaaaagcaatcagtaccaattccaaaaactgtatccagaaaaggtacattaaaaaaataattcctagta

SEQ ID NO: 104655 - DNA, 3244 bp, Homo sapiens
  Payload ID: 549
  Gene Symbol: ADAM29
  Gene Name: ADAM metallopeptidase domain 29
  Uniprot ID: Q9UKF5
  ENST ID: ENST00000445694
  CDS Start-End: 590-3052
gtgacatcacatccactaaccaaatggggtggtgtgagtatctcctataaaataaaagctctcctgatggcctgttcctgcacatttcctgaggacgccctcgatcacaagcagcttgctggatgaataaaggaaagaaggtttatatacactaataatagaaatgttttgggatggttcatgatttcgaaaagcttcagagaaaataaagatgcttaatgttagagtacaaaacattctccctgcagtctcacgaactgtgaacaaaaactgaagtgaaaactcatagtgcataactcgtcaatactcctgtgatcgtataaccatcagcaagaaaacaaatttgattgagcccccatccagtcctctttgcgtggaatcagacctcttttgcagtggaaaggagcagtgctgcagctctgatggttcaactctgccaaaagatggatctttaatgattagcactacacactgaccaactcagaagaaggagccacaccacctgtgactccagccctgacttctgctctggaccagtgtttccataacagggacttcaaaatcactgtgatttgaagcctttttgaacatgaagatgttactcctgctgcattgccttggggtgtttctgtcctgttctggacacatccaggatgagcacccccaatatcacagccctccggatgtggtgattcctgtgaggataactggcaccaccagaggcatgacacctccaggctggctctcctatatcctgccctttggaggccagaaacacattatccacataaaggtcaagaagcttttgttttccaaacacctccctgtgttcacctacacagaccagggtgctatccttgaggaccagccatttgtccagaataactgctactatcatggttatgtggaaggggacccagaatccctggtttccctcagtacctgttttgggggttttcaaggaatattacagataaatgactttgcttatgaaatcaagcccctagcattttctaccacgtttgaacatctggtatacaagatggacagtgaggagaaacaattttcaaccatgagatccggatttatgcaaaatgaaataacatgccgaatggaatttgaagaaattgataattccactcagaagcaaagttcttatgtgggctggtggatccattttaggattgttgaaattgtagtcgtcattgataattatctgtacattcgttatgaaaggaacgactcaaagttgctggaggatctatatgttattgttaatatagtggattccattttggatgtcattggtgttaaggtgttattatttggtttggagatctggaccaataaaaacctcattgtagtagatgatgtaaggaaatctgtgcacctgtattgcaagtggaagtcggagaacattacgccccggatgcaacatgacacctcacatcttttcacaactctaggattaagagggttaagtggcataggagcttttagaggaatgtgtacaccacaccgtagttgtgcaattgttactttcatgaacaaaactttgggcactttttcaattgcagtggctcatcatctaggtcataatttgggcatgaaccatgatgaggatacatgtcgttgttcacaacctagatgcataatgcatgaaggcaacccaccaataactaaatttagcaattgtagttatggtgatttttgggaatatactgtagagaggacaaagtgtttgcttgaaacagtacacacaaaggacatctttaatgtgaagcgctgtgggaatggtgttgttgaagaaggagaagagtgtgactgtggacctttaaagcattgtgcaaaagatccctgctgtctgtcaaattgcactctgactgatggttctacttgtgcttttgggctttgttgcaaagactgcaagttcctaccatcagggaaagtgtgtagaaaggaggtcaatgaatgtgatcttccagagtggtgcaatggtacttcccataagtgcccagatgacttttatgtggaagatggaattccctgtaaggagaggggctactgctatgaaaagagctgtcatgaccgcaatgaacagtgtaggaggatttttggtgcaggcgcaaatactgcaagtgagacttgctacaaagaattgaacaccttaggtgaccgtgttggtcactgtggtatcaaaaatgctacatatataaagtgtaatatctcagatgtccagtgtggaagaattcagtgtgagaatgtgacagaaattcccaatatgagtgatcatactactgtgcattgggctcgcttcaatgacataatgtgctggagtactgattaccatttggggatgaagggacctgatattggtgaagtgaaagatggaacagagtgtgggatagatcatatatgcatccacaggcactgtgtccatataaccatcttgaatagtaattgctcacctgcattttgtaacaagaggggcatctgcaacaataaacatcactgccattgcaattatctgtgggaccctcccaactgcctgataaaaggctatggaggtagtgttgacagtggcccaccccctaagagaaagaagaaaaagaagttctgttatctgtgtatattgttgcttattgttttgtttattttattatgttgtctttatcgactttgtaaaaaaagtaaaccaataaaaaagcagcaagatgttcaaactccatctgcaaaagaagaggaaaaaattcagcgtcgacctcatgagttacctccccagagtcaaccttgggtgatgccttcccagagtcaacctcctgtgacgccttcccagagtcatcctcaggtgatgccttcccagagtcaacctcctgtgacaccctcccagagtcaacctcgggtgatgccttctcagagtcaacctcctgtgatgccttcccagagtcatcctcagttgacgccttcccagagtcaacctcctgtgacaccctcccagaggcaacctcagttgatgccttcccagagtcaacctcctgtgacgccctcctagagccaacctcagttgatgccttcccagagtcaacctcctgtgacgccctcccagagccaacctcgggtgacaccctcccagagtcaacctcatgtgacaccttaccggagtaaaagtggtaaacaaaagcaatcagtaccaattccaaaaactgtatccagaaaaggtacattaaaaaaataattcctagta

SEQ ID NO: 104656 - DNA, 788 bp, Homo sapiens
  Payload ID: 549
  Gene Symbol: ADAM29
  Gene Name: ADAM metallopeptidase domain 29
  ENST ID: ENST00000502305
  CDS Start-End: 657-788
actaaccaaatggggtggtgtgagtatctcctataaaataaaagctctcctgatggcctgttcctgcacatttcctgaggacgccctcgatcacaagcagcttgctggatgaataaaggaaagaaggtttatatacactaataatagaaatgttttgggatggttcatgatttcgaaaagcttcagagaaaataaagatgcttaatgttagagtacaaaacattctccctgcagtctcacgaactgtgaacaaaaactgaagtgaaaactcatagtgcataactcgtcaatactcctgtgatcgtataaccatcagcaagaaaacaaatttgattgagcccccatccagtcctctttgcgtggaatcagacctcttttgcagtggaaaggagcagagaatgtgactttcctgaacaacaggagcaagaatcaatgccagattctcttctctaaaaataatcaatttgttactacagtgctgcagctctgatggttcaactctgccaaaagatggatctttaatgattagcactacacactgaccaactcagaagaaggagccacaccacctgtgactccagccctgacttctgctctggaccagtgtttccataacagggacttcaaaatcactgtgatttgaagcctttttgaacatgaagatgttactcctgctgcattgccttggggtgtttctgtcctgttctggacacatccaggatgagcacccccaatatcacagccctccggatgtggtgattcctgtgaggataactggcaccaccaga

SEQ ID NO: 104657 - DNA, 3010 bp, Homo sapiens
  Payload ID: 549
  Gene Symbol: ADAM29
  Gene Name: ADAM metallopeptidase domain 29
  Uniprot ID: Q9UKF5
  ENST ID: ENST00000514159
  CDS Start-End: 431-2893
aaaagctctcctgatggcctgttcctgcacatttcctgaggacgccctcgatcacaagcaggttagagtacaaaacattctccctgcagtctcacgaactgtgaacaaaaactgaagtgaaaactcatagtgcataactcgtcaatactcctgtgatcgtataaccatcagcaagaaaacaaatttgattgagcccccatccagtcctctttgcgtggaatcagacctcttttgcagtggaaaggagcagtgctgcagctctgatggttcaactctgccaaaagatggatctttaatgattagcactacacactgaccaactcagaagaaggagccacaccacctgtgactccagccctgacttctgctctggaccagtgtttccataacagggacttcaaaatcactgtgatttgaagcctttttgaacatgaagatgttactcctgctgcattgccttggggtgtttctgtcctgttctggacacatccaggatgagcacccccaatatcacagccctccggatgtggtgattcctgtgaggataactggcaccaccagaggcatgacacctccaggctggctctcctatatcctgccctttggaggccagaaacacattatccacataaaggtcaagaagcttttgttttccaaacacctccctgtgttcacctacacagaccagggtgctatccttgaggaccagccatttgtccagaataactgctactatcatggttatgtggaaggggacccagaatccctggtttccctcagtacctgttttgggggttttcaaggaatattacagataaatgactttgcttatgaaatcaagcccctagcattttctaccacgtttgaacatctggtatacaagatggacagtgaggagaaacaattttcaaccatgagatccggatttatgcaaaatgaaataacatgccgaatggaatttgaagaaattgataattccactcagaagcaaagttcttatgtgggctggtggatccattttaggattgttgaaattgtagtcgtcattgataattatctgtacattcgttatgaaaggaacgactcaaagttgctggaggatctatatgttattgttaatatagtggattccattttggatgtcattggtgttaaggtgttattatttggtttggagatctggaccaataaaaacctcattgtagtagatgatgtaaggaaatctgtgcacctgtattgcaagtggaagtcggagaacattacgccccggatgcaacatgacacctcacatcttttcacaactctaggattaagagggttaagtggcataggagcttttagaggaatgtgtacaccacaccgtagttgtgcaattgttactttcatgaacaaaactttgggcactttttcaattgcagtggctcatcatctaggtcataatttgggcatgaaccatgatgaggatacatgtcgttgttcacaacctagatgcataatgcatgaaggcaacccaccaataactaaatttagcaattgtagttatggtgatttttgggaatatactgtagagaggacaaagtgtttgcttgaaacagtacacacaaaggacatctttaatgtgaagcgctgtgggaatggtgttgttgaagaaggagaagagtgtgactgtggacctttaaagcattgtgcaaaagatccctgctgtctgtcaaattgcactctgactgatggttctacttgtgcttttgggctttgttgcaaagactgcaagttcctaccatcagggaaagtgtgtagaaaggaggtcaatgaatgtgatcttccagagtggtgcaatggtacttcccataagtgcccagatgacttttatgtggaagatggaattccctgtaaggagaggggctactgctatgaaaagagctgtcatgaccgcaatgaacagtgtaggaggatttttggtgcaggcgcaaatactgcaagtgagacttgctacaaagaattgaacaccttaggtgaccgtgttggtcactgtggtatcaaaaatgctacatatataaagtgtaatatctcagatgtccagtgtggaagaattcagtgtgagaatgtgacagaaattcccaatatgagtgatcatactactgtgcattgggctcgcttcaatgacataatgtgctggagtactgattaccatttggggatgaagggacctgatattggtgaagtgaaagatggaacagagtgtgggatagatcatatatgcatccacaggcactgtgtccatataaccatcttgaatagtaattgctcacctgcattttgtaacaagaggggcatctgcaacaataaacatcactgccattgcaattatctgtgggaccctcccaactgcctgataaaaggctatggaggtagtgttgacagtggcccaccccctaagagaaagaagaaaaagaagttctgttatctgtgtatattgttgcttattgttttgtttattttattatgttgtctttatcgactttgtaaaaaaagtaaaccaataaaaaagcagcaagatgttcaaactccatctgcaaaagaagaggaaaaaattcagcgtcgacctcatgagttacctccccagagtcaaccttgggtgatgccttcccagagtcaacctcctgtgacgccttcccagagtcatcctcaggtgatgccttcccagagtcaacctcctgtgacaccctcccagagtcaacctcgggtgatgccttctcagagtcaacctcctgtgatgccttcccagagtcatcctcagttgacgccttcccagagtcaacctcctgtgacaccctcccagaggcaacctcagttgatgccttcccagagtcaacctcctgtgacgccctcctagagccaacctcagttgatgccttcccagagtcaacctcctgtgacgccctcccagagccaacctcgggtgacaccctcccagagtcaacctcatgtgacaccttaccggagtaaaagt

SEQ ID NO: 104658 - DNA, 632 bp, Homo sapiens
  Payload ID: 549
  Gene Symbol: ADAM29
  Gene Name: ADAM metallopeptidase domain 29
  ENST ID: ENST00000505141
  CDS Start-End: 590-632
gtgacatcacatccactaaccaaatggggtggtgtgagtatctcctataaaataaaagctctcctgatggcctgttcctgcacatttcctgaggacgccctcgatcacaagcagcttgctggatgaataaaggaaagaaggtttatatacactaataatagaaatgttttgggatggttcatgatttcgaaaagcttcagagaaaataaagatgcttaatgttagagtacaaaacattctccctgcagtctcacgaactgtgaacaaaaactgaagtgaaaactcatagtgcataactcgtcaatactcctgtgatcgtataaccatcagcaagaaaacaaatttgattgagcccccatccagtcctctttgcgtggaatcagacctcttttgcagtggaaaggagcagtgctgcagctctgatggttcaactctgccaaaagatggatctttaatgattagcactacacactgaccaactcagaagaaggagccacaccacctgtgactccagccctgacttctgctctggaccagtgtttccataacagggacttcaaaatcactgtgatttgaagcctttttgaacatgaagatgttactcctgctgcattgccttggggtgtttctgt

SEQ ID NO: 104659 - DNA, 555 bp, Homo sapiens
  Payload ID: 549
  Gene Symbol: ADAM29
  Gene Name: ADAM metallopeptidase domain 29
  ENST ID: ENST00000502940
  CDS Start-End: 287-555
acatccactaaccaaatggggtggtgtgagtatctcctataaaataaaagctctcctgatggcctgttcctgcacatttcctgaggacgccctcgatcacaagcagtgctgcagctctgatggttcaactctgccaaaagatggatctttaatgattagcactacacactgaccaactcagaagaaggagccacaccacctgtgactccagccctgacttctgctctggaccagtgtttccataacagggacttcaaaatcactgtgatttgaagcctttttgaacatgaagatgttactcctgctgcattgccttggggtgtttctgtcctgttctggacacatccaggatgagcacccccaatatcacagccctccggatgtggtgattcctgtgaggataactggcaccaccagaggcatgacacctccaggctggctctcctatatcctgccctttggaggccagaaacacattatccacataaaggtcaagaagcttttgttttccaaacacctccctgtgttcacctacacagaccagggtgctatcct

SEQ ID NO: 104660 - DNA, 2949 bp, Homo sapiens
  Payload ID: 549
  Gene Symbol: ADAM29
  Gene Name: ADAM metallopeptidase domain 29
  Uniprot ID: Q9UKF5
  ENST ID: ENST00000618444
  CDS Start-End: 295-2757
gtgacatcacatccactaaccaaatggggtggtgtgagtatctcctataaaataaaagctctcctgatggcctgttcctgcacatttcctgaggacgccctcgatcacaagcagtgctgcagctctgatggttcaactctgccaaaagatggatctttaatgattagcactacacactgaccaactcagaagaaggagccacaccacctgtgactccagccctgacttctgctctggaccagtgtttccataacagggacttcaaaatcactgtgatttgaagcctttttgaacatgaagatgttactcctgctgcattgccttggggtgtttctgtcctgttctggacacatccaggatgagcacccccaatatcacagccctccggatgtggtgattcctgtgaggataactggcaccaccagaggcatgacacctccaggctggctctcctatatcctgccctttggaggccagaaacacattatccacataaaggtcaagaagcttttgttttccaaacacctccctgtgttcacctacacagaccagggtgctatccttgaggaccagccatttgtccagaataactgctactatcatggttatgtggaaggggacccagaatccctggtttccctcagtacctgttttgggggttttcaaggaatattacagataaatgactttgcttatgaaatcaagcccctagcattttctaccacgtttgaacatctggtatacaagatggacagtgaggagaaacaattttcaaccatgagatccggatttatgcaaaatgaaataacatgccgaatggaatttgaagaaattgataattccactcagaagcaaagttcttatgtgggctggtggatccattttaggattgttgaaattgtagtcgtcattgataattatctgtacattcgttatgaaaggaacgactcaaagttgctggaggatctatatgttattgttaatatagtggattccattttggatgtcattggtgttaaggtgttattatttggtttggagatctggaccaataaaaacctcattgtagtagatgatgtaaggaaatctgtgcacctgtattgcaagtggaagtcggagaacattacgccccggatgcaacatgacacctcacatcttttcacaactctaggattaagagggttaagtggcataggagcttttagaggaatgtgtacaccacaccgtagttgtgcaattgttactttcatgaacaaaactttgggcactttttcaattgcagtggctcatcatctaggtcataatttgggcatgaaccatgatgaggatacatgtcgttgttcacaacctagatgcataatgcatgaaggcaacccaccaataactaaatttagcaattgtagttatggtgatttttgggaatatactgtagagaggacaaagtgtttgcttgaaacagtacacacaaaggacatctttaatgtgaagcgctgtgggaatggtgttgttgaagaaggagaagagtgtgactgtggacctttaaagcattgtgcaaaagatccctgctgtctgtcaaattgcactctgactgatggttctacttgtgcttttgggctttgttgcaaagactgcaagttcctaccatcagggaaagtgtgtagaaaggaggtcaatgaatgtgatcttccagagtggtgcaatggtacttcccataagtgcccagatgacttttatgtggaagatggaattccctgtaaggagaggggctactgctatgaaaagagctgtcatgaccgcaatgaacagtgtaggaggatttttggtgcaggcgcaaatactgcaagtgagacttgctacaaagaattgaacaccttaggtgaccgtgttggtcactgtggtatcaaaaatgctacatatataaagtgtaatatctcagatgtccagtgtggaagaattcagtgtgagaatgtgacagaaattcccaatatgagtgatcatactactgtgcattgggctcgcttcaatgacataatgtgctggagtactgattaccatttggggatgaagggacctgatattggtgaagtgaaagatggaacagagtgtgggatagatcatatatgcatccacaggcactgtgtccatataaccatcttgaatagtaattgctcacctgcattttgtaacaagaggggcatctgcaacaataaacatcactgccattgcaattatctgtgggaccctcccaactgcctgataaaaggctatggaggtagtgttgacagtggcccaccccctaagagaaagaagaaaaagaagttctgttatctgtgtatattgttgcttattgttttgtttattttattatgttgtctttatcgactttgtaaaaaaagtaaaccaataaaaaagcagcaagatgttcaaactccatctgcaaaagaagaggaaaaaattcagcgtcgacctcatgagttacctccccagagtcaaccttgggtgatgccttcccagagtcaacctcctgtgacgccttcccagagtcatcctcaggtgatgccttcccagagtcaacctcctgtgacaccctcccagagtcaacctcgggtgatgccttctcagagtcaacctcctgtgatgccttcccagagtcatcctcagttgacgccttcccagagtcaacctcctgtgacaccctcccagaggcaacctcagttgatgccttcccagagtcaacctcctgtgacgccctcctagagccaacctcagttgatgccttcccagagtcaacctcctgtgacgccctcccagagccaacctcgggtgacaccctcccagagtcaacctcatgtgacaccttaccggagtaaaagtggtaaacaaaagcaatcagtaccaattccaaaaactgtatccagaaaaggtacattaaaaaaataattcctagta

SEQ ID NO: 104661 - DNA, 3386 bp, Homo sapiens
  Payload ID: 549
  Gene Symbol: ADAM29
  Gene Name: ADAM metallopeptidase domain 29
  Uniprot ID: Q9UKF5
  ENST ID: ENST00000615367
  CDS Start-End: 732-3194
gtgacatcacatccactaaccaaatggggtggtgtgagtatctcctataaaataaaagctctcctgatggcctgttcctgcacatttcctgaggacgccctcgatcacaagcagaatctgtttaattcagagtcatatgtttgctttcttctgagaaattcgataacgtacactgcttgctggatgaataaaggaaagaaggtttatatacactaataatagaaatgttttgggatggttcatgatttcgaaaagcttcagagaaaataaagatgcttaatgttagagtacaaaacattctccctgcagtctcacgaactgtgaacaaaaactgaagtgaaaactcatagtgcataactcgtcaatactcctgtgatcgtataaccatcagcaagaaaacaaatttgattgagcccccatccagtcctctttgcgtggaatcagacctcttttgcagtggaaaggagcagagaatgtgactttcctgaacaacaggagcaagaatcaatgccagattctcttctctaaaaataatcaatttgttactacagtgctgcagctctgatggttcaactctgccaaaagatggatctttaatgattagcactacacactgaccaactcagaagaaggagccacaccacctgtgactccagccctgacttctgctctggaccagtgtttccataacagggacttcaaaatcactgtgatttgaagcctttttgaacatgaagatgttactcctgctgcattgccttggggtgtttctgtcctgttctggacacatccaggatgagcacccccaatatcacagccctccggatgtggtgattcctgtgaggataactggcaccaccagaggcatgacacctccaggctggctctcctatatcctgccctttggaggccagaaacacattatccacataaaggtcaagaagcttttgttttccaaacacctccctgtgttcacctacacagaccagggtgctatccttgaggaccagccatttgtccagaataactgctactatcatggttatgtggaaggggacccagaatccctggtttccctcagtacctgttttgggggttttcaaggaatattacagataaatgactttgcttatgaaatcaagcccctagcattttctaccacgtttgaacatctggtatacaagatggacagtgaggagaaacaattttcaaccatgagatccggatttatgcaaaatgaaataacatgccgaatggaatttgaagaaattgataattccactcagaagcaaagttcttatgtgggctggtggatccattttaggattgttgaaattgtagtcgtcattgataattatctgtacattcgttatgaaaggaacgactcaaagttgctggaggatctatatgttattgttaatatagtggattccattttggatgtcattggtgttaaggtgttattatttggtttggagatctggaccaataaaaacctcattgtagtagatgatgtaaggaaatctgtgcacctgtattgcaagtggaagtcggagaacattacgccccggatgcaacatgacacctcacatcttttcacaactctaggattaagagggttaagtggcataggagcttttagaggaatgtgtacaccacaccgtagttgtgcaattgttactttcatgaacaaaactttgggcactttttcaattgcagtggctcatcatctaggtcataatttgggcatgaaccatgatgaggatacatgtcgttgttcacaacctagatgcataatgcatgaaggcaacccaccaataactaaatttagcaattgtagttatggtgatttttgggaatatactgtagagaggacaaagtgtttgcttgaaacagtacacacaaaggacatctttaatgtgaagcgctgtgggaatggtgttgttgaagaaggagaagagtgtgactgtggacctttaaagcattgtgcaaaagatccctgctgtctgtcaaattgcactctgactgatggttctacttgtgcttttgggctttgttgcaaagactgcaagttcctaccatcagggaaagtgtgtagaaaggaggtcaatgaatgtgatcttccagagtggtgcaatggtacttcccataagtgcccagatgacttttatgtggaagatggaattccctgtaaggagaggggctactgctatgaaaagagctgtcatgaccgcaatgaacagtgtaggaggatttttggtgcaggcgcaaatactgcaagtgagacttgctacaaagaattgaacaccttaggtgaccgtgttggtcactgtggtatcaaaaatgctacatatataaagtgtaatatctcagatgtccagtgtggaagaattcagtgtgagaatgtgacagaaattcccaatatgagtgatcatactactgtgcattgggctcgcttcaatgacataatgtgctggagtactgattaccatttggggatgaagggacctgatattggtgaagtgaaagatggaacagagtgtgggatagatcatatatgcatccacaggcactgtgtccatataaccatcttgaatagtaattgctcacctgcattttgtaacaagaggggcatctgcaacaataaacatcactgccattgcaattatctgtgggaccctcccaactgcctgataaaaggctatggaggtagtgttgacagtggcccaccccctaagagaaagaagaaaaagaagttctgttatctgtgtatattgttgcttattgttttgtttattttattatgttgtctttatcgactttgtaaaaaaagtaaaccaataaaaaagcagcaagatgttcaaactccatctgcaaaagaagaggaaaaaattcagcgtcgacctcatgagttacctccccagagtcaaccttgggtgatgccttcccagagtcaacctcctgtgacgccttcccagagtcatcctcaggtgatgccttcccagagtcaacctcctgtgacaccctcccagagtcaacctcgggtgatgccttctcagagtcaacctcctgtgatgccttcccagagtcatcctcagttgacgccttcccagagtcaacctcctgtgacaccctcccagaggcaacctcagttgatgccttcccagagtcaacctcctgtgacgccctcctagagccaacctcagttgatgccttcccagagtcaacctcctgtgacgccctcccagagccaacctcgggtgacaccctcccagagtcaacctcatgtgacaccttaccggagtaaaagtggtaaacaaaagcaatcagtaccaattccaaaaactgtatccagaaaaggtacattaaaaaaataattcctagta

SEQ ID NO: 104662 - DNA, 2963 bp, Homo sapiens
  Payload ID: 550
  Gene Symbol: ADAM30
  Gene Name: ADAM metallopeptidase domain 30
  Uniprot ID: Q9UKF2
  ENST ID: ENST00000369400
  CDS Start-End: 160-2532
agaccgagccctgggaggctacgggctcccccggaaaccctgccaggggagccgggttttgagctcaggcgcctctagcggcggcccccagaaatctgactcgcgaggccagagttgcagggactgaatagcaaactgaggctgagtagggaacagaccatgaggtcagtgcagatcttcctctcccaatgccgtttgctccttctactagttccgacaatgctccttaagtctcttggcgaagatgtaatttttcaccctgaaggggagtttgactcgtatgaagtcaccattcctgagaagctgagcttccggggagaggtgcagggtgtggtcagtcccgtgtcctacctactgcagttaaaaggcaagaagcacgtcctccatttgtggcccaagagacttctgttgccccgacatctgcgcgttttctccttcacagaacatggggaactgctggaggatcatccttacataccaaaggactgcaactacatgggctccgtgaaagagtctctggactctaaagctactataagcacatgcatggggggtctccgaggtgtatttaacattgatgccaaacattaccaaattgagcccctcaaggcctctcccagttttgaacatgtcgtctatctcctgaagaaagagcagtttgggaatcaggtttgtggcttaagtgatgatgaaatagaatggcagatggccccttatgagaataaggcgaggctaagggactttcctggatcctataaacacccaaagtacttggaattgatcctactctttgatcaaagtaggtataggtttgtgaacaacaatctttctcaagtcatacatgatgccattcttttgactgggattatggacacctactttcaagatgttcgtatgaggatacacttaaaggctcttgaagtatggacagattttaacaaaatacgcgttggatatccagagttagctgaagttttaggcagatttgtaatatataaaaaaagtgtattaaatgctcgcctgtcatcagattgggcacatttatatcttcaaagaaaatataatgatgctcttgcatggtcgtttggaaaagtgtgttctctagaatatgctggatcagtgagtactttactagatacaaatatccttgcccctgctacctggtctgctcatgagctgggtcatgctgtaggaatgtcacatgatgaacaatactgccaatgtaggggtaggcttaattgcatcatgggctcaggacgcactgggtttagcaattgcagttatatctctttttttaaacatatctcttcgggagcaacatgtctaaataatatcccaggactaggttatgtgcttaagagatgtggaaacaaaattgtggaggacaatgaggaatgtgactgtggttccacagaggagtgtcagaaagatcggtgttgccaatcaaattgtaagttgcaaccaggtgccaactgtagcattggactttgctgtcatgattgtcggtttcgtccatctggatacgtgtgtaggcaggaaggaaatgaatgtgaccttgcagagtactgcgacgggaattcaagttcctgcccaaatgacgtttataagcaggatggaaccccttgcaagtatgaaggccgttgtttcaggaaggggtgcagatccagatatatgcagtgccaaagcatttttggacctgatgccatggaggctcctagtgagtgctatgatgcagttaacttaataggtgatcaatttggtaactgtgagattacaggaattcgaaattttaaaaagtgtgaaagtgcaaattcaatatgtggcaggctacagtgtataaatgttgaaaccatccctgatttgccagagcatacgactataatttctactcatttacaggcagaaaatctcatgtgctggggcacaggctatcatctatccatgaaacccatgggaatacctgacctaggtatgataaatgatggcacctcctgtggagaaggccgggtatgttttaaaaaaaattgcgtcaatagctcagtcctgcagtttgactgtttgcctgagaaatgcaatacccggggtgtttgcaacaacagaaaaaactgccactgcatgtatgggtgggcacctccattctgtgaggaagtggggtatggaggaagcattgacagtgggcctccaggactgctcagaggggcgattccctcgtcaatttgggttgtgtccatcataatgtttcgccttattttattaatcctttcagtggtttttgtgtttttccggcaagtgataggaaaccacttaaaacccaaacaggaaaaaatgccactatccaaagcaaaaactgaacaggaagaatctaaaacaaaaactgtacaggaagaatctaaaacaaaaactggacaggaagaatctgaagcaaaaactggacaggaagaatctaaagcaaaaactggacaggaagaatctaaagcaaacattgaaagtaaacgacccaaagcaaagagtgtcaagaaacaaaaaaagtaaccgggcaatccatactcattcagtaacacaggctcatttatttaaccagctaatcatttatccaaaggctttccattcttctcccaatatttttttactttaatttttcccacaagttttgatcagcaaataaacagcattcttgttttggaaacaaaccagtgcattctacttctcgagtgttcacttgcccctcagtttgtgaccaagttgtgggtattctgagaatcatgctctaatggcttttccatacactaaagctctgaaagtagtgagtttcctagaattaccatgctattcaaggtatagtcttgtttctcagaatcccagggaacaaagcaattgtctgcctctccctctgcctccctcaacttgatccatgtgaacatccgcacctgcacccatgctgatcaataaatgccgacaacaca

SEQ ID NO: 104663 - DNA, 2601 bp, Homo sapiens
  Payload ID: 551
  Gene Symbol: ADAM32
  Gene Name: ADAM metallopeptidase domain 32
  Uniprot ID: Q8TC27
  ENST ID: ENST00000379907
  CDS Start-End: 128-2491
ccggggcctccggagaacgctgtcccatgaacgtgcggggagcggcccccggcgtccgcgcgtccccgcgtccctggcaattcccgacttcccaacggcttcccgctggcagccccgaagccgcaccatgttccgcctctggttgctgctggccgggctctgcggcctcctggcgtcaagacccggttttcaaaattcacttctacagatcgtaattccagagaaaatccaaacaaatacaaatgacagttcagaaatagaatatgaacaaatatcctatattattccaatagatgagaaactgtacactgtgcaccttaaacaaagatattttttagcagataattttatgatctatttgtacaatcaaggatctatgaatacttattcttcagatattcagactcaatgctactatcaaggaaatattgaaggatatccagattccatggtcacactcagcacgtgctctggactaagaggaatactgcaatttgaaaatgtttcttatggaattgagcctctggaatctgcagttgaatttcagcatgttctttacaaattaaagaatgaagacaatgatattgcaatttttattgacagaagcctgaaagaacaaccaatggatgacaacatttttataagtgaaaaatcagaaccagctgttccagatttatttcctctttatctagaaatgcatattgtggtggacaaaactttgtatgattactggggctctgatagcatgatagtaacaaataaagtcatcgaaattgttggccttgcaaattcaatgttcacccaatttaaagttactattgtgctgtcatcattggagttatggtcagatgaaaataagatttctacagttggtgaggcagatgaattattgcaaaaatttttagaatggaaacaatcttatcttaacctaaggcctcatgatattgcatatctactaatttatatggattatcctcgttatttgggagcagtgtttcctggaacaatgtgtattactcgttattctgcaggagttgcattgtaccccaaggagataactctggaggcatttgcagttattgtcacccagatgctggcactcagtctgggaatatcatatgacgacccaaagaaatgtcaatgttcagaatccacctgtataatgaatccagaagttgtgcaatccaatggtgtgaagacttttagcagttgcagtttgaggagctttcaaaatttcatttcaaatgtgggtgtcaaatgtcttcagaataagccacaaatgcaaaaaaaatctccgaaaccagtctgtggcaatggcagattggagggaaatgaaatctgtgattgtggtactgaggctcaatgtggacctgcaagctgttgtgattttcgaacttgtgtactgaaagacggagcaaaatgttataaaggactgtgctgcaaagactgtcaaattttacaatcaggcgttgaatgtaggccgaaagcacatcctgaatgtgacatcgctgaaaattgtaatggaacctcaccagaatgtggtcctgacataactttaatcaatggactttcatgcaaaaataataagtttatttgttatgacggagactgccatgatctcgatgcacgttgtgagagtgtatttggaaaaggttcaagaaatgctccatttgcctgctatgaagaaatacaatctcaatcagacagatttgggaactgtggtagggatagaaataacaaatatgtgttctgtggatggaggaatcttatatgtggaagattagtttgtacctaccctactcgaaagcctttccatcaagaaaatggtgatgtgatttatgctttcgtacgagattctgtatgcataactgtagactacaaattgcctcgaacagttccagatccactggctgtcaaaaatggctctcagtgtgatattgggagggtttgtgtaaatcgtgaatgtgtagaatcaaggataattaaggcttcagcacatgtttgttcacaacagtgttctggacatggagtgtgtgattccagaaacaagtgccattgttcgccaggctataagcctccaaactgccaaatacgttccaaaggattttccatatttcctgaggaagatatgggttcaatcatggaaagagcatctgggaagactgaaaacacctggcttctaggtttcctcattgctcttcctattctcattgtaacaaccgcaatagttttggcaaggaaacagttgaaaaagtggttcgccaaggaagaggaattcccaagtagcgaatctaaatcggaaggtagcacacagacatatgccagccaatccagctcagaaggcagcactcagacatatgccagccaaaccagatcagaaagcagcagtcaagctgatactagcaaatccaaatcagaagatagtgctgaagcatatactagcagatccaaatcacaggacagtacccaaacacaaagcagtagtaactagtgattccttcagaaggcaacggataacatcgagagtctcgctaagaaatgaaaattctgtctttccttccgtggtcacagctgaaagaaacaataaattgagtgtggatc

SEQ ID NO: 104664 - DNA, 712 bp, Homo sapiens
  Payload ID: 551
  Gene Symbol: ADAM32
  Gene Name: ADAM metallopeptidase domain 32
  ENST ID: ENST00000399831
  CDS Start-End: 248-712
agtggctccagcaaccacgcggctggggtgcgccgggaagggagctggatgttttagcctcggggcgcacgctgcgggcccttcgtgttccggacgctaaacaccgagagcaccccgtctccggggcctccggagaacgctgtcccatgaacgtgcggggagcggcccccggcgtccgcgcgtccccgcgtccctggcaattcccgacttcccaacggcttcccgctggcagccccgaagccgcaccatgttccgcctctggttgctgctggccgggctctgcggcctcctggcgtcaagacccggttttcaaaattcacttctacagatcgtaattccagagaaaatccaaacaaatacaaatgacagttcagaaatagaatatgaacaaatatcctatattattccaatagatgagaaactgtacactgtgcaccttaaacaaagatattttttagcagataattttatgatctatttgtacaatcaaggatctatgaatacttattcttcagatattcagactcaatgctactatcaaggaaatattgaaggatatccagattccatggtcacactcagcacgtgctctggactaagaagcctgaaagaacaaccaatggatgacaacatttttataagtgaaaaatcagaaccagctgttccagatttatttcctctttatctagaaatgcatattgtggtggacaaa

SEQ ID NO: 104665 - DNA, 2281 bp, Homo sapiens
  Payload ID: 551
  Gene Symbol: ADAM32
  Gene Name: ADAM metallopeptidase domain 32
  ENST ID: ENST00000437682
  CDS Start-End: 105-2171
agctggatgttttagcctcggggcgcacgctgcgggcccttcgtgttccggacgctaaacaccgagagcaccccgtctccggggcctccggagaacgctgtcccatgaacgtgcggggagcggcccccggcgtccgcgcgtccccgcgtccctggcaattcccgacttcccaacggcttcccgctggcagccccgaagccgcaccatgttccgcctctggttgctgctggccgggctctgcggcctcctggcgtcaagacccggaacaaatatcctatattattccaatagatgagaaactgtacactgtgcaccttaaacaaagatattttttagcagataattttatgatctatttgtacaatcaaggatctatgaatacttattcttcagatattcagactcaatgctactatcaaggaaatattgaaggatatccagattccatggtcacactcagcacgtgctctggactaagaggaatactgcaatttgaaaatgtttcttatggaattgagcctctggaatctgcagttgaatttcagcatgttctttacaaattaaagaatgaagacaatgatattgcaatttttattgacagaagcctgaaagaacaaccaatggatgacaacatttttataagtgaaaaatcagaaccagctgttccagatttatttcctctttatctagaaatgcatattgtggtggacaaaactttgtatgattactggggctctgatagcatgatagtaacaaataaagtcatcgaaattgttggccttgcaaattcaatgttcacccaatttaaagttactattgtgctgtcatcattggagttatggtcagatgaaaataagatttctacagttggtgaggcagatgaattattgcaaaaatttttagaatggaaacaatcttatcttaacctaaggcctcatgatattgcatatctactaatttatatggattatcctcgttatttgggagcagtgtttcctggaacaatgtgtattactcgttattctgcaggagttgcattgcaatgtggacctgcaagctgttgtgattttcgaacttgtgtactgaaagacggagcaaaatgttataaaggactgtgctgcaaagactgtcaaattttacaatcaggcgttgaatgtaggccgaaagcacatcctgaatgtgacatcgctgaaaattgtaatggaacctcaccagaatgtggtcctgacataactttaatcaatggactttcatgcaaaaataataagtttatttgttatgacggagactgccatgatctcgatgcacgttgtgagagtgtatttggaaaaggttcaagaaatgctccatttgcctgctatgaagaaatacaatctcaatcagacagatttgggaactgtggtagggatagaaataacaaatatgtgttctgtggatggaggaatcttatatgtggaagattagtttgtacctaccctactcgaaagcctttccatcaagaaaatggtgatgtgatttatgctttcgtacgagattctgtatgcataactgtagactacaaattgcctcgaacagttccagatccactggctgtcaaaaatggctctcagtgtgatattgggagggtttgtgtaaatcgtgaatgtgtagaatcaaggataattaaggcttcagcacatgtttgttcacaacagtgttctggacatggagtgtgtgattccagaaacaagtgccattgttcgccaggctataagcctccaaactgccaaatacgttccaaaggattttccatatttcctgaggaagatatgggttcaatcatggaaagagcatctgggaagactgaaaacacctggcttctaggtttcctcattgctcttcctattctcattgtaacaaccgcaatagttttggcaaggaaacagttgaaaaagtggttcgccaaggaagaggaattcccaagtagcgaatctaaatcggaaggtagcacacagacatatgccagccaatccagctcagaaggcagcactcagacatatgccagccaaaccagatcagaaagcagcagtcaagctgatactagcaaatccaaatcagaagatagtgctgaagcatatactagcagatccaaatcacaggacagtacccaaacacaaagcagtagtaactagtgattccttcagaaggcaacggataacatcgagagtctcgctaagaaatgaaaattctgtctttccttccgtggtcacagctgaaagaaacaataaattgagtgtggatc

SEQ ID NO: 104666 - DNA, 577 bp, Homo sapiens
  Payload ID: 551
  Gene Symbol: ADAM32
  Gene Name: ADAM metallopeptidase domain 32
  ENST ID: ENST00000523400
  CDS Start-End: 60-577
agattggaggaaaaagcctggttgtgaagtccatttgggcagcgtcagtggggaaaaaaatgcagctggcgctcttcaaaaatatgaagagctggcatttcatattgaaaagcggctcacttttcccttctttggaatgttcacacatctggctaaatagttttgaaaaaatattagaaacaggtttggcaaatatgaatatatatttaggttttcaaaattcacttctacagatcgtaattccagagaaaatccaaacaaatacaaatgacagttcagaaatagaatatgaacaaatatcctatattattccaatagatgagaaactgtacactgtgcaccttaaacaaagatattttttagcagataattttatgatctatttgtacaatcaaggatctatgaatacttattcttcagatattcagactcaatgctactatcaaggaaatattgaaggatatccagattccatggtcacactcagcacgtgctctggactaagaggaatactgcaatttgaaaatgtttcttatggaattgagcctctggaatctgcagttgaatttcagcatgt

SEQ ID NO: 104667 - DNA, 557 bp, Homo sapiens
  Payload ID: 551
  Gene Symbol: ADAM32
  Gene Name: ADAM metallopeptidase domain 32
  ENST ID: ENST00000522506
  CDS Start-End: 4-557
accatgttccgcctctggttgctgctggccgggctctgcggcctcctggcgtcaagacccggttttcaaaattcacttctacagatcgtaattccagagaaaatccaaacaaatacaaatgacagttcagaaatagaatatgaacaaatatcctatattattccaatagatgagaaactgtacactgtgcaccttaaacaaagatattttttagcagataattttatgatctatttgtacaatcaaggatctatgaatacttattcttcagatattcagactcaatgctactatcaaggaaatattgaaggatatccagattccatggtcacactcagcacgtgctctggactaagaggaatactgcaatttgaaaatgtttcttatggaattgagcctctggaatctgcagttgaatttcagcatgttctttacaaattaaagaatgaagacaatgatattgcaatttttattgacagaagcctgaaagaacaaccaatggatgacaacatttttataagtgaaaaatatgattactggggctctgatagcatgat

SEQ ID NO: 104668 - DNA, 2168 bp, Homo sapiens
  Payload ID: 551
  Gene Symbol: ADAM32
  Gene Name: ADAM metallopeptidase domain 32
  ENST ID: ENST00000519315
  CDS Start-End: 169-2058
ccttcgtgttccggacgctaaacaccgagagcaccccgtctccggggcctccggagaacgctgtcccatgaacgtgcggggagcggcccccggcgtccgcgcgtccccgcgtccctggcaattcccgacttcccaacggcttcccgctggcagccccgaagccgcaccatgttccgcctctggttgctgctggccgggctctgcggcctcctggcgtcaagacccggttttcaaaattcacttctacagatcgtaattccagagaaaatccaaacaaatacaaatgacagttcagaaatagaatatgaacaaatatcctatattattccaatagatgagaaactgtacactgtgcaccttaaacaaagatattttttagcagataattttatgatctatttgtacaatcaaggatctatgaatacttattcttcagatattcagactcaatgctactatcaaggaaatattgaaggatatccagattccatggtcacactcagcacgtgctctggactaagaggaatactgcaatttgaaaatgtttcttatggaattgagcctctggaatctgcagttgaatttcagcatgttctttacaaattaaagaatgaagacaatgatattgcaatttttattgacagaagcctgaaagaacaaccaatggatgacaacatttttataagtgaaaaatcagaaccagctgttccagatttatttcctctttatctagaaatgcatattgtggtggacaaaactttgtatgattactggggctctgatagcatgatagtaacaaataaagtcatcgaaattgttggccttgcaaattcaatgttcacccaatttaaagttactattgtgctgtcatcattggagttatggtcagatgaaaataagatttctacagttggtgaggcagatgaattattgcaaaaatttttagaatggaaacaatcttatcttaacctaaggcctcatgatattgcatatctactaatttatatggattatcctcgttatttgggagcagtgtttcctggaacaatgtgtattactcgttattctgcaggagttgcattgcaatgtggacctgcaagctgttgtgattttcgaacttgtgtactgaaagacggagcaaaatgttataaaggactgtgctgcaaagactgtcaaattttacaatcaggcgttgaatgtaggccgaaagcacatcctgaatgtgacatcgctgaaaattgtaatggaacctcaccagaatgtggtcctgacataactttaatcaatggactttcatgcaaaaataataagtttatttgttatgacggagactgccatgatctcgatgcacgttgtgagagtgtatttggaaaaggttcaagaaatgctccatttgcctgctatgaagaaatacaatctcaatcagacagatttgggaactgtggtagggatagaaataacaaatatgtgttctgtggatggaggaatcttatatgtggaagattagtttgtacctaccctactcgaaagcctttccatcaagaaaatggtgatgtgatttatgctttcgtacgagattctgtatgcataactgtagactacaaattgcctcgaacagttccagatccactggctgtcaaaaatggctctcagtgtgatattgggagggtttgtgtaaatcgtgaatgtgtagaatcaaggataattaaggcttcagcacatgtttgttcacaacagtgttctggacatggagtgtgtgattccagaaacaagtgccattgttcgccaggctataagcctccaaactgccaaatacgttccaaaggattttccatatttcctgaggaagatatgggttcaatcatggaaagagcatctgggaagactgaaaacacctggcttctaggtttcctcattgctcttcctattctcattgtaacaaccgcaatagttttggcaaggaaacagttgaaaaagtggttcgccaaggaagaggaattcccaagtagcgaatccaaatcacaggacagtacccaaacacaaagcagtagtaactagtgattccttcagaaggcaacggataacatcgagagtctcgctaagaaatgaaaattctgtctttccttccgtggtcacagctgaaagaaacaataaattgagtgtggatc

SEQ ID NO: 104669 - DNA, 571 bp, Homo sapiens
  Payload ID: 551
  Gene Symbol: ADAM32
  Gene Name: ADAM metallopeptidase domain 32
  ENST ID: ENST00000521741
  CDS Start-End: 411-571
ttttccaggggattaggcgccccgtccggatggagaagcgactcagggcccagcaccagggctcacgcctgtaatcccagggctttgagagactgaggcgagctgattgtttgacctcggagttggagaccagcttgggcaacacagcaagaccccatctctacaaaaaaatttaaaaaaatgttccgaggtggtggtgcgcacctgtgatcccagctacccgggaggctgagggaggaggaccacgttttcaaaattcacttctacagatcgtaattccagagaaaatccaaacaaatacaaatgacagttcagaaatagaatatgaacaaatatcctatattattccaatagatgagaaactgtacactgtgcaccttaaacaaagatattttttagcagataattttatgatctatttgtacaatcaaggatctatgaatacttattcttcagatattcagactcaatgctactatcaaggaaatattgaaggatatccagattccatggtcacactcagcacgtgctctggactaagaggaatactgcaatttgaaaatgtttctta

SEQ ID NO: 104670 - DNA, 2168 bp, Homo sapiens
  Payload ID: 551
  Gene Symbol: ADAM32
  Gene Name: ADAM metallopeptidase domain 32
  ENST ID: ENST00000618895
  CDS Start-End: 169-2058
ccttcgtgttccggacgctaaacaccgagagcaccccgtctccggggcctccggagaacgctgtcccatgaacgtgcggggagcggcccccggcgtccgcgcgtccccgcgtccctggcaattcccgacttcccaacggcttcccgctggcagccccgaagccgcaccatgttccgcctctggttgctgctggccgggctctgcggcctcctggcgtcaagacccggttttcaaaattcacttctacagatcgtaattccagagaaaatccaaacaaatacaaatgacagttcagaaatagaatatgaacaaatatcctatattattccaatagatgagaaactgtacactgtgcaccttaaacaaagatattttttagcagataattttatgatctatttgtacaatcaaggatctatgaatacttattcttcagatattcagactcaatgctactatcaaggaaatattgaaggatatccagattccatggtcacactcagcacgtgctctggactaagaggaatactgcaatttgaaaatgtttcttatggaattgagcctctggaatctgcagttgaatttcagcatgttctttacaaattaaagaatgaagacaatgatattgcaatttttattgacagaagcctgaaagaacaaccaatggatgacaacatttttataagtgaaaaatcagaaccagctgttccagatttatttcctctttatctagaaatgcatattgtggtggacaaaactttgtatgattactggggctctgatagcatgatagtaacaaataaagtcatcgaaattgttggccttgcaaattcaatgttcacccaatttaaagttactattgtgctgtcatcattggagttatggtcagatgaaaataagatttctacagttggtgaggcagatgaattattgcaaaaatttttagaatggaaacaatcttatcttaacctaaggcctcatgatattgcatatctactaatttatatggattatcctcgttatttgggagcagtgtttcctggaacaatgtgtattactcgttattctgcaggagttgcattgcaatgtggacctgcaagctgttgtgattttcgaacttgtgtactgaaagacggagcaaaatgttataaaggactgtgctgcaaagactgtcaaattttacaatcaggcgttgaatgtaggccgaaagcacatcctgaatgtgacatcgctgaaaattgtaatggaagctcaccagaatgtggtcctgacataactttaatcaatggactttcatgcaaaaataataagtttatttgttatgacggagactgccatgatctcgatgcacgttgtgagagtgtatttggaaaaggttcaagaaatgctccatttgcctgctatgaagaaatacaatctcaatcagacagatttgggaactgtggtagggatagaaataacaaatatgtgttctgtggatggaggaatcttatatgtggaagattagtttgtacctaccctactcgaaagcctttccatcaagaaaatggtgatgtgatttatgctttcgtacgagattctgtatgcataaccgtagactacaaattgcctcgaacagttccagatccactggctgtcaaaaatggctctcagtgtgatattgggagggtttgtgtaaatcgtgaatgtgtagaatcaaggataattaaggcttcagcacatgtttgttcacaacagtgttctggacatggagtgtgtgattccagaaacaagtgccattgttcgccaggctataagcctccaaactgccaaatacgttccaaaggattttccatatttcctgaggaagatatgggttcaatcatggaaagagcatctgggaagactgaaaacacctggcttctaggtttcctcattgctcttcctattctcattgtaacaaccgcaatagttttggcaaggaaacagttgaaaaagtggttcgccaaggaagaggaattcccaagtagcgaatccaaatcacaggacagtacccaaacacaaagcagtagtaactagtgattccttcagaaggcaacggataacatcgagagtctcgctaagaaatgaaaattctgtctttccttccgtggtcacagctgaaagaaacaataaattgagtgtggatc

SEQ ID NO: 104671 - DNA, 2601 bp, Homo sapiens
  Payload ID: 551
  Gene Symbol: ADAM32
  Gene Name: ADAM metallopeptidase domain 32
  Uniprot ID: Q8TC27
  ENST ID: ENST00000615420
  CDS Start-End: 128-2491
ccggggcctccggagaacgctgtcccatgaacgtgcggggagcggcccccggcgtccgcgcgtccccgcgtccctggcaattcccgacttcccaacggcttcccgctggcagccccgaagccgcaccatgttccgcctctggttgctgctggccgggctctgcggcctcctggcgtcaagacccggttttcaaaattcacttctacagatcgtaattccagagaaaatccaaacaaatacaaatgacagttcagaaatagaatatgaacaaatatcctatattattccaatagatgagaaactgtacactgtgcaccttaaacaaagatattttttagcagataattttatgatctatttgtacaatcaaggatctatgaatacttattcttcagatattcagactcaatgctactatcaaggaaatattgaaggatatccagattccatggtcacactcagcacgtgctctggactaagaggaatactgcaatttgaaaatgtttcttatggaattgagcctctggaatctgcagttgaatttcagcatgttctttacaaattaaagaatgaagacaatgatattgcaatttttattgacagaagcctgaaagaacaaccaatggatgacaacatttttataagtgaaaaatcagaaccagctgttccagatttatttcctctttatctagaaatgcatattgtggtggacaaaactttgtatgattactggggctctgatagcatgatagtaacaaataaagtcatcgaaattgttggccttgcaaattcaatgttcacccaatttaaagttactattgtgctgtcatcattggagttatggtcagatgaaaataagatttctacagttggtgaggcagatgaattattgcaaaaatttttagaatggaaacaatcttatcttaacctaaggcctcatgatattgcatatctactaatttatatggattatcctcgttatttgggagcagtgtttcctggaacaatgtgtattactcgttattctgcaggagttgcattgtaccccaaggagataactctggaggcatttgcagttattgtcacccagatgctggcactcagtctgggaatatcatatgacgacccaaagaaatgtcaatgttcagaatccacctgtataatgaatccagaagttgtgcaatccaatggtgtgaagacttttagcagttgcagtttgaggagctttcaaaatttcatttcaaatgtgggtgtcaaatgtcttcagaataagccacaaatgcaaaaaaaatctccgaaaccagtctgtggcaatggcagattggagggaaatgaaatctgtgattgtggtactgaggctcaatgtggacctgcaagctgttgtgattttcgaacttgtgtactgaaagacggagcaaaatgttataaaggactgtgctgcaaagactgtcaaattttacaatcaggcgttgaatgtaggccgaaagcacatcctgaatgtgacatcgctgaaaattgtaatggaagctcaccagaatgtggtcctgacataactttaatcaatggactttcatgcaaaaataataagtttatttgttatgacggagactgccatgatctcgatgcacgttgtgagagtgtatttggaaaaggttcaagaaatgctccatttgcctgctatgaagaaatacaatctcaatcagacagatttgggaactgtggtagggatagaaataacaaatatgtgttctgtggatggaggaatcttatatgtggaagattagtttgtacctaccctactcgaaagcctttccatcaagaaaatggtgatgtgatttatgctttcgtacgagattctgtatgcataaccgtagactacaaattgcctcgaacagttccagatccactggctgtcaaaaatggctctcagtgtgatattgggagggtttgtgtaaatcgtgaatgtgtagaatcaaggataattaaggcttcagcacatgtttgttcacaacagtgttctggacatggagtgtgtgattccagaaacaagtgccattgttcgccaggctataagcctccaaactgccaaatacgttccaaaggattttccatatttcctgaggaagatatgggttcaatcatggaaagagcatctgggaagactgaaaacacctggcttctaggtttcctcattgctcttcctattctcattgtaacaaccgcaatagttttggcaaggaaacagttgaaaaagtggttcgccaaggaagaggaattcccaagtagcgaatctaaatcggaaggtagcacacagacatatgccagccaatccagctcagaaggcagcactcagacatatgccagccaaaccagatcagaaagcagcagtcaagctgatactagcaaatccaaatcagaagatagtgctgaagcatatactagcagatccaaatcacaggacagtacccaaacacaaagcagtagtaactagtgattccttcagaaggcaacggataacatcgagagtctcgctaagaaatgaaaattctgtctttccttccgtggtcacagctgaaagaaacaataaattgagtgtggatc

SEQ ID NO: 104672 - DNA, 712 bp, Homo sapiens; identical to SEQ ID NO: 104664
  Payload ID: 551
  Gene Symbol: ADAM32
  Gene Name: ADAM metallopeptidase domain 32
  ENST ID: ENST00000633822
  CDS Start-End: 248-712

SEQ ID NO: 104673 - DNA, 571 bp, Homo sapiens; identical to SEQ ID NO: 104669
  Payload ID: 551
  Gene Symbol: ADAM32
  Gene Name: ADAM metallopeptidase domain 32
  ENST ID: ENST00000634221
  CDS Start-End: 411-571

SEQ ID NO: 104674 - DNA, 275 bp, Homo sapiens
  Payload ID: 551
  Gene Symbol: ADAM32
  Gene Name: ADAM metallopeptidase domain 32
  ENST ID: ENST00000632855
  CDS Start-End: 1-163
atctaaatcggaaggtagcacacagacatatgccagccaatccagctcagaaggcagcactcagacatatgccagccaaaccagatcagaaagcagcagtcaagctgatactagcaaatccaaatcacaggacagtacccaaacacaaagcagtagtaactagtgattccttcagaaggcaacggataacatcgagagtctcgctaagaaatgaaaattctgtctttccttccgtggtcacagctgaaagaaacaataaattgagtgtggatcaa

SEQ ID NO: 104675 - DNA, 2281 bp, Homo sapiens
  Payload ID: 551
  Gene Symbol: ADAM32
  Gene Name: ADAM metallopeptidase domain 32
  ENST ID: ENST00000634081
  CDS Start-End: 105-2171
agctggatgttttagcctcggggcgcacgctgcgggcccttcgtgttccggacgctaaacaccgagagcaccccgtctccggggcctccggagaacgctgtcccatgaacgtgcggggagcggcccccggcgtccgcgcgtccccgcgtccctggcaattcccgacttcccaacggcttcccgctggcagccccgaagccgcaccatgttccgcctctggttgctgctggccgggctctgcggcctcctggcgtcaagacccggaacaaatatcctatattattccaatagatgagaaactgtacactgtgcaccttaaacaaagatattttttagcagataattttatgatctatttgtacaatcaaggatctatgaatacttattcttcagatattcagactcaatgctactatcaaggaaatattgaaggatatccagattccatggtcacactcagcacgtgctctggactaagaggaatactgcaatttgaaaatgtttcttatggaattgagcctctggaatctgcagttgaatttcagcatgttctttacaaattaaagaatgaagacaatgatattgcaatttttattgacagaagcctgaaagaacaaccaatggatgacaacatttttataagtgaaaaatcagaaccagctgttccagatttatttcctctttatctagaaatgcatattgtggtggacaaaactttgtatgattactggggctctgatagcatgatagtaacaaataaagtcatcgaaattgttggccttgcaaattcaatgttcacccaatttaaagttactattgtgctgtcatcattggagttatggtcagatgaaaataagatttctacagttggtgaggcagatgaattattgcaaaaatttttagaatggaaacaatcttatcttaacctaaggcctcatgatattgcatatctactaatttatatggattatcctcgttatttgggagcagtgtttcctggaacaatgtgtattactcgttattctgcaggagttgcattgcaatgtggacctgcaagctgttgtgattttcgaacttgtgtactgaaagacggagcaaaatgttataaaggactgtgctgcaaagactgtcaaattttacaatcaggcgttgaatgtaggccgaaagcacatcctgaatgtgacatcgctgaaaattgtaatggaagctcaccagaatgtggtcctgacataactttaatcaatggactttcatgcaaaaataataagtttatttgttatgacggagactgccatgatctcgatgcacgttgtgagagtgtatttggaaaaggttcaagaaatgctccatttgcctgctatgaagaaatacaatctcaatcagacagatttgggaactgtggtagggatagaaataacaaatatgtgttctgtggatggaggaatcttatatgtggaagattagtttgtacctaccctactcgaaagcctttccatcaagaaaatggtgatgtgatttatgctttcgtacgagattctgtatgcataaccgtagactacaaattgcctcgaacagttccagatccactggctgtcaaaaatggctctcagtgtgatattgggagggtttgtgtaaatcgtgaatgtgtagaatcaaggataattaaggcttcagcacatgtttgttcacaacagtgttctggacatggagtgtgtgattccagaaacaagtgccattgttcgccaggctataagcctccaaactgccaaatacgttccaaaggattttccatatttcctgaggaagatatgggttcaatcatggaaagagcatctgggaagactgaaaacacctggcttctaggtttcctcattgctcttcctattctcattgtaacaaccgcaatagttttggcaaggaaacagttgaaaaagtggttcgccaaggaagaggaattcccaagtagcgaatctaaatcggaaggtagcacacagacatatgccagccaatccagctcagaaggcagcactcagacatatgccagccaaaccagatcagaaagcagcagtcaagctgatactagcaaatccaaatcagaagatagtgctgaagcatatactagcagatccaaatcacaggacagtacccaaacacaaagcagtagtaactagtgattccttcagaaggcaacggataacatcgagagtctcgctaagaaatgaaaattctgtctttccttccgtggtcacagctgaaagaaacaataaattgagtgtggatc

SEQ ID NO: 104676 - DNA, 577 bp, Homo sapiens; identical to SEQ ID NO: 104666
  Payload ID: 551
  Gene Symbol: ADAM32
  Gene Name: ADAM metallopeptidase domain 32
  ENST ID: ENST00000631545
  CDS Start-End: 60-577

SEQ ID NO: 104677 - DNA, 557 bp, Homo sapiens; identical to SEQ ID NO: 104667
  Payload ID: 551
  Gene Symbol: ADAM32
  Gene Name: ADAM metallopeptidase domain 32
  ENST ID: ENST00000631415
  CDS Start-End: 4-557

SEQ ID NO: 104678 - DNA, 3480 bp, Homo sapiens
  Payload ID: 552
  Gene Symbol: ADAM33
  Gene Name: ADAM metallopeptidase domain 33
  Uniprot ID: Q9BZ11
  ENST ID: ENST00000350009
  CDS Start-End: 128-2491
gggaggtgggggcgggaaggtccgaaggcggcggcctgaggctgcaccgggcacgggtcggccgcaatccagcctgggcggagccggagttgcgagccgctgcctagaggccgaggagctcacagctatgggctggaggccccggagagctcgggggaccccgttgctgctgctgctactactgctgctgctctggccagtgccaggcgccggggtgcttcaaggacatatccctgggcagccagtcaccccgcactgggtcctggatggacaaccctggcgcaccgtcagcctggaggagccggtctcgaagccagacatggggctggtggccctggaggctgaaggccaggagctcctgcttgagctggagaagaaccacaggctgctggccccaggatacatagaaacccactacggcccagatgggcagccagtggtgctggcccccaaccacacggatcattgccactaccaagggcgagtaaggggcttccccgactcctgggtagtcctctgcacctgctctgggatgagtggcctgatcaccctcagcaggaatgccagctattatctgcgtccctggccaccccggggctccaaggacttctcaacccacgagatctttcggatggagcagctgctcacctggaaaggaacctgtggccacagggatcctgggaacaaagcgggcatgaccagccttcctggtggtccccagagcaggggcaggcgagaagcgcgcaggacccggaagtacctggaactgtacattgtggcagaccacaccctgttcttgactcggcaccgaaacttgaaccacaccaaacagcgtctcctggaagtcgccaactacgtggaccagcttctcaggactctggacattcaggtggcgctgaccggcctggaggtgtggaccgagcgggaccgcagccgcgtcacgcaggacgccaacgccacgctctgggccttcctgcagtggcgccgggggctgtgggcgcagcggccccacgactccgcgcagctgctcacgggccgcgccttccagggcgccacagtgggcctggcgcccgtcgagggcatgtgccgcgccgagagctcgggaggcgtgagcacggaccactcggagctccccatcggcgccgcagccaccatggcccatgagatcggccacagcctcggcctcagccacgaccccgacggctgctgcgtggaggctgcggccgagtccggaggctgcgtcatggctgcggccaccgggcacccgtttccgcgcgtgttcagcgcctgcagccgccgccagctgcgcgccttcttccgcaaggggggcggcgcttgcctctccaatgccccggaccccggactcccggtgccgccggcgctctgcgggaacggcttcgtggaagcgggcgaggagtgtgactgcggccctggccaggagtgccgcgacctctgctgctttgctcacaactgctcgctgcgcccgggggcccagtgcgcccacggggactgctgcgtgcgctgcctgctgaagccggctggagcgctgtgccgccaggccatgggtgactgtgacctccctgagttttgcacgggcacctcctcccactgtcccccagacgtttacctactggacggctcaccctgtgccaggggcagtggctactgctgggatggcgcatgtcccacgctggagcagcagtgccagcagctctgggggcctggctcccacccagctcccgaggcctgtttccaggtggtgaactctgcgggagatgctcatggaaactgcggccaggacagcgagggccacttcctgccctgtgcagggagggatgccctgtgtgggaagctgcagtgccagggtggaaagcccagcctgctcgcaccgcacatggtgccagtggactctaccgttcacctagatggccaggaagtgacttgtcggggagccttggcactccccagtgcccagctggacctgcttggcctgggcctggtagagccaggcacccagtgtggacctagaatggtttgcaatagcaaccataactgccactgtgctccaggctgggctccacccttctgtgacaagccaggctttggtggcagcatggacagtggccctgtgcaggctgaaaaccatgacaccttcctgctggccatgctcctcagcgtcctgctgcctctgctcccaggggccggcctggcctggtgttgctaccgactcccaggagcccatctgcagcgatgcagctggggctgcagaagggaccctgcgtgcagtggccccaaagatggcccacacagggaccaccccctgggcggcgttcaccccatggagttgggccccacagccactggacagccctggcccctggaccctgagaactctcatgagcccagcagccaccctgagaagcctctgccagcagtctcgcctgacccccaagcagatcaagtccagatgccaagatcctgcctctggtgagaggtagctcctaaaatgaacagatttaaagacaggtggccactgacagccactccaggaacttgaactgcaggggcagagccagtgaatcaccggacctccagcacctgcaggcagcttggaagtttcttccccgagtggagcttcgacccacccactccaggaacccagagccacattagaagttcctgagggctggagaacactgctgggcacactctccagctcaataaaccatcagtcccagaagcaaaggtcacacagcccctgacctccctcaccagtggaggctgggtagtgctggccatcccaaaagggctctgtcctgggagtctggtgtgtctcctacatgcaatttccacggacccagctctgtggagggcatgactgctggccagaagctagtggtcctggggccctatggttcgactgagtccacactcccctggagcctggctggcctctgcaaacaaacataattttggggaccttccttcctgtttcttcccaccctgtcttctcccctaggtggttcctgagcccccacccccaatcccagtgctacacctgaggttctggagctcagaatctgacagcctctcccccattctgtgtgtgtcggggggacagagggaaccatttaagaaaagataccaaagtagaagtcaaaagaaagacatgttggctataggcgtggtggctcatgcctataatcccagcactttgggaagccggggtaggaggatcaccagaggccagcaggtccacaccagcctgggcaacacagcaagacaccgcatctacagaaaaattttaaaattagctgggcgtggtggtgtgtacctgtaggcctagctgctcaggaggctgaagcaggaggatcacttgagcctgagttcaacactgcagtgagctatggtggcaccactgcactccagcctgggtgacagagcaagaccctgtctctaaaataaattttaaaaagacat

SEQ ID NO: 104679 - DNA, 3677 bp, Homo sapiens
  Payload ID: 552
  Gene Symbol: ADAM33
  Gene Name: ADAM metallopeptidase domain 33
  Uniprot ID: Q9BZ11
  ENST ID: ENST00000356518
  CDS Start-End: 243-2684
gggcggcggtccgggagtggcgacccggctcccccatggcgcgcgccgtcggggcccctggccaggctccgagcggggttggcggggaggggaggcgggagcgagggcgggcggtgggaggtgggggcgggaaggtccgaaggcggcggcctgaggctgcaccgggcacgggtcggccgcaatccagcctgggcggagccggagttgcgagccgctgcctagaggccgaggagctcacagctatgggctggaggccccggagagctcgggggaccccgttgctgctgctgctactactgctgctgctctggccagtgccaggcgccggggtgcttcaaggacatatccctgggcagccagtcaccccgcactgggtcctggatggacaaccctggcgcaccgtcagcctggaggagccggtctcgaagccagacatggggctggtggccctggaggctgaaggccaggagctcctgcttgagctggagaagaaccacaggctgctggccccaggatacatagaaacccactacggcccagatgggcagccagtggtgctggcccccaaccacacggatcattgccactaccaagggcgagtaaggggcttccccgactcctgggtagtcctctgcacctgctctgggatgagtggcctgatcaccctcagcaggaatgccagctattatctgcgtccctggccaccccggggctccaaggacttctcaacccacgagatctttcggatggagcagctgctcacctggaaaggaacctgtggccacagggatcctgggaacaaagcgggcatgaccagccttcctggtggtccccagagcaggggcaggcgagaagcgcgcaggacccggaagtacctggaactgtacattgtggcagaccacaccctgttcttgactcggcaccgaaacttgaaccacaccaaacagcgtctcctggaagtcgccaactacgtggaccagcttctcaggactctggacattcaggtggcgctgaccggcctggaggtgtggaccgagcgggaccgcagccgcgtcacgcaggacgccaacgccacgctctgggccttcctgcagtggcgccgggggctgtgggcgcagcggccccacgactccgcgcagctgctcacgggccgcgccttccagggcgccacagtgggcctggcgcccgtcgagggcatgtgccgcgccgagagctcgggaggcgtgagcacggaccactcggagctccccatcggcgccgcagccaccatggcccatgagatcggccacagcctcggcctcagccacgaccccgacggctgctgcgtggaggctgcggccgagtccggaggctgcgtcatggctgcggccaccgggcacccgtttccgcgcgtgttcagcgcctgcagccgccgccagctgcgcgccttcttccgcaaggggggcggcgcttgcctctccaatgccccggaccccggactcccggtgccgccggcgctctgcgggaacggcttcgtggaagcgggcgaggagtgtgactgcggccctggccaggagtgccgcgacctctgctgctttgctcacaactgctcgctgcgcccgggggcccagtgcgcccacggggactgctgcgtgcgctgcctgctgaagccggctggagcgctgtgccgccaggccatgggtgactgtgacctccctgagttttgcacgggcacctcctcccactgtcccccagacgtttacctactggacggctcaccctgtgccaggggcagtggctactgctgggatggcgcatgtcccacgctggagcagcagtgccagcagctctgggggcctggctcccacccagctcccgaggcctgtttccaggtggtgaactctgcgggagatgctcatggaaactgcggccaggacagcgagggccacttcctgccctgtgcagggagggatgccctgtgtgggaagctgcagtgccagggtggaaagcccagcctgctcgcaccgcacatggtgccagtggactctaccgttcacctagatggccaggaagtgacttgtcggggagccttggcactccccagtgcccagctggacctgcttggcctgggcctggtagagccaggcacccagtgtggacctagaatggtgtgccagagcaggcgctgcaggaagaatgccttccaggagcttcagcgctgcctgactgcctgccacagccacggggtttgcaatagcaaccataactgccactgtgctccaggctgggctccacccttctgtgacaagccaggctttggtggcagcatggacagtggccctgtgcaggctgaaaaccatgacaccttcctgctggccatgctcctcagcgtcctgctgcctctgctcccaggggccggcctggcctggtgttgctaccgactcccaggagcccatctgcagcgatgcagctggggctgcagaagggaccctgcgtgcagtggccccaaagatggcccacacagggaccaccccctgggcggcgttcaccccatggagttgggccccacagccactggacagccctggcccctggaccctgagaactctcatgagcccagcagccaccctgagaagcctctgccagcagtctcgcctgacccccaagcagatcaagtccagatgccaagatcctgcctctggtgagaggtagctcctaaaatgaacagatttaaagacaggtggccactgacagccactccaggaacttgaactgcaggggcagagccagtgaatcaccggacctccagcacctgcaggcagcttggaagtttcttccccgagtggagcttcgacccacccactccaggaacccagagccacattagaagttcctgagggctggagaacactgctgggcacactctccagctcaataaaccatcagtcccagaagcaaaggtcacacagcccctgacctccctcaccagtggaggctgggtagtgctggccatcccaaaagggctctgtcctgggagtctggtgtgtctcctacatgcaatttccacggacccagctctgtggagggcatgactgctggccagaagctagtggtcctggggccctatggttcgactgagtccacactcccctggagcctggctggcctctgcaaacaaacataattttggggaccttccttcctgtttcttcccaccctgtcttctcccctaggtggttcctgagcccccacccccaatcccagtgctacacctgaggttctggagctcagaatctgacagcctctcccccattctgtgtgtgtcggggggacagagggaaccatttaagaaaagataccaaagtagaagtcaaaagaaagacatgttggctataggcgtggtggctcatgcctataatcccagcactttgggaagccggggtaggaggatcaccagaggccagcaggtccacaccagcctgggcaacacagcaagacaccgcatctacagaaaaattttaaaattagctgggcgtggtggtgtgtacctgtaggcctagctgctcaggaggctgaagcaggaggatcacttgagcctgagttcaacactgcagtgagctatggtggcaccactgcactccagcctgggtgacagagcaagaccctgtctctaaaataaattttaaaaagacatatta

SEQ ID NO: 104680 - DNA, 3674 bp, Homo sapiens
  Payload ID: 552
  Gene Symbol: ADAM33
  Gene Name: ADAM metallopeptidase domain 33
  ENST ID: ENST00000379861
  CDS Start-End: 243-2681
gggcggcggtccgggagtggcgacccggctcccccatggcgcgcgccgtcggggcccctggccaggctccgagcggggttggcggggaggggaggcgggagcgagggcgggcggtgggaggtgggggcgggaaggtccgaaggcggcggcctgaggctgcaccgggcacgggtcggccgcaatccagcctgggcggagccggagttgcgagccgctgcctagaggccgaggagctcacagctatgggctggaggccccggagagctcgggggaccccgttgctgctgctgctactactgctgctgctctggccagtgccaggcgccggggtgcttcaaggacatatccctgggcagccagtcaccccgcactgggtcctggatggacaaccctggcgcaccgtcagcctggaggagccggtctcgaagccagacatggggctggtggccctggaggctgaaggccaggagctcctgcttgagctggagaagaaccacaggctgctggccccaggatacatagaaacccactacggcccagatgggcagccagtggtgctggcccccaaccacacggatcattgccactaccaagggcgagtaaggggcttccccgactcctgggtagtcctctgcacctgctctgggatgagtggcctgatcaccctcagcaggaatgccagctattatctgcgtccctggccaccccggggctccaaggacttctcaacccacgagatctttcggatggagcagctgctcacctggaaaggaacctgtggccacagggatcctgggaacaaagcgggcatgaccagccttcctggtggtccccagagcaggggcaggcgagaagcgcgcaggacccggaagtacctggaactgtacattgtggcagaccacaccctgttcttgactcggcaccgaaacttgaaccacaccaaacagcgtctcctggaagtcgccaactacgtggaccagcttctcaggactctggacattcaggtggcgctgaccggcctggaggtgtggaccgagcgggaccgcagccgcgtcacgcaggacgccaacgccacgctctgggccttcctgcagtggcgccgggggctgtgggcgcagcggccccacgactccgcgcagctgctcacgggccgcgccttccagggcgccacagtgggcctggcgcccgtcgagggcatgtgccgcgccgagagctcgggaggcgtgagcacggaccactcggagctccccatcggcgccgcagccaccatggcccatgagatcggccacagcctcggcctcagccacgaccccgacggctgctgcgtggaggctgcggccgagtccggaggctgcgtcatggctgcggccaccgggcacccgtttccgcgcgtgttcagcgcctgcagccgccgccagctgcgcgccttcttccgcaaggggggcggcgcttgcctctccaatgccccggaccccggactcccggtgccgccggcgctctgcgggaacggcttcgtggaagcgggcgaggagtgtgactgcggccctggccaggagtgccgcgacctctgctgctttgctcacaactgctcgctgcgcccgggggcccagtgcgcccacggggactgctgcgtgcgctgcctgctgaagccggctggagcgctgtgccgccaggccatgggtgactgtgacctccctgagttttgcacgggcacctcctcccactgtcccccagacgtttacctactggacggctcaccctgtgccaggggcagtggctactgctgggatggcgcatgtcccacgctggagcagcagtgccagcagctctgggggcctggctcccacccagctcccgaggcctgtttccaggtggtgaactctgcgggagatgctcatggaaactgcggccaggacagcgagggccacttcctgccctgtgcagggagggatgccctgtgtgggaagctgcagtgccagggtggaaagcccagcctgctcgcaccgcacatggtgccagtggactctaccgttcacctagatggccaggaagtgacttgtcggggagccttggcactccccagtgcccagctggacctgcttggcctgggcctggtagagccaggcacccagtgtggacctagaatggtgtgccagagcaggcgctgcaggaagaatgccttccaggagcttcagcgctgcctgactgcctgccacagccacggggtttgcaatagcaaccataactgccactgtgctccaggctgggctccacccttctgtgacaagccaggctttggtggcagcatggacagtggccctgtgcaggctgaaaaccatgacaccttcctgctggccatgctcctcagcgtcctgctgcctctgctcccaggggccggcctggcctggtgttgctaccgactcccaggagcccatctgcagcgatgcagctggggctgcagaagggaccctgcgtgcagtggccccaaagatggcccacacagggaccaccccctgggcggcgttcaccccatggagttgggccccacagccactggacagccctggcccctggaccctgagaactctcatgagcccagcagccaccctgagaagcctctgccagcagtctcgcctgacccccaagatcaagtccagatgccaagatcctgcctctggtgagaggtagctcctaaaatgaacagatttaaagacaggtggccactgacagccactccaggaacttgaactgcaggggcagagccagtgaatcaccggacctccagcacctgcaggcagcttggaagtttcttccccgagtggagcttcgacccacccactccaggaacccagagccacattagaagttcctgagggctggagaacactgctgggcacactctccagctcaataaaccatcagtcccagaagcaaaggtcacacagcccctgacctccctcaccagtggaggctgggtagtgctggccatcccaaaagggctctgtcctgggagtctggtgtgtctcctacatgcaatttccacggacccagctctgtggagggcatgactgctggccagaagctagtggtcctggggccctatggttcgactgagtccacactcccctggagcctggctggcctctgcaaacaaacataattttggggaccttccttcctgtttcttcccaccctgtcttctcccctaggtggttcctgagcccccacccccaatcccagtgctacacctgaggttctggagctcagaatctgacagcctctcccccattctgtgtgtgtcggggggacagagggaaccatttaagaaaagataccaaagtagaagtcaaaagaaagacatgttggctataggcgtggtggctcatgcctataatcccagcactttgggaagccggggtaggaggatcaccagaggccagcaggtccacaccagcctgggcaacacagcaagacaccgcatctacagaaaaattttaaaattagctgggcgtggtggtgtgtacctgtaggcctagctgctcaggaggctgaagcaggaggatcacttgagcctgagttcaacactgcagtgagctatggtggcaccactgcactccagcctgggtgacagagcaagaccctgtctctaaaataaattttaaaaagacatatta

SEQ ID NO: 104681 - DNA, 1971 bp, Homo sapiens
  Payload ID: 552
  Gene Symbol: ADAM33
  Gene Name: ADAM metallopeptidase domain 33
  ENST ID: ENST00000617732
  CDS Start-End: 48-464
gagccggagttgcgagccgctgcctagaggccgaggagctcacagctatgggctggaggccccggagagctcgggggaccccgttgctgctgctgctactactgctgctgctctggccagtgccaggcgccggggtgcttcaaggacatatccctgggcagccagtcaccccgcactgggtcctggatggacaaccctggcgcaccgtcagcctggaggagccggtctcgaagccagacatggggctggtggccctggaggctgaaggccaggagctcctgcttgagctggagaagaaccacaggctgctggccccaggatacatagaaacccactacggcccagatgggcagccagtggtgctggcccccaaccacacggtgagatgcttccatgggctctgggatgcaccgccagaggtacccccccaccattcctacccctactcctccttgcattcctaaggggcggttggagccagcccctaccacaccctccctcttgcccctcttgctccagccctggctgagatttggggctggccccttcctccctaggatcattgccactaccaagggcgagtaaggggcttccccgactcctgggtagtcctctgcacctgctctgggatgaggtgagctctgggagaggaggctgggcctgggatggggaaagagctccctcacacccgctcctacccctctgcaccctagtggcctgatcaccctcagcaggaatgccagctattatctgcgtccctggccaccccggggctccaaggacttctcaacccacgagatctttcggatggagcagctgctcacctggaaaggaacctgtggccacagggatcctgggaacaaagcgggcatgaccagccttcctggtggtccccagagcagggtcaggggcatcgatcggatgggagtgggaatgctgtatctatagccctccaaatcagaagagacgggaattcacaggcctcgagtcccagtatttttattgaagtctgaagaaacaagttccagaaaacatgttaaacttccttctgggagctgggattggtggtcagggctcaagcccagcagcttccacgagcttcagcgctgcctgactgcctgccacagccacggggtttgcaatagcaaccataactgccactgtgctccaggctgggctccacccttctgtgacaagccaggctttggtggcagcatggacagtggccctgtgcaggctgaaaaccatgacaccttcctgctggccatgctcctcagcgtcctgctgcctctgctcccaggggccggcctggcctggtgttgctaccgactcccaggagcccatctgcagcgatgcagctggggctgcagaagggaccctgcgtgcagtggccccaaagatggcccacacagggaccaccccctgggcggcgttcaccccatggagttgggccccacagccactggacagccctggcccctggaccctgagaactctcatgagcccagcagccaccctgagaagcctctgccagcagtctcgcctgacccccaagatcaagtccagatgccaagatcctgcctctggtgagaggtagctcctaaaatgaacagatttaaagacaggtggccactgacagccactccaggaacttgaactgcaggggcagagccagtgaatcaccggacctccagcacctgcaggcagcttggaagtttcttccccgagtggagcttcgacccacccactccaggaacccagagccacattagaagttcctgagggctggagaacactgctgggcacactctccagctcaataaaccatcagtcccagaagcaaaggtcacacagcccctgacctccctcaccagtggaggctgggtagtgctggccatcccaaaagggctctgtcctgggagtctggtgtgtctcctacatgcaatttccacggacccagctctgtggagg

SEQ ID NO: 104682 - DNA, 3195 bp, Homo sapiens
  Payload ID: 552
  Gene Symbol: ADAM33
  Gene Name: ADAM metallopeptidase domain 33
  ENST ID: ENST00000619289
  CDS Start-End: 128-2206
gggaggtgggggcgggaaggtccgaaggcggcggcctgaggctgcaccgggcacgggtcggccgcaatccagcctgggcggagccggagttgcgagccgctgcctagaggccgaggagctcacagctatgggctggaggccccggagagctcgggggaccccgttgctgctgctgctactactgctgctgctctggccagtgccaggcgccggggtgcttcaaggacatatccctgggcagccagtcaccccgcactgggtcctggatggacaaccctggcgcaccgtcagcctggaggagccggtctcgaagccagacatggggctggtggccctggaggctgaaggccaggagctcctgcttgagctggagaagaaccacaggctgctggccccaggatacatagaaacccactacggcccagatgggcagccagtggtgctggcccccaaccacacggatcattgccactaccaagggcgagtaaggggcttccccgactcctgggtagtcctctgcacctgctctgggatgagtggcctgatcaccctcagcaggaatgccagctattatctgcgtccctggccaccccggggctccaaggacttctcaacccacgagatctttcggatggagcagctgctcacctggaaaggaacctgtggccacagggatcctgggaacaaagcgggcatgaccagccttcctggtggtccccagagcaggggcaggcgagaagcgcgcaggacccggaagtacctggaactgtacattgtggcagaccacaccctgttcttgactcggcaccgaaacttgaaccacaccaaacagcgtctcctggaagtcgccaactacgtggaccagcttctcaggactctggacattcaggtggcgctgaccggcctggaggtgtggaccgagcgggaccgcagccgccgccagctgcgcgccttcttccgcaaggggggcggcgcttgcctctccaatgccccggaccccggactcccggtgccgccggcgctctgcgggaacggcttcgtggaagcgggcgaggagtgtgactgcggccctggccaggagtgccgcgacctctgctgctttgctcacaactgctcgctgcgcccgggggcccagtgcgcccacggggactgctgcgtgcgctgcctgctgaagccggctggagcgctgtgccgccaggccatgggtgactgtgacctccctgagttttgcacgggcacctcctcccactgtcccccagacgtttacctactggacggctcaccctgtgccaggggcagtggctactgctgggatggcgcatgtcccacgctggagcagcagtgccagcagctctgggggcctggctcccacccagctcccgaggcctgtttccaggtggtgaactctgcgggagatgctcatggaaactgcggccaggacagcgagggccacttcctgccctgtgcagggagggatgccctgtgtgggaagctgcagtgccagggtggaaagcccagcctgctcgcaccgcacatggtgccagtggactctaccgttcacctagatggccaggaagtgacttgtcggggagccttggcactccccagtgcccagctggacctgcttggcctgggcctggtagagccaggcacccagtgtggacctagaatggtgtgccagagcaggcgctgcaggaagaatgccttccaggagcttcagcgctgcctgactgcctgccacagccacggggtttgcaatagcaaccataactgccactgtgctccaggctgggctccacccttctgtgacaagccaggctttggtggcagcatggacagtggccctgtgcaggctgaaaaccatgacaccttcctgctggccatgctcctcagcgtcctgctgcctctgctcccaggggccggcctggcctggtgttgctaccgactcccaggagcccatctgcagcgatgcagctggggctgcagaagggaccctgcgtgcagtggccccaaagatggcccacacagggaccaccccctgggcggcgttcaccccatggagttgggccccacagccactggacagccctggcccctggaccctgagaactctcatgagcccagcagccaccctgagaagcctctgccagcagtctcgcctgacccccaagatcaagtccagatgccaagatcctgcctctggtgagaggtagctcctaaaatgaacagatttaaagacaggtggccactgacagccactccaggaacttgaactgcaggggcagagccagtgaatcaccggacctccagcacctgcaggcagcttggaagtttcttccccgagtggagcttcgacccacccactccaggaacccagagccacattagaagttcctgagggctggagaacactgctgggcacactctccagctcaataaaccatcagtcccagaagcaaaggtcacacagcccctgacctccctcaccagtggaggctgggtagtgctggccatcccaaaagggctctgtcctgggagtctggtgtgtctcctacatgcaatttccacggacccagctctgtggagggcatgactgctggccagaagctagtggtcctggggccctatggttcgactgagtccacactcccctggagcctggctggcctctgcaaacaaacataattttggggaccttccttcctgtttcttcccaccctgtcttctcccctaggtggttcctgagcccccacccccaatcccagtgctacacctgaggttctggagctcagaatctgacagcctctcccccattctgtgtgtgtcggggggacagagggaaccatttaagaaaagataccaaagtagaagtcaaaagaaagacatgttggctataggcgtggtggctcatgcctataatcccagcactttgggaagccggggtaggaggatcaccagaggccagcaggtccacaccagcctgggcaacacagcaagacaccgcatctacagaaaaattttaaaattagctgggcgtggtggtgtgtacctgtaggcctagctgctcaggaggctgaagcaggaggatcacttgagcctgagttcaacactgcagtgagctatggtggcaccactgcactccagcctgggtgacagagcaagaccctgtctctaaaataaattttaaaaagacat

SEQ ID NO: 104683 - DNA, 3367 bp, Homo sapiens
  Payload ID: 553
  Gene Symbol: ADAM7
  Gene Name: ADAM metallopeptidase domain 7
  Uniprot ID: Q9H2U9
  ENST ID: ENST00000175238
  CDS Start-End: 84-2348
atccctgcagtggaagtgaggaggaagaaaggtgaactccttttctcaagcacttctgctctcctctaccagaatcactcagaatgcttcccgggtgtatattcttgatgattttactcattcctcaggttaaagaaaagttcatccttggagtagagggtcaacaactggttcgtcctaaaaagcttcctctgatacagaagcgagatactggacacacccatgatgatgacatactgaaaacgtatgaagaagaattgttgtatgaaataaaactaaatagaaaaaccttagtccttcatcttctaagatccagggagttcctaggctcaaattacagtgaaacattctactccatgaaaggagaagcgttcaccaggcatcctcagatcatggatcattgtttttaccaaggatccatagtacacgaatatgattcagctgccagtatcagtacgtgtaatggtctaaggggattcttcagaataaacgaccaaagatacctcattgaaccagtgaaatactcagatgagggagaacatttggtgttcaaatataacctgagggtgccgtatggtgccaattattcctgtacagagcttaattttaccagaaaaactgttccaggggataatgaatctgaagaagactccaaaataaaaggcatccatgatgaaaagtatgttgaattgttcattgttgctgatgatactgtgtatcgcagaaatggtcatcctcacaataaactaaggaaccgaatttggggaatggtcaattttgtcaacatgatttataaaaccttaaacatccatgtgacgttggttggcattgaaatatggacacatgaagataaaatagaactatattcaaatatagaaactaccttattgcgtttttcattttggcaagaaaagatccttaaaacacggaaggattttgatcatgttgtattactcagtgggaagtggctctactcacatgtgcaaggaatttcttatccagggggtatgtgcctgccctattattccaccagtatcattaaggatcttttacctgacacaaacataattgcaaacagaatggcacatcaactggggcataaccttgggatgcagcatgacgagttcccatgcacctgtccttcaggaaaatgcgtgatggacagtgatggaagcattcctgcactgaaattcagtaaatgcagccaaaaccaataccaccagtacttgaaggattataagccaacatgcatgctcaacattccatttccttacaattttcatgatttccaattttgtggaaacaagaagttggatgagggtgaagagtgtgactgtggccctgctcaggagtgtactaatccttgctgtgatgcacacacatgtgtactgaagccaggatttacttgtgcagaaggagaatgctgtgaatcttgtcagataaaaaaagcagggtccatatgcagaccggcgaaagatgaatgtgattttcctgagatgtgcactggccactcgcctgcctgtcctaaggaccagttcagggtcaatggatttccttgcaagaactcagaaggctactgtttcatggggaaatgtccaactcgtgaggatcagtgctctgaactatttgatgatgaggcaatagagagtcatgatatctgctacaagatgaatacaaaaggaaataaatttggatactgcaaaaacaaggaaaacagatttcttccctgtgaggagaaagatgtcagatgtggaaagatctactgcactggaggggagctttcctctctccttggagaagacaagacttatcaccttaaggatccccagaagaatgctactgtcaaatgcaaaactatttttttataccatgattctacagacattggcctggtggcgtcaggaacaaaatgtggagagggaatggtgtgcaacaatggtgaatgtctaaacatggaaaaggtctatatctcaaccaattgcccctctcagtgcaatgaaaatcctgtggatggccacggactccagtgccactgtgaggaaggacaggcacctgtagcctgtgaagaaaccttacatgttaccaatatcaccatcttggttgttgtgcttgtcctggttattgtcggtatcggagttcttatactattagttcgttaccgaaaatgtatcaagttgaagcaagttcagagcccacctacagaaaccctgggagtggagaacaaaggatactttggtgatgagcagcagataaggactgagccaatcctgccagaaattcatttcctaaataaacctgcaagtaaagattcaagaggaatcgcagatcccaatcaaagtgccaagtgagcttgaagttggatatccaaaatggccgtgcaagcttaggctggggattctggatgcaacgtctttacaaccttacctagatatctgctactcacatttttggtagtgtttcaaacgttctttatccagacagacaatgtttaagagaaacaacttatttctgttaatatttaccggtagaattcacaccctctatcataaacatatgctgcagaaaaaaaatgtcttgtggtctttcaaatgctctttagcacaatataaaaattcgtaaccttgctgtagtattttcctacaaaatgttactctgctttcttttaagaatccaaactttaaggatgataacttacagtctaagaagaaaacattgcatataaaaagttacttttttggaaacataaaagtacgttttaaaacttgaacatgacatcattagcactaattctggtttaaatgaaagtcctgcagaaatgccaaagaaggcagggcagagcggcacggattctaggtaattaaaagtgaaagaggcagaagaatagtggacagaactgcaggatagtccttaaaataatggtggtgggaaaggaaaacacagaatgctcctggcaattctaaattcctaggtttgcctttctagaattccttaagaagctgacagagaaatcagagggttacaagaatttcagaaaatttactccaagtgagaggacatactcacaactcctatgaagggtttctaaggtctttgtcctgtgcaatttgacaatgtgccatttctgtgctgtctctgccctctccctatccgtttgttatgggatgggggattaccctgggaatgatttcagctgcttcttacacagatgcctctcaaggtgttcttttgtgtcctctattttcttcttgtgaactgttaaagctacatgcattattttttttccatttactgaaataaagttttcaagttctaaataaaaatattctgactcgatgaaataaataaaggctacaaaagaaggaagaaa

SEQ ID NO: 104684 - DNA, 3358 bp, Homo sapiens
  Payload ID: 553
  Gene Symbol: ADAM7
  Gene Name: ADAM metallopeptidase domain 7
  ENST ID: ENST00000380789
  CDS Start-End: 26-2356
ctctcctctaccagaatcactcagaatgcttcccgggtgtatattcttgatgattttactcattcctcaggttaaagaaaagttcatccttggagtagagggtcaacaactggttcgtcctaaaaagcttcctctgatacagaagcgagatactggacacacccatgatgatgacatactgaaaacgtatgaagaagaattgttgtatgaaataaaactaaatagaaaaaccttagtccttcatcttctaagatccagggagttcctaggctcaaattacagtgaaacattctactccatgaaaggagaagcgttcaccaggcatcctcagatcatggatcattgtttttaccaaggatccatagtacacgaatatgattcagctgccagtatcagtacgtgtaatggtctaaggggattcttcagaataaacgaccaaagatacctcattgaaccagtgaaatactcagatgagggagaacatttggtgttcaaatataacctgagggtgccgtatggtgccaattattcctgtacagagcttaattttaccagaaaaactgttccaggggataatgaatctgaagaagactccaaaataaaaggcatccatgatgaaaagtatgttgaattgttcattgttgctgatgatactgtgtatcgcagaaatggtcatcctcacaataaactaaggaaccgaatttggggaatggtcaattttgtcaacatgatttataaaaccttaaacatccatgtgacgttggttggcattgaaatatggacacatgaagataaaatagaactatattcaaatatagaaactaccttattgcgtttttcattttggcaagaaaagatccttaaaacacggaaggattttgatcatgttgtattactcagtgggaagtggctctactcacatgtgcaaggaatttcttatccagggggtatgtgcctgccctattattccaccagtatcattaaggatcttttacctgacacaaacataattgcaaacagaatggcacatcaactggggcataaccttgggatgcagcatgacgagttcccatgcacctgtccttcaggaaaatgcgtgatggacagtgatggaagcattcctgcactgaaattcagtaaatgcagccaaaaccaataccaccagtacttgaaggattataagccaacatgcatgctcaacattccatttccttacaattttcatgatttccaattttgtggaaacaagaagttggatgagggtgaagagtgtgactgtggccctgctcaggagtgtactaatccttgctgtgatgcacacacatgtgtactgaagccaggatttacttgtgcagaaggagaatgctgtgaatcttgtcagataaaaaaagcagggtccatatgcagaccggcgaaagatgaatgtgattttcctgagatgtgcactggccactcgcctgcctgtcctaaggaccagttcagggtcaatggatttccttgcaagaactcagaaggctactgtttcatggggaaatgtccaactcgtgaggatcagtgctctgaactatttgatgatgaggcaatagagagtcatgatatctgctacaagatgaatacaaaaggaaataaatttggatactgcaaaaacaaggaaaacagatttcttccctgtgaggagaaagatgtcagatgtggaaagatctactgcactggaggggagctttcctctctccttggagaagacaagacttatcaccttaaggatccccagaagaatgctactgtcaaatgcaaaactatttttttataccatgattctacagacattggcctggtggcgtcaggaacaaaatgtggagagggaatggtgtgcaacaatggtgaatgtctaaacatggaaaaggtctatatctcaaccaattgcccctctcagtgcaatgaaaatcctgtggatggccacggactccagtgccactgtgaggaaggacaggcacctgtagcctgtgaagaaaccttacatgttaccaatatcaccatcttggttgttgtgcttgtcctggttattgtcggtatcggagttcttatactattagttcgttaccgaaaatgtatcaagttgaagcaagttcagagcccacctacagaaaccctgggagtggagaacaaaggatactttggtgatgagcagcagataaggactgagccaatcctgccagaaattcatttcctaaatcagagaactccagaatccttggaaagcctgcccactagtttttcaagtccccactacatcacactgaaacctgcaagtaaagattcaagaggaatcgcagatcccaatcaaagtgccaagtgagcttgaagttggatatccaaaatggccgtgcaagcttaggctggggattctggatgcaacgtctttacaaccttacctagatatctgctactcacatttttggtagtgtttcaaacgttctttatccagacagacaatgtttaagagaaacaacttatttctgttaatatttaccggtagaattcacaccctctatcataaacatatgctgcagaaaaaaaatgtcttgtggtctttcaaatgctctttagcacaatataaaaattcgtaaccttgctgtagtattttcctacaaaatgttactctgctttcttttaagaatccaaactttaaggatgataacttacagtctaagaagaaaacattgcatataaaaagttacttttttggaaacataaaagtacgttttaaaacttgaacatgacatcattagcactaattctggtttaaatgaaagtcctgcagaaatgccaaagaaggcagggcagagcggcacggattctaggtaattaaaagtgaaagaggcagaagaatagtggacagaactgcaggatagtccttaaaataatggtggtgggaaaggaaaacacagaatgctcctggcaattctaaattcctaggtttgcctttctagaattccttaagaagctgacagagaaatcagagggttacaagaatttcagaaaatttactccaagtgagaggacatactcacaactcctatgaagggtttctaaggtctttgtcctgtgcaatttgacaatgtgccatttctgtgctgtctctgccctctccctatccgtttgttatgggatgggggattaccctgggaatgatttcagctgcttcttacacagatgcctctcaaggtgttcttttgtgtcctctattttcttcttgtgaactgttaaagctacatgcattattttttttccatttactgaaataaagttttcaagttctaaataaaaatattctgactcgatgaaataaataaaggct

SEQ ID NO: 104685 - DNA, 1417 bp, Homo sapiens
  Payload ID: 553
  Gene Symbol: ADAM7
  Gene Name: ADAM metallopeptidase domain 7
  Uniprot ID: Q9H2U9
  ENST ID: ENST00000441335
  CDS Start-End: 180-812
ggttttagcctcaagcacctagcaagttgtgtaactccctcaaggaacacttccttgttgtggatcaaaactgcccacctatctgtgaggtgcttcatccctgcagtggaagtgaggaggaagaaaggtgaactccttttctcaagcacttctgctctcctctaccagaatcactcagaatgcttcccgggtgtatattcttgatgattttactcattcctcaggttaaagaaaagttcatccttggagtagagggtcaacaactggttcgtcctaaaaagcttcctctgatacagaagcgagatactggacacacccatgatgatgacatactgaaaacgtatgaagaagaattgttgtatgaaataaaactaaatagaaaaaccttagtccttcatcttctaagatccagggagttcctaggctcaaattacagtgaaacattctactccatgaaaggagaagcgttcaccaggcatcctcagatcatggatcattgtttttaccaaggatccatagtacacgaatatgattcagctgccagtatcagtacgtgtaatggtctaaggggattcttcagaataaacgaccaaagatacctcattgaaccagtgaaatactcagatgagggagaacatttggtgttcaaatataacctgagggtgccgtatggtgccaattattcctgtacagagcttaattttaccagaaaaactgttccaggggataatgaatctgaagaagactccaaaataaaagtgagtactttattattatctttaccccaaatgaaacaccttttattttcttgatgatgtctagggataaagtatgagtccagttactgaaatatatgtgctactttcagtctggcacttcatctgatatttgaaattggaaaattttttcttgtctatgtaaaaagtgtttatttcatagagtttgtttaatcagtttcaagaaaggatgattctacaattctatgtatagattgataacattggggctatgagtagttggaaatcatgaaattttcaatgtcctaaaacctaatctagagatagtgtctttccttttcttccctgccatttttttttgcagagttattgatgacaagctatgttctcccctttttatcattcaaatgttttaatggttaaggatgattaaggataaaacaagttcagtttttggtgggatggttgtataaaagtagtccttggagctttaggcttttctatacaactaatccatatccccttaaattcccagtggatgttagtctgtaagctacttggttgtttttcttcttcgtatgtccatgatttgtatagtgtctgacacatactgtatgcctaatggatgtttcctgattgaataaatcaacaaataaatgattacttagtccatagaaaaa

SEQ ID NO: 104686 - DNA, 1870 bp, Homo sapiens
  Payload ID: 553
  Gene Symbol: ADAM7
  Gene Name: ADAM metallopeptidase domain 7
  ENST ID: ENST00000520720
  CDS Start-End: 131-1681
ggtttgccctcgtagctatttcctggagggaaggggtagctacagtttcctgtccctcttcagcacttctccagctccatatcgcagaaatggtcatcctcacaataaactaaggaaccgaatttggggaatggtcaattttgtcaacatgatttataaaaccttaaacatccatgtgacgttggttggcattgaaatatggacacatgaagataaaatagaactatattcaaatatagaaactaccttattgcgtttttcattttggcaagaaaagatccttaaaacacggaaggattttgatcatgttgtattactcagtgggaagtggctctactcacatgtgcaaggaatttcttatccagggggtatgtgcctgccctattattccaccagtatcattaaggatcttttacctgacacaaacataattgcaaacagaatggcacatcaactggggcataaccttgggatgcagcatgacgagttcccatgcacctgtccttcaggaaaatgcgtgatggacagtgatggaagcattcctgcactgaaattcagtaaatgcagccaaaaccaataccaccagtacttgaaggattataagccaacatgcatgctcaacattccatttccttacaattttcatgatttccaattttgtggaaacaagaagttggatgagggtgaagagtgtgactgtggccctgctcaggagtgtactaatccttgctgtgatgcacacacatgtgtactgaagccaggatttacttgtgcagaaggagaatgctgtgaatcttgtcagataaaaaaagcagggtccatatgcagaccggcgaaagatgaatgtgattttcctgagatgtgcactggccactcgcctgcctgtcctaaggaccagttcagggtcaatggatttccttgcaagaactcagaaggctactgtttcatggggaaatgtccaactcgtgaggatcagtgctctgaactatttgatgatgaggcaatagagagtcatgatatctgctacaagatgaatacaaaaggaaataaatttggatactgcaaaaacaaggaaaacagatttcttccctgtgaggagaaagatgtcagatgtggaaagatctactgcactggaggggagctttcctctctccttggagaagacaagacttatcaccttaaggatccccagaagaatgctactgtcaaatgcaaaactatttttttataccatgattctacagacattggcctggtggcgtcaggaacaaaatgtggagagggaatggtgtgcaacaatggtgaatgtctaaacatggaaaaggtctatatctcaaccaattgcccctctcagtgcaatgaaaatcctgtggatggccacggactccagtgccactgtgaggaaggacaggcacctgtagcctgtgaagaaaccttacatgttaccaatatcaccatcttggttgttgtgcttgtcctggttattgtcggtatcggagttcttatactattagttcgttaccgaaaatgtatcaagttgaagcaagttcagagcccacctacagaaaccctgggagtggagaacaaaggatactttggtgatgagcagcagataaggactgagccaatcctgccagaaattcatttcctaaatcacctcttatatggaaggcatcaatgagaaccaaaataaaaactacaatccctcactcaagaagtttaaaatgaagtgaatggacaattgtgagaagaaatgctattgatcttccaaagttgtatattcgatagtgaatattgtatgtttaaagtaaccttgcaaaatgtgtcatgtcaaatgtaataaattgtatgttctgacgaaggaatggaa

SEQ ID NO: 104687 - DNA, 818 bp, Homo sapiens
  Payload ID: 554
  Gene Symbol: ADAM8
  Gene Name: ADAM metallopeptidase domain 8
  ENST ID: ENST00000560135
  CDS Start-End: 47-376
gtgtcccgcggggctgtcacctccgcctctgctccccgacccggccatgcgcggcctcgggctctggctgctgggcgcgatgatgctgcctgggcctgcacccagagagggtgagctacgtccttggggccacagggcacaacttcaccctccacctgcggaagaacagggacctgctgggctccggctacacagagacctatacggctgccaatggctccgaggtgacggagcagcctcgcgggcaggaccactgcttctaccagggccacgtagaggggtacccggactcagccgccagcctcagcacctgtgccggcctcaggggtttcttccaggtggggtcagacctgcacctgatcgagcccctggatgaaggtggcgagggcggacggcacgccgtgtaccaggctgagcacctgctgcagacggccgggacctgcggggtcagcgacgacagcctgggcagcctcctgggaccccggacggcagccgtcttcaggcctcggcccggggactctctgccatcccgagagacccgctacgtggagctgtatgtggtcgtggacaatgcagagttccagatgctggggagcgaagcagccgtgcgtcatcgggtgctggaggtggtgaatcacgtggacaagctatatcagaaactcaacttccgtgtggtcctggtgggcctggagatttggaatagtcaggacaggttccacgtcagccccgaccccagtgtcacactggagaacctcctgacctggcaggcacggcaacggacacggcggcacctgcatgacaacgtacagctcatcacg

SEQ ID NO: 104688 - DNA, 2441 bp, Homo sapiens
  Payload ID: 554
  Gene Symbol: ADAM8
  Gene Name: ADAM metallopeptidase domain 8
  Uniprot ID: P78325
  ENST ID: ENST00000485491
  CDS Start-End: 52-2253
agaccgtgtcccgcggggctgtcacctccgcctctgctccccgacccggccatgcgcggcctcgggctctggctgctgggcgcgatgatgctgcctgggcctgcacccagagagggtgagctacgtccttggggccacagggcacaacttcaccctccacctgcggaagaacagggacctgctgggctccggctacacagagacctatacggctgccaatggctccgaggtgacggagcagcctcgcgggcaggaccactgcttctaccagggccacgtagaggggtacccggactcagccgccagcctcagcacctgtgccggcctcaggtggggtcagacctgcacctgatcgagcccctggatgaaggtggcgagggcggacggcacgccgtgtaccaggctgagcacctgctgcagacggccgggacctgcggggtcagcgacgacagcctgggcagcctcctgggaccccggacggcagccgtcttcaggcctcggcccggggactctctgccatcccgagagacccgctacgtggagctgtatgtggtcgtggacaatgcagagttccagatgctggggagcgaagcagccgtgcgtcatcgggtgctggaggtggtgaatcacgtggacaagctatatcagaaactcaacttccgtgtggtcctggtgggcctggagatttggaatagtcaggacaggttccacgtcagccccgaccccagtgtcacactggagaacctcctgacctggcaggcacggcaacggacacggcggcacctgcatgacaacgtacagctcatcacgggtgtcgacttcaccgggactaccgtggggtttgccagggtgtccgccatgtgctcccacagctcaggggctgtgaaccaggaccacagcaagaaccccgtgggcgtggcctgtaccatggcccatgagatgggccacaacctgggcatggaccatgatgagaacgtccagggctgccgctgccaggaacgcttcgaggccggccgctgcatcatggcgggcagcattggctccagtttccccaggatgttcagtgactgcagccaggcctacctggagagctttttggagcggccgcagtcggtgtgcctcgccaacgcccctgacctcagccacctggtgggcggccccgtgtgtgggaacctgtttgtggagcgtggggagcagtgcgactgcggcccccccgaggactgccggaaccgctgctgcaactctaccacctgccagctggctgagggggcccagtgtgcgcacggtacctgctgccaggagtgcaaggtgaagccggctggtgagctgtgccgtcccaagaaggacatgtgtgacctcgaggagttctgtgacggccggcaccctgagtgcccggaagacgccttccaggagaacggcacgccctgctccgggggctactgctacaacggggcctgtcccacactggcccagcagtgccaggccttctgggggccaggtgggcaggctgccgaggagtcctgcttctcctatgacatcctaccaggctgcaaggccagccggtacagggctgacatgtgtggcgttctgcagtgcaagggtgggcagcagcccctggggcgtgccatctgcatcgtggatgtgtgccacgcgctcaccacagaggatggcactgcgtatgaaccagtgcccgagggcacccggtgtggaccagagaaggtgtgcaaccacaagcaggagtgccactgccacgcgggctgggccccgccccactgcgcgaagctgctgactgaggtgcacgcagcgtccgggagcctccccgtcttcgtggtggtggttctggtgctcctggcagttgtgctggtcaccctggcaggcatcatcgtctaccgcaaagcccggagccgcatcctgagcaggaacgtggctcccaagaccacaatggggcgctccaaccccctgttccaccaggctgccagccgcgtgccggccaagggcggggctccagccccatccaggggcccccaagagctggtccccaccacccacccgggccagcccgcccgacacccggcctcctcggtggctctgaagaggccgccccctgctcctccggtcactgtgtccagcccacccttcccagttcctgtctacacccggcaggcaccaaagcagggtgctgttggcccaaaggttgccctgaagccccccatccagaggaagcaaggagccggagctcccacagcaccctaggggggcacctgcgcctgtgtggaaatttggagaagttgcggcagagaagccatgcgttccagcattccacggtccagctagtgccgctcagccctagaccctgactttgcaggctcagctgctgttctaacctcaggaatgcatctacctgagaggctcctgctgtccacgccctcagccaattcctt

SEQ ID NO: 104689 - DNA, 3279 bp, Homo sapiens
  Payload ID: 554
  Gene Symbol: ADAM8
  Gene Name: ADAM metallopeptidase domain 8
  Uniprot ID: P78325
  ENST ID: ENST00000445355
  CDS Start-End: 52-2526
agaccgtgtcccgcggggctgtcacctccgcctctgctccccgacccggccatgcgcggcctcgggctctggctgctgggcgcgatgatgctgcctgcgattgcccccagccggccctgggccctcatggagcagtatgaggtcgtgttgccgtggcgtctgccaggcccccgagtccgccgagctctgccctcccacttgggcctgcacccagagagggtgagctacgtccttggggccacagggcacaacttcaccctccacctgcggaagaacagggacctgctgggctccggctacacagagacctatacggctgccaatggctccgaggtgacggagcagcctcgcgggcaggaccactgcttctaccagggccacgtagaggggtacccggactcagccgccagcctcagcacctgtgccggcctcaggggtttcttccaggtggggtcagacctgcacctgatcgagcccctggatgaaggtggcgagggcggacggcacgccgtgtaccaggctgagcacctgctgcagacggccgggacctgcggggtcagcgacgacagcctgggcagcctcctgggaccccggacggcagccgtcttcaggcctcggcccggggactctctgccatcccgagagacccgctacgtggagctgtatgtggtcgtggacaatgcagagttccagatgctggggagcgaagcagccgtgcgtcatcgggtgctggaggtggtgaatcacgtggacaagctatatcagaaactcaacttccgtgtggtcctggtgggcctggagatttggaatagtcaggacaggttccacgtcagccccgaccccagtgtcacactggagaacctcctgacctggcaggcacggcaacggacacggcggcacctgcatgacaacgtacagctcatcacgggtgtcgacttcaccgggactaccgtggggtttgccagggtgtccgccatgtgctcccacagctcaggggctgtgaaccaggaccacagcaagaaccccgtgggcgtggcctgtaccatggcccatgagatgggccacaacctgggcatggaccatgatgagaacgtccagggctgccgctgccaggaacgcttcgaggccggccgctgcatcatggcgggcagcattggctccagtttccccaggatgttcagtgactgcagccaggcctacctggagagctttttggagcggccgcagtcggtgtgcctcgccaacgcccctgacctcagccacctggtgggcggccccgtgtgtgggaacctgtttgtggagcgtggggagcagtgcgactgcggcccccccgaggactgccggaaccgctgctgcaactctaccacctgccagctggctgagggggcccagtgtgcgcacggtacctgctgccaggagtgcaaggtgaagccggctggtgagctgtgccgtcccaagaaggacatgtgtgacctcgaggagttctgtgacggccggcaccctgagtgcccggaagacgccttccaggagaacggcacgccctgctccgggggctactgctacaacggggcctgtcccacactggcccagcagtgccaggccttctgggggccaggtgggcaggctgccgaggagtcctgcttctcctatgacatcctaccaggctgcaaggccagccggtacagggctgacatgtgtggcgttctgcagtgcaagggtgggcagcagcccctggggcgtgccatctgcatcgtggatgtgtgccacgcgctcaccacagaggatggcactgcgtatgaaccagtgcccgagggcacccggtgtggaccagagaaggtttgctggaaaggacgttgccaggacttacacgtttacagatccagcaactgctctgcccagtgccacaaccatggggtgtgcaaccacaagcaggagtgccactgccacgcgggctgggccccgccccactgcgcgaagctgctgactgaggtgcacgcagcgtccgggagcctccccgtcttcgtggtggtggttctggtgctcctggcagttgtgctggtcaccctggcaggcatcatcgtctaccgcaaagcccggagccgcatcctgagcaggaacgtggctcccaagaccacaatggggcgctccaaccccctgttccaccaggctgccagccgcgtgccggccaagggcggggctccagccccatccaggggcccccaagagctggtccccaccacccacccgggccagcccgcccgacacccggcctcctcggtggctctgaagaggccgccccctgctcctccggtcactgtgtccagcccacccttcccagttcctgtctacacccggcaggcaccaaagcaggtcatcaagccaacgttcgcacccccagtgcccccagtcaaacccggggctggtgcggccaaccctggtccagctgagggtgctgttggcccaaaggttgccctgaagccccccatccagaggaagcaaggagccggagctcccacagcaccctaggggggcacctgcgcctgtgtggaaatttggagaagttgcggcagagaagccatgcgttccagcattccacggtccagctagtgccgctcagccctagaccctgactttgcaggctcagctgctgttctaacctcaggaatgcatctacctgagaggctcctgctgtccacgccctcagccaattccttctccccgccttggccacgtgtagccccagctgtctgcaggcaccaggctgggatgagctgtgtgcttgcgggtgcgtgtgtgtgtacgtgtctccaggtggccgctggtctcccgctgtgttcaggaggccacatatacagcccctcccagccacacctgcccctgctctggggcctgctgagccggctgccctgggcacccggttccaggcagcacagacgtggggcatccccagaaagactccatcccaggaccaggttcccctgcgtgctcttcgagagggtgtcagtgagcagactgcaccccaagctcccgactccaggtcccctgatcttggggcctgtttcccatgggattcaagagggacagccccagctttgtgtgtgtttaagcttaggaatcgcctttatggaaagggctatgtgggagagtcagctatcttgtctggttttcttgagacctcagatgtgtgttcagcagggctgaaagcttttattctttaataatgagaaatgtatattttactaataaattattgaccgagttctgtagattcttgttaga

SEQ ID NO: 104690 - DNA, 776 bp, Homo sapiens
  Payload ID: 554
  Gene Symbol: ADAM8
  Gene Name: ADAM metallopeptidase domain 8
  ENST ID: ENST00000486609
  CDS Start-End: 41-776
cgcggggctgtcacctccgcctctgctccccgacccggccatgcgcggcctcgggctctggctgctgggcgcgatgatgctgcctgcgattgcccccagccggccctgggccctcatggagcagtatgaggtcgtgttgccgtggcgtctgccaggcccccgagtccgccgagctctgccctcccacttgggagggcagttccggccccagccctgtccttacctcagcatccggggaacctactaccgacctgcccgctgccctgggctcatccagccggtggcacagctaaggctgtcccagagctctgcaggccgagccccagcctgcacatgggggctggagatgcagtggtccagcaggaggctctgcaggcaccaccagggcctgcacccagagagggtgagctacgtccttggggccacagggcacaacttcaccctccacctgcggaagaacagggacctgctgggctccggctacacagagacctatacggctgccaatggctccgaggtgacggagcagcctcgcgggcaggaccactgcttctaccagggccacgtagaggggtacccggactcagccgccagcctcagcacctgtgccggcctcaggggtttcttccaggtggggtcagacctgcacctgatcgagcccctggatgaaggtggcgagggcggacggcacgccgtgtaccaggctgagcacctgctgcagacggccgggacctgcggggtcagcgacgacagcctgggcagcctcctgggacccc

SEQ ID NO: 104691 - DNA, 3077 bp, Homo sapiens
  Payload ID: 554
  Gene Symbol: ADAM8
  Gene Name: ADAM metallopeptidase domain 8
  Uniprot ID: P78325
  ENST ID: ENST00000415217
  CDS Start-End: 34-2262
ctgtcacctccgcctctgctccccgacccggccatgcgcggcctcgggctctggctgctgggcgcgatgatgctgcctgcgattgcccccagccggccctgggccctcatggagcagtatgaggtcgtgttgccgtggcgtctgccaggcccccgagtccgccgagctctgccctcccacttgggcctgcacccagagagggtgagctacgtccttggggccacagggcacaacttcaccctccacctgcggaagaacagggacctgctgggctccggctacacagagacctatacggctgccaatggctccgaggtgacggagcagcctcgcgggcaggaccactgcttctaccagggccacgtagaggggtacccggactcagccgccagcctcagcacctgtgccggcctcaggggtttcttccaggtggggtcagacctgcacctgatcgagcccctggatgaaggtggcgagggcggacggcacgccgtgtaccaggctgagcacctgctgcagacggccgggacctgcggggtcagcgacgacagcctgggcagcctcctgggaccccggacggcagccgtcttcaggcctcggcccggggactctctgccatcccgagagacccgctacgtggagctgtatgtggtcgtggacaatgcagagttccagatgctggggagcgaagcagccgtgcgtcatcgggtgctggaggtggtgaatcacgtggacaagctatatcagaaactcaacttccgtgtggtcctggtgggcctggagatttggaatagtcaggacaggttccacgtcagccccgaccccagtgtcacactggagaacctcctgacctggcaggcacggcaacggacacggcggcacctgcatgacaacgtacagctcatcacgggtgtcgacttcaccgggactaccgtggggtttgccagggtgtccgccatgtgctcccacagctcaggggctgtgaaccaggaccacagcaagaaccccgtgggcgtggcctgtaccatggcccatgagatgggccacaacctgggcatggaccatgatgagaacgtccagggctgccgctgccaggaacgcttcgaggccggccgctgcatcatggcgggcagcattggctccagtttccccaggatgttcagtgactgcagccaggcctacctggagagctttttggagcggccgcagtcggtgtgcctcgccaacgcccctgacctcagccacctggtgggcggccccgtgtgtgggaacctgtttgtggagcgtggggagcagtgcgactgcggcccccccgaggactgccggaaccgctgctgcaactctaccacctgccagctggctgagggggcccagtgtgcgcacggtacctgctgccaggagtgcaaggtgaagccggctggtgagctgtgccgtcccaagaaggacatgtgtgacctcgaggagttctgtgacggccggcaccctgagtgcccggaagacgccttccaggagaacggcacgccctgctccgggggctactgctacaacggggcctgtcccacactggcccagcagtgccaggccttctgggggccaggtgggcaggctgccgaggagtcctgcttctcctatgacatcctaccaggctgcaaggccagccggtacagggctgacatgtgtggcgttctgcagtgcaagggtgggcagcagcccctggggcgtgccatctgcatcgtggatgtgtgccacgcgctcaccacagaggatggcactgcgtatgaaccagtgcccgagggcacccggtgtggaccagagaaggtttgctggaaaggacgttgccaggacttacacgtttacagatccagcaactgctctgcccagtgccacaaccatggggtgtgcaaccacaagcaggagtgccactgccacgcgggctgggccccgccccactgcgcgaagctgctgactgaggtgcacgcaggctgccagccgcgtgccggccaagggcggggctccagccccatccaggggcccccaagagctggtccccaccacccacccgggccagcccgcccgacacccggcctcctcggtggctctgaagaggccgccccctgctcctccggtcactgtgtccagcccacccttcccagttcctgtctacacccggcaggcaccaaagcaggtcatcaagccaacgttcgcacccccagtgcccccagtcaaacccggggctggtgcggccaaccctggtccagctgagggtgctgttggcccaaaggttgccctgaagccccccatccagaggaagcaaggagccggagctcccacagcaccctaggggggcacctgcgcctgtgtggaaatttggagaagttgcggcagagaagccatgcgttccagcattccacggtccagctagtgccgctcagccctagaccctgactttgcaggctcagctgctgttctaacctcaggaatgcatctacctgagaggctcctgctgtccacgccctcagccaattccttctccccgccttggccacgtgtagccccagctgtctgcaggcaccaggctgggatgagctgtgtgcttgcgggtgcgtgtgtgtgtacgtgtctccaggtggccgctggtctcccgctgtgttcaggaggccacatatacagcccctcccagccacacctgcccctgctctggggcctgctgagccggctgccctgggcacccggttccaggcagcacagacgtggggcatccccagaaagactccatcccaggaccaggttcccctgcgtgctcttcgagagggtgtcagtgagcagactgcaccccaagctcccgactccaggtcccctgatcttggggcctgtttcccatgggattcaagagggacagccccagctttgtgtgtgtttaagcttaggaatcgcctttatggaaagggctatgtgggagagtcagctatcttgtctggttttcttgagacctcagatgtgtgttcagcagggctgaaagcttttattctttaataatgagaaatgtatattttactaataaattattgaccgagttc

SEQ ID NO: 104692 - DNA, 3836 bp, Homo sapiens
  Payload ID: 555
  Gene Symbol: ADAM9
  Gene Name: ADAM metallopeptidase domain 9
  Uniprot ID: Q13443
  ENST ID: ENST00000379917
  CDS Start-End: 39-2006
cgaccgagtgctgagaggaacctgcggaatcggccgagatggggtctggcgcgcgctttccctcggggacccttcgtgtccggtggttgctgttgcttggcctggtgggcccagtcctcggtgcggcgcggccaggctttcaacagacctcacatctttcttcttatgaaattataactccttggagattaactagagaaagaagagaagcccctaggccctattcaaaacaagtatcttatgttattcaggctgaaggaaaagagcatattattcacttggaaaggaacaaagaccttttgcctgaagattttgtggtttatacttacaacaaggaagggactttaatcactgaccatcccaatatacagaatcattgtcattatcggggctatgtggagggagttcataattcatccattgctcttagcgactgttttggactcagaggattgctgcatttagagaatgcgagttatgggattgaacccctgcagaacagctctcattttgagcacatcatttatcgaatggatgatgtctacaaagagcctctgaaatgtggagtttccaacaaggatatagagaaagaaactgcaaaggatgaagaggaagagcctcccagcatgactcagctacttcgaagaagaagagctgtcttgccacagacccggtatgtggagctgttcattgtcgtagacaaggaaaggtatgacatgatgggaagaaatcagactgctgtgagagaagagatgattctcctggcaaactacttggatagtatgtatattatgttaaatattcgaattgtgctagttggactggagatttggaccaatggaaacctgatcaacatagttgggggtgctggtgatgtgctggggaacttcgtgcagtggcgggaaaagtttcttatcacacgtcggagacatgacagtgcacagctagttctaaagaaaggttttggtggaactgcaggaatggcatttgtgggaacagtgtgttcaaggagccacgcaggcgggattaatgtgtttggacaaatcactgtggagacatttgcttccattgttgctcatgaattgggtcataatcttggaatgaatcacgatgatgggagagattgttcctgtggagcaaagagctgcatcatgaattcaggagcatcgggttccagaaactttagcagttgcagtgcagaggactttgagaagttaactttaaataaaggaggaaactgccttcttaatattccaaagcctgatgaagcctatagtgctccctcctgtggtaataagttggtggacgctggggaagagtgtgactgtggtactccaaaggaatgtgaattggacccttgctgcgaaggaagtacctgtaagcttaaatcatttgctgagtgtgcatatggtgactgttgtaaagactgtcggttccttccaggaggtactttatgccgaggaaaaaccagtgagtgtgatgttccagagtactgcaatggttcttctcagttctgtcagccagatgtttttattcagaatggatatccttgccagaataacaaagcctattgctacaacggcatgtgccagtattatgatgctcaatgtcaagtcatctttggctcaaaagccaaggctgcccccaaagattgtttcattgaagtgaattctaaaggtgacagatttggcaattgtggtttctctggcaatgaatacaagaagtgtgccactgggaatgctttgtgtggaaagcttcagtgtgagaatgtacaagagatacctgtatttggaattgtgcctgctattattcaaacgcctagtcgaggcaccaaatgttggggtgtggatttccagctaggatcagatgttccagatcctgggatggttaacgaaggcacaaaatgtggtgctggaaagatctgtagaaacttccagtgtgtagatgcttctgttctgaattatgactgtgatgttcagaaaaagtgtcatggacatgggaaatgaatactgcattgagggacggacttctggtcttcttcttcctaattgttccccttattgtctgtgctatttttatcttcatcaagagggatcaactgtggagaagctacttcagaaagaagagatcacaaacatatgagtcagatggcaaaaatcaagcaaacccttctagacagccggggagtgttcctcgacatgtttctccagtgacacctcccagagaagttcctatatatgcaaacagatttgcagtaccaacctatgcagccaagcaacctcagcagttcccatcaaggccacctccaccacaaccgaaagtatcatctcagggaaacttaattcctgcccgtcctgctcctgcacctcctttatatagttccctcacttgatttttttaaccttctttttgcaaatgtcttcagggaactgagctaatactttttttttttcttgatgttttcttgaaaagcctttctgttgcaactatgaatgaaaacaaaacaccacaaaacagacttcactaacacagaaaaacagaaactgagtgtgagagttgtgaaatacaaggaaatgcagtaaagccagggaatttacaataacatttccgtttccatcattgaataagtcttattcagtcatcggtgaggttaatgcactaatcatggattttttgaacatgttattgcagtgattctcaaattaactgtattggtgtaagagttttgtcattaagtgtttaagtgttattctgaattttctaccttagttatcattaatgtagttcctcattgaacatgtgataatctaatacctgtgaaaactgactaatcagctgccaataatatctaatatttttcatcatgcacgaattaataatcatcatactctagaatcttgtctgtcactcactacatgaataagcaaatattgtcttcaaaagaatgcacaagaaccacaattaagatgtcatattattttgaaagtacaaaatatactaaaagagtgtgtgtgtattcacgcagttactcgcttccatttttatgacctttcaactataggtaataactcttagagaaattaatttaatattagaatttctattatgaatcatgtgaaagcatgacattcgttcacaatagcactattttaaataaattataagctttaaggtacgaagtatttaatagatctaatcaaatatgttgattcatggctataataaagcaggagcaattataaaatcttcaatcaattgaacttttacaaaaccacttgagaatttcatgagcactttaaaatctgaactttcaaagcttgctattaaatcatttagaatgtttacatttactaaggtgtgctgggtcatgtaaaatattagacactaatattttcatagaaattaggctggagaaagaaggaagaaatggttttcttaaatacctacaaaaaagttactgtggtatctatgagttatcatcttagctgtgttaaaaatgaatttttactatggcagatatggtatggatcgtaaaattttaagcactaaaaattttttcataacctttcataataaagtttaataataggtttattaactgaatttcattagttttttaaaagtgtttttggtttgtgtatatatacatatacaaatacaacatttacaataaataaaatacttgaaattctcttttgtgtctcctagtagcttcctactcaactatttataatctcattaattaaaaagttataattttagataaaaattctagtcaaatttttacagatattatctcactaattttcagacttttgccaaagtgtgcacaatgg

SEQ ID NO: 104693 - DNA, 2387 bp, Homo sapiens
  Payload ID: 555
  Gene Symbol: ADAM9
  Gene Name: ADAM metallopeptidase domain 9
  ENST ID: ENST00000481513
  CDS Start-End: 79-465
cggcagggttggaaaatgatggaagaggcggaggtggaggcgaccgagtgctgagaggaacctgcggaatcggccgagatggggtctggcgcgcgctttccctcggggacccttcgtgtccggtggttgctgttgcttggcctggtgggcccagtcctcggtgcggcgcggccaggctttcaacagacctcacatctttcttcttatgaaattataactccttggagattaactagagaaagaagagaagcccctaggccctattcaaaacaagtatcttatgttattcaggctgaaggaaaagagcatattattcacttggaaaggaacaaagaccttttgcctgaagattttgtggtttatacttacaacaaggaagggactttaatcactgaccatcccaatatacaggtaatgtatttttctcttgatcccatagcaaattttaaaacaattataatttaaaaatgagttctgtataggcactcaggactgttacattgcacagccccacagggtacctttaacattataacatatgggttatcttgggaaaagtgggtgcatttctatagactaagctgtaccttacagctctccaggtactcagtagttaaggttttttttttaaagactaggaaaataaatcttctatttaatggtaatccttactgatgagaaaatttgatatgttttgaaaataggagtttctgatttttttgttgaaagttaatatctctaaaagtgcacttattaaaacatttaatttgtcagtgatatttagtaaagaaaaacactcatttgatgttatgtgttctaatgttctaaattttttctgaaaataattgtttcctaaaagaggtgtggtcctctctgcatcagagaacagagtactcctggggacagagctggccagaatacccaaaataattggcagatgtcaaatttggctttctgtgtttattactagagcataaacatttctagttttgtttgagtgttttacagtcctttttggcagttaggtattatacctttttttcttttgcaatggttttcatgagaaatctttattcccattacatgtgtatgttttatttttcttctgaactttgtaatactttgctatgttgaattgtttctgttggtagcgcacttttgcagcattcttcaaataggaggcaaaaaaatctttagattaattattagtacttacaaaaaccaaggaaatgctgacttaggcctatcttctggtccactatctgatttctttatcttagtgtgttgttggtccattgtttaatagaaaattagtagaggagtttgaatttaccttacagcataaaccagatagaaaataacgcattcatccagtcatgcatccaatgattaccaaggcagaaggccaaacaccacataatttgtgtcacttgacaaaagcagtaatgttaaaaggcatttttttcctcatagaggtttcttggcatactttcttcagacatacactgtttgggcttgagttttgactcattatttgctgatgaagctactttaatctgtttgtgccttggtatcttcgctttaaaatgtaataatagttaccactttatggatatactgggaaacttaactgagttaatacttacaagatgcttagaacagtctgacaatttttaactcaacgaatgttattatttgttgctattattgacagcgtatgttcttaaaactgccaaaaattgatttaattatatagaaacttatgtaactattatcttatataatacttaagtatcataagtatgatagagttatgcttttctgggtgtttgaaaaatgtcaactaagacagatggtgtctcacttatttcttggttatttaatattgttcagttagatgaaagtgtgattgtagatttgaaatacaaaataaaacttggatactgtgatttttttaacatggccagactgtcatgtattataatgacatatacttttgtccataaaatgaaattaagtttcactgaaaaatttacatactttcccctggggattctattgcttcagattaaagtttataaagtatcattagtgtcttccacagggtcattttacacaaacacagttttagtgagatgtcaactggcttttgttggttgttggattgactgtgatttaaaatgttaaagatgatataatgcatcttgttctgcttctaggctgaaaggtcactgaggcagagctgtttgtaccttgtatcccctggaattttgcctaaacatttgtgtactcatagggtggtaggagatagtccgcagatggtctaaagaatgccatgtgatactgtgagatgccaataatataaataaaactttgttattattaaa

SEQ ID NO: 104694 - DNA, 3793 bp, Homo sapiens
  Payload ID: 555
  Gene Symbol: ADAM9
  Gene Name: ADAM metallopeptidase domain 9
  ENST ID: ENST00000481873
  CDS Start-End: 39-2177
cgaccgagtgctgagaggaacctgcggaatcggccgagatggggtctggcgcgcgctttccctcggggacccttcgtgtccggtggttgctgttgcttggcctggtgggcccagtcctcggtgcggcgcggccaggctttcaacagacctcacatctttcttcttatgaaattataactccttggagattaactagagaaagaagagaagcccctaggccctattcaaaacaagtatcttatgttattcaggctgaaggaaaagagcatattattcacttggaaaggaacaaagaccttttgcctgaagattttgtggtttatacttacaacaaggaagggactttaatcactgaccatcccaatatacagaatcattgtcattatcggggctatgtggagggagttcataattcatccattgctcttagcgactgttttggactcagaggattgctgcatttagagaatgcgagttatgggattgaacccctgcagaacagctctcattttgagcacatcatttatcgaatggatgatgtctacaaagagcctctgaaatgtggagtttccaacaaggatatagagaaagaaactgcaaaggatgaagaggaagagcctcccagcatgactcagctacttcgaagaagaagagctgtcttgccacagacccggtatgtggagctgttcattgtcgtagacaaggaaaggtatgacatgatgggaagaaatcagactgctgtgagagaagagatgattctcctggcaaactacttggatagtatgtatattatgttaaatattcgaattgtgctagttggactggagatttggaccaatggaaacctgatcaacatagttgggggtgctggtgatgtgctggggaacttcgtgcagtggcgggaaaagtttcttatcacacgtcggagacatgacagtgcacagctagttctaaagaaaggttttggtggaactgcaggaatggcatttgtgggaacagtgtgttcaaggagccacgcaggcgggattaatgtgtttggacaaatcactgtggagacatttgcttccattgttgctcatgaattgggtcataatcttggaatgaatcacgatgatgggagagattgttcctgtggagcaaagagctgcatcatgaattcaggagcatcgggttccagaaactttagcagttgcagtgcagaggactttgagaagttaactttaaataaaggaggaaactgccttcttaatattccaaagcctgatgaagcctatagtgctccctcctgtggtaataagttggtggacgctggggaagagtgtgactgtggtactccaaaggaatgtgaattggacccttgctgcgaaggaagtacctgtaagcttaaatcatttgctgagtgtgcatatggtgactgttgtaaagactgtcggttccttccaggaggtactttatgccgaggaaaaaccagtgagtgtgatgttccagagtactgcaatggttcttctcagttctgtcagccagatgtttttattcagaatggatatccttgccagaataacaaagcctattgctacaacggcatgtgccagtattatgatgctcaatgtcaagtcatctttggctcaaaagccaaggctgcccccaaagattgtttcattgaagtgaattctaaaggtgacagatttggcaattgtggtttctctggcaatgaatacaagaagtgtgccactgggaatgctttgtgtggaaagcttcagtgtgagaatgtacaagagatacctgtatttggaattgtgcctgctattattcaaacgcctagtcgaggcaccaaatgttggggtgtggatttccagctaggatcagatgttccagatcctgggatggttaacgaaggcacaaaatgtggtgctggaaagatctgtagaaacttccagtgtgtagatgcttctgttctgaattatgactgtgatgttcagaaaaagtgtcatggacatggggtatgtaatagcaataagaattgtcactgtgaaaatggctgggctcccccaaattgtgagactaaaggatacggaggaagtgtggacagtggacctacatacaatggtcagatggcaaaaatcaagcaaacccttctagacagccggggagtgttcctcgacatgtttctccagtgacacctcccagagaagttcctatatatgcaaacagatttgcagtaccaacctatgcagccaagcaacctcagcagttcccatcaaggccacctccaccacaaccgaaagtatcatctcagggaaacttaattcctgcccgtcctgctcctgcacctcctttatatagttccctcacttgatttttttaaccttctttttgcaaatgtcttcagggaactgagctaatactttttttttttcttgatgttttcttgaaaagcctttctgttgcaactatgaatgaaaacaaaacaccacaaaacagacttcactaacacagaaaaacagaaactgagtgtgagagttgtgaaatacaaggaaatgcagtaaagccagggaatttacaataacatttccgtttccatcattgaataagtcttattcagtcatcggtgaggttaatgcactaatcatggattttttgaacatgttattgcagtgattctcaaattaactgtattggtgtaagagttttgtcattaagtgtttaagtgttattctgaattttctaccttagttatcattaatgtagttcctcattgaacatgtgataatctaatacctgtgaaaactgactaatcagctgccaataatatctaatatttttcatcatgcacgaattaataatcatcatactctagaatcttgtctgtcactcactacatgaataagcaaatattgtcttcaaaagaatgcacaagaaccacaattaagatgtcatattattttgaaagtacaaaatatactaaaagagtgtgtgtgtattcacgcagttactcgcttccatttttatgacctttcaactataggtaataactcttagagaaattaatttaatattagaatttctattatgaatcatgtgaaagcatgacattcgttcacaatagcactattttaaataaattataagctttaaggtacgaagtatttaatagatctaatcaaatatgttgattcatggctataataaagcaggagcaattataaaatcttcaatcaattgaacttttacaaaaccacttgagaatttcatgagcactttaaaatctgaactttcaaagcttgctattaaatcatttagaatgtttacatttactaaggtgtgctgggtcatgtaaaatattagacactaatattttcatagaaattaggctggagaaagaaggaagaaatggttttcttaaatacctacaaaaaagttactgtggtatctatgagttatcatcttagctgtgttaaaaatgaatttttactatggcagatatggtatggatcgtaaaattttaagcactaaaaattttttcataacctttcataataaagtttaataataggtttattaactgaatttcattagttttttaaaagtgtttttggtttgtgtatatatacatatacaaatacaacatttacaataaataaaatacttgaaattctcttttgtgtctcctagtagcttcctactcaactatttataatctcattaattaaaaagttataattttagataaaaattctagtcaaatttttacagatattatctcactaattttcagacttttgccaaagtgtgc

SEQ ID NO: 104695 - DNA, 3755 bp, Homo sapiens
  Payload ID: 555
  Gene Symbol: ADAM9
  Gene Name: ADAM metallopeptidase domain 9
  ENST ID: ENST00000468065
  CDS Start-End: 39-1925
cgaccgagtgctgagaggaacctgcggaatcggccgagatggggtctggcgcgcgctttccctcggggacccttcgtgtccggtggttgctgttgcttggcctggtgggcccagtcctcggtgcggcgcggccaggctttcaacagacctcacatctttcttcttatgaaattataactccttggagattaactagagaaagaagagaagcccctaggccctattcaaaacaagtatcttatgttattcaggctgaaggaaaagagcatattattcacttggaaaggaacaaagaccttttgcctgaagattttgtggtttatacttacaacaaggaagggactttaatcactgaccatcccaatatacagaatcattgtcattatcggggctatgtggagggagttcataattcatccattgctcttagcgactgttttggactcagaggattgctgcatttagagaatgcgagttatgggattgaacccctgcagaacagctctcattttgagcacatcatttatcgaatggatgatgtctacaaagagcctctgaaatgtggagtttccaacaaggatatagagaaagaaactgcaaaggatgaagaggaagagcctcccagcatgactcagctacttcgaagaagaagagctgtcttgccacagacccggtatgtggagctgttcattgtcgtagacaaggaaaggtatgacatgatgggaagaaatcagactgctgtgagagaagagatgattctcctggcaaactacttggatagtatgtatattatgttaaatattcgaattgtgctagttggactggagatttggaccaatggaaacctgatcaacatagttgggggtgctggtgatgtgctggggaacttcgtgcagtggcgggaaaagtttcttatcacacgtcggagacatgacagtgcacagctagttctaaagaaaggttttggtggaactgcaggaatggcatttgtgggaacagtgtgttcaaggagccacgcaggcgggattaatgtgtttggacaaatcactgtggagacatttgcttccattgttgctcatgaattgggtcataatcttggaatgaatcacgatgatgggagagattgttcctgtggagcaaagagctgcatcatgaattcaggagcatcgggttccagaaactttagcagttgcagtgcagaggactttgagaagttaactttaaataaaggaggaaactgccttcttaatattccaaagcctgatgaagcctatagtgctccctcctgtggtaataagttggtggacgctggggaagagtgtgactgtggtactccaaaggaatgtgaattggacccttgctgcgaaggaagtacctgtaagcttaaatcatttgctgagtgtgcatatggtgactgttgtaaagactgtcggttccttccaggaggtactttatgccgaggaaaaaccagtgagtgtgatgttccagagtactgcaatggttcttctcagttctgtcagccagatgtttttattcagaatggatatccttgccagaataacaaagcctattgctacaacggcatgtgccagtattatgatgctcaatgtcaagtcatctttggctcaaaagccaaggctgcccccaaagattgtttcattgaagtgaattctaaaggtgacagatttggcaattgtggtttctctggcaatgaatacaagaagtgtgccactgggaatgctttgtgtggaaagcttcagtgtgagaatgtacaagagatacctgtatttggaattgtgcctgctattattcaaacgcctagtcgaggcaccaaatgttggggtgtggatttccagctaggatcagatgttccagatcctgggatggttaacgaaggcacaaaatgtggtgctggaaagaaatgaatactgcattgagggacggacttctggtcttcttcttcctaattgttccccttattgtctgtgctatttttatcttcatcaagagggatcaactgtggagaagctacttcagaaagaagagatcacaaacatatgagtcagatggcaaaaatcaagcaaacccttctagacagccggggagtgttcctcgacatgtttctccagtgacacctcccagagaagttcctatatatgcaaacagatttgcagtaccaacctatgcagccaagcaacctcagcagttcccatcaaggccacctccaccacaaccgaaagtatcatctcagggaaacttaattcctgcccgtcctgctcctgcacctcctttatatagttccctcacttgatttttttaaccttctttttgcaaatgtcttcagggaactgagctaatactttttttttttcttgatgttttcttgaaaagcctttctgttgcaactatgaatgaaaacaaaacaccacaaaacagacttcactaacacagaaaaacagaaactgagtgtgagagttgtgaaatacaaggaaatgcagtaaagccagggaatttacaataacatttccgtttccatcattgaataagtcttattcagtcatcggtgaggttaatgcactaatcatggattttttgaacatgttattgcagtgattctcaaattaactgtattggtgtaagagttttgtcattaagtgtttaagtgttattctgaattttctaccttagttatcattaatgtagttcctcattgaacatgtgataatctaatacctgtgaaaactgactaatcagctgccaataatatctaatatttttcatcatgcacgaattaataatcatcatactctagaatcttgtctgtcactcactacatgaataagcaaatattgtcttcaaaagaatgcacaagaaccacaattaagatgtcatattattttgaaagtacaaaatatactaaaagagtgtgtgtgtattcacgcagttactcgcttccatttttatgacctttcaactataggtaataactcttagagaaattaatttaatattagaatttctattatgaatcatgtgaaagcatgacattcgttcacaatagcactattttaaataaattataagctttaaggtacgaagtatttaatagatctaatcaaatatgttgattcatggctataataaagcaggagcaattataaaatcttcaatcaattgaacttttacaaaaccacttgagaatttcatgagcactttaaaatctgaactttcaaagcttgctattaaatcatttagaatgtttacatttactaaggtgtgctgggtcatgtaaaatattagacactaatattttcatagaaattaggctggagaaagaaggaagaaatggttttcttaaatacctacaaaaaagttactgtggtatctatgagttatcatcttagctgtgttaaaaatgaatttttactatggcagatatggtatggatcgtaaaattttaagcactaaaaattttttcataacctttcataataaagtttaataataggtttattaactgaatttcattagttttttaaaagtgtttttggtttgtgtatatatacatatacaaatacaacatttacaataaataaaatacttgaaattctcttttgtgtctcctagtagcttcctactcaactatttataatctcattaattaaaaagttataattttagataaaaattctagtcaaatttttacagatattatctcactaattttcagacttttgccaaagtgtgcacaatgg

SEQ ID NO: 104696 - DNA, 3839 bp, Homo sapiens
  Payload ID: 555
  Gene Symbol: ADAM9
  Gene Name: ADAM metallopeptidase domain 9
  Uniprot ID: Q13443
  ENST ID: ENST00000487273
  CDS Start-End: 79-2538
cggcagggttggaaaatgatggaagaggcggaggtggaggcgaccgagtgctgagaggaacctgcggaatcggccgagatggggtctggcgcgcgctttccctcggggacccttcgtgtccggtggttgctgttgcttggcctggtgggcccagtcctcggtgcggcgcggccaggctttcaacagacctcacatctttcttcttatgaaattataactccttggagattaactagagaaagaagagaagcccctaggccctattcaaaacaagtatcttatgttattcaggctgaaggaaaagagcatattattcacttggaaaggaacaaagaccttttgcctgaagattttgtggtttatacttacaacaaggaagggactttaatcactgaccatcccaatatacagaatcattgtcattatcggggctatgtggagggagttcataattcatccattgctcttagcgactgttttggactcagaggattgctgcatttagagaatgcgagttatgggattgaacccctgcagaacagctctcattttgagcacatcatttatcgaatggatgatgtctacaaagagcctctgaaatgtggagtttccaacaaggatatagagaaagaaactgcaaaggatgaagaggaagagcctcccagcatgactcagctacttcgaagaagaagagctgtcttgccacagacccggtatgtggagctgttcattgtcgtagacaaggaaaggtatgacatgatgggaagaaatcagactgctgtgagagaagagatgattctcctggcaaactacttggatagtatgtatattatgttaaatattcgaattgtgctagttggactggagatttggaccaatggaaacctgatcaacatagttgggggtgctggtgatgtgctggggaacttcgtgcagtggcgggaaaagtttcttatcacacgtcggagacatgacagtgcacagctagttctaaagaaaggttttggtggaactgcaggaatggcatttgtgggaacagtgtgttcaaggagccacgcaggcgggattaatgtgtttggacaaatcactgtggagacatttgcttccattgttgctcatgaattgggtcataatcttggaatgaatcacgatgatgggagagattgttcctgtggagcaaagagctgcatcatgaattcaggagcatcgggttccagaaactttagcagttgcagtgcagaggactttgagaagttaactttaaataaaggaggaaactgccttcttaatattccaaagcctgatgaagcctatagtgctccctcctgtggtaataagttggtggacgctggggaagagtgtgactgtggtactccaaaggaatgtgaattggacccttgctgcgaaggaagtacctgtaagcttaaatcatttgctgagtgtgcatatggtgactgttgtaaagactgtcggttccttccaggaggtactttatgccgaggaaaaaccagtgagtgtgatgttccagagtactgcaatggttcttctcagttctgtcagccagatgtttttattcagaatggatatccttgccagaataacaaagcctattgctacaacggcatgtgccagtattatgatgctcaatgtcaagtcatctttggctcaaaagccaaggctgcccccaaagattgtttcattgaagtgaattctaaaggtgacagatttggcaattgtggtttctctggcaatgaatacaagaagtgtgccactgggaatgctttgtgtggaaagcttcagtgtgagaatgtacaagagatacctgtatttggaattgtgcctgctattattcaaacgcctagtcgaggcaccaaatgttggggtgtggatttccagctaggatcagatgttccagatcctgggatggttaacgaaggcacaaaatgtggtgctggaaagatctgtagaaacttccagtgtgtagatgcttctgttctgaattatgactgtgatgttcagaaaaagtgtcatggacatggggtatgtaatagcaataagaattgtcactgtgaaaatggctgggctcccccaaattgtgagactaaaggatacggaggaagtgtggacagtggacctacatacaatgaaatgaatactgcattgagggacggacttctggtcttcttcttcctaattgttccccttattgtctgtgctatttttatcttcatcaagagggatcaactgtggagaagctacttcagaaagaagagatcacaaacatatgagtcagatggcaaaaatcaagcaaacccttctagacagccggggagtgttcctcgacatgtttctccagtgacacctcccagagaagttcctatatatgcaaacagatttgcagtaccaacctatgcagccaagcaacctcagcagttcccatcaaggccacctccaccacaaccgaaagtatcatctcagggaaacttaattcctgcccgtcctgctcctgcacctcctttatatagttccctcacttgatttttttaaccttctttttgcaaatgtcttcagggaactgagctaatactttttttttttcttgatgttttcttgaaaagcctttctgttgcaactatgaatgaaaacaaaacaccacaaaacagacttcactaacacagaaaaacagaaactgagtgtgagagttgtgaaatacaaggaaatgcagtaaagccagggaatttacaataacatttccgtttccatcattgaataagtcttattcagtcatcggtgaggttaatgcactaatcatggattttttgaacatgttattgcagtgattctcaaattaactgtattggtgtaagagttttgtcattaagtgtttaagtgttattctgaattttctaccttagttatcattaatgtagttcctcattgaacatgtgataatctaatacctgtgaaaactgactaatcagctgccaataatatctaatatttttcatcatgcacgaattaataatcatcatactctagaatcttgtctgtcactcactacatgaataagcaaatattgtcttcaaaagaatgcacaagaaccacaattaagatgtcatattattttgaaagtacaaaatatactaaaagagtgtgtgtgtattcacgcagttactcgcttccatttttatgacctttcaactataggtaataactcttagagaaattaatttaatattagaatttctattatgaatcatgtgaaagcatgacattcgttcacaatagcactattttaaataaattataagctttaaggtacgaagtatttaatagatctaatcaaatatgttgattcatggctataataaagcaggagcaattataaaatcttcaatcaattgaacttttacaaaaccacttgagaatttcatgagcactttaaaatctgaactttcaaagcttgctattaaatcatttagaatgtttacatttactaaggtgtgctgggtcatgtaaaatattagacactaatattttcatagaaattaggctggagaaagaaggaagaaatggttttcttaaatacctacaaaaaagttactgtggtatctatgagttatcatcttagctgtgttaaaaatgaatttttactatggcagatatggtatggatcgtaaaattttaagcactaaaaattttttcataacctttcataataaagtttaataataggtttattaactgaatttcattagttttttaaaagtgtttttggtttgtgtatatatacatatacaaatacaacatttacaataaataaaatacttgaaattctc

SEQ ID NO: 104697 - DNA, 2053 bp, Homo sapiens
  Payload ID: 555
  Gene Symbol: ADAM9
  Gene Name: ADAM metallopeptidase domain 9
  ENST ID: ENST00000466936
  CDS Start-End: 196-639
taggcgatgtcgggagcgagctcggaccgagggctcagttgcgtcagtgccgcgcgcgtgctcgtcgggcgcgcgtgctcgtcgggcgcgcgcgcttcccggccagacttggggccccggcagggttggaaaatgatggaagaggcggaggtggaggcgaccgagtgctgagaggaacctgcggaatcggccgagatggggtctggcgcgcgctttccctcggggacccttcgtgtccggtggttgctgttgcttggcctggtgggcccagtcctcggtgcggcgcggccaggctttcaacagacctcacatctttcttcttatgaaattataactccttggagattaactagagaaagaagagaagcccctaggccctattcaaaacaagtatcttatgttattcaggctgaaggaaaagagcatattattcacttggaaaggaacaaagaccttttgcctgaagattttgtggtttatacttacaacaaggaagggactttaatcactgaccatcccaatatacagaggtgtggtcctctctgcatcagagaacagagtactcctggggacagagctggccagaatacccaaaataattggcagatgtcaaatttggctttctgtgtttattactagagcataaacatttctagttttgtttgagtgttttacagtcctttttggcagttaggtattatacctttttttcttttgcaatggttttcatgagaaatctttattcccattacatgtgtatgttttatttttcttctgaactttgtaatactttgctatgttgaattgtttctgttggtagcgcacttttgcagcattcttcaaataggaggcaaaaaaatctttagattaattattagtacttacaaaaaccaaggaaatgctgacttaggcctatcttctggtccactatctgatttctttatcttagtgtgttgttggtccattgtttaatagaaaattagtagaggagtttgaatttaccttacagcataaaccagatagaaaataacgcattcatccagtcatgcatccaatgattaccaaggcagaaggccaaacaccacataatttgtgtcacttgacaaaagcagtaatgttaaaaggcatttttttcctcatagaggtttcttggcatactttcttcagacatacactgtttgggcttgagttttgactcattatttgctgatgaagctactttaatctgtttgtgccttggtatcttcgctttaaaatgtaataatagttaccactttatggatatactgggaaacttaactgagttaatacttacaagatgcttagaacagtctgacaatttttaactcaacgaatgttattatttgttgctattattgacagcgtatgttcttaaaactgccaaaaattgatttaattatatagaaacttatgtaactattatcttatataatacttaagtatcataagtatgatagagttatgcttttctgggtgtttgaaaaatgtcaactaagacagatggtgtctcacttatttcttggttatttaatattgttcagttagatgaaagtgtgattgtagatttgaaatacaaaataaaacttggatactgtgatttttttaacatggccagactgtcatgtattataatgacatatacttttgtccataaaatgaaattaagtttcactgaaaaatttacatactttcccctggggattctattgcttcagattaaagtttataaagtatcattagtgtcttccacagggtcattttacacaaacacagttttagtgagatgtcaactggcttttgttggttgttggattgactgtgatttaaaatgttaaagatgatataatgcatcttgttctgcttctaggctgaaaggtcactgaggcagagctgtttgtaccttgtatcccctggaattttgcctaaacatttgtgtactcatagggtggtaggagatagtccgcagatggtctaaagaatgccatgtgatactgtgagatgccaataatataaataaaactttgttattatt

SEQ ID NO: 104698 - DNA, 1463 bp, Homo sapiens
  Payload ID: 555
  Gene Symbol: ADAM9
  Gene Name: ADAM metallopeptidase domain 9
  ENST ID: ENST00000631491
  CDS Start-End: 1-162
cctatatatgcaaacagatttgcagtaccaacctatgcagccaagcaacctcagcagttcccatcaaggccacctccaccacaaccgaaagtatcatctcagggaaacttaattcctgcccgtcctgctcctgcacctcctttatatagttccctcacttgatttttttaaccttctttttgcaaatgtcttcagggaactgagctaatactttttttttttcttgatgttttcttgaaaagcctttctgttgcaactatgaatgaaaacaaaacaccacaaaacagacttcactaacacagaaaaacagaaactgagtgtgagagttgtgaaatacaaggaaatgcagtaaagccagggaatttacaataacatttccgtttccatcattgaataagtcttattcagtcatcggtgaggttaatgcactaatcatggattttttgaacatgttattgcagtgattctcaaattaactgtattggtgtaagagttttgtcattaagtgtttaagtgttattctgaattttctaccttagttatcattaatgtagttcctcattgaacatgtgataatctaatacctgtgaaaactgactaatcagctgccaataatatctaatatttttcatcatgcacgaattaataatcatcatactctagaatcttgtctgtcactcactacatgaataagcaaatattgtcttcaaaagaatgcacaagaaccacaattaagatgtcatattattttgaaagtacaaaatatactaaaagagtgtgtgtgtattcacgcagttactcgcttccatttttatgacctttcaactataggtaataactcttagagaaattaatttaatattagaatttctattatgaatcatgtgaaagcatgacattcgttcacaatagcactattttaaataaattataagctttaaggtacgaagtatttaatagatctaatcaaatatgttgattcatggctataataaagcaggagcaattataaaatcttcaatcaattgaacttttacaaaaccacttgagaatttcatgagcactttaaaatctgaactttcaaagcttgctattaaatcatttagaatgtttacatttactaaggtgtgctgggtcatgtaaaatattagacactaatattttcatagaaattaggctggagaaagaaggaagaaatggttttcttaaatacctacaaaaaagttactgtggtatctatgagttatcatcttagctgtgttaaaaatgaatttttactatggcagatatggtatggatcgtaaaattttaagcactaaaaattttttcataacctttcataataaagtttaataataggtttattaactgaatttcattagttttttaaaagtgtttttggtttgtgtatatatacatatacaaatacaacatttacaataaataaaatacttgaaattctc

SEQ ID NO: 104699 - DNA, 3022 bp, Homo sapiens
  Payload ID: 556
  Gene Symbol: ADAMTS13
  Gene Name: ADAM metallopeptidase with thrombospondin type 1 motif 13
  ENST ID: ENST00000626079
  CDS Start-End: 121-1155
acactgcctaatcgtcccgcccagtagtgagcaggcctgtcccattccatactgaccagattcccagtcaccaaggccccctctcactccgctccactcctcgggctggctctcctgaggatgcaccagcgtcacccccgggcaagatgccctcccctctgtgtggccggaatccttgcctgtggctttctcctgggctgctggggaccctcccatttccagcagagttgtcttcaggctttggagccacaggccgtgtcttcttacttgagccctggtgctcccttaaaaggccgccctccttcccctggcttccagaggcagaggcagaggcagaggcgggctgcaggcggcatcctacacctggagctgctggtggccgtgggccccgatgtcttccaggctcaccaggaggacacagagcgctatgtgctcaccaacctcaacatcggggcagaactgcttcgggacccgtccctgggggctcagtttcgggtgcacctggtgaagatggtcattctgacagagcctgagggtgctccaaatatcacagccaacctcacctcgtccctgctgagcgtctgtgggtggagccagaccatcaaccctgaggacgacacggatcctggccatgctgacctggtcctctatatcactaggtttgacctggagttgcctgatggtaaccggcaggtgcggggcgtcacccagctgggcggtgcctgctccccaacctggagctgcctcattaccgaggacactggcttcgacctgggagtcaccattgcccatgagattgggcacagcttcggcctggagcacgacggcgcgcccggcagcggctgcggccccagcggacacgtgatggcttcggacggcgccgcgccccgcgccggcctcgcctggtccccctgcagccgccggcagctgctgagcctgctcagacccgtccctccgtcgccgctccctctgctggccacccacctctgcgccggcaggagccttagtcttggtcccagccaagagccggctcctggtggggggcgcgggccgagaactcctgttcccactcacaaaaggccacgcttccaaacgcttccatcctcgtgcccactcctccgtcccgcctcctcccggtgtacaccccgggactgagccgggcctgagccgggccttgtcgcagcgcaggacgggcgcgctgcgtgtgggacccgccgcggcctcaacccgggtccgcggggcacccgccggatgcgcagcctggcctctactacagcgccaacgagcagtgccgcgtggccttcggccccaaggctgtcgcctgcaccttcgccagggagcacctggtgagtctgccggcggtggcctgggattggctgtgaggtccctccgcatcacccagctcacgtcccccaaaacgtgcatggatatgtgccaggccctctcctgccacacagacccgctggaccaaagcagctgcagccgcctcctcgttcctctcctggatgggacagaatgtggcgtggagaagtggtgctccaagggtcgctgccgctccctggtggagctgacccccatagcagcagtgcatgggcgctggtctagctggggtccccgaagtccttgctcccgctcctgcggaggaggtgtggtcaccaggaggcggcagtgcaacaaccccagacctgcctttggggggcgtgcatgtgttggtgctgacctccaggccgagatgtgcaacactcaggcctgcgagaagacccagctggagttcatgtcgcaacagtgcgccaggaccgacggccagccgctgcgctcctcccctggcggcgcctccttctaccactggggtgctgctgtaccacacagccaaggggatgctctgtgcagacacatgtgccgggccattggcgagagcttcatcatgaagcgtggagacagcttcctcgatgggacccggtgtatgccaagtggcccccgggaggacgggaccctgagcctgtgtgtgtcgggcagctgcaggacatttggctgtgatggtaggatggactcccagcaggtatgggacaggtgccaggtgtgtggtggggacaacagcacgtgcagcccacggaagggctctttcacagctggcagagcgagagaatatgtcacgtttctgacagttacccccaacctgaccagtgtctacattgccaaccacaggcctctcttcacacacttggcggtgaggatcggagggcgctatgtcgtggctgggaagatgagcatctcccctaacaccacctacccctccctcctggaggatggtcgtgtcgagtacagagtggccctcaccgaggaccggctgccccgcctggaggagatccgcatctggggacccctccaggaagatgctgacatccaggtgggaggtgtcagagcccagctcatgcacatcagctggtggagcaggcctggccttggagaacgagacctgtgtgccaggggcagatggcctggaggctccagtgactgaggggcctggctccgtagatgagaagctgcctgcccctgagccctgtgtcgggatgtcatgtcctccaggctggggccatctggatgccacctctgcaggggagaaggctccctccccatggggcagcatcaggacgggggctcaagctgcacacgtgtggacccctgcggcagggtcgtgctccgtctcctgcgggcgaggtctgatggagctgcgtttcctgtgcatggactctgccctcagggtgcctgtccaggaagagctgtgtggcctggcaagcaagcctgggagccggcgggaggtctgccaggctgtcccgtgccctgctcggtggcagtacaagctggcggcctgcagcgtgagctgtgggagaggggtcgtgcggaggatcctgtattgtgcccgggcccatggggaggacgatggtgaggagatcctgttggacacccagtgccaggggctgcctcgcccggaaccccaggaggcctgcagcctggagccctg

SEQ ID NO: 104700 - DNA, 4349 bp, Homo sapiens
  Payload ID: 556
  Gene Symbol: ADAMTS13
  Gene Name: ADAM metallopeptidase with thrombospondin type 1 motif 13
  ENST ID: ENST00000630465
  CDS Start-End: 121-4143
acactgcctaatcgtcccgcccagtagtgagcaggcctgtcccattccatactgaccagattcccagtcaccaaggccccctctcactccgctccactcctcgggctggctctcctgaggatgcaccagcgtcacccccgggcaagatgccctcccctctgtgtggccggaatccttgcctgtggctttctcctgggctgctggggaccctcccatttccagcagagttgtcttcaggctttggagccacaggccgtgtcttcttacttgagccctggtgctcccttaaaaggccgccctccttcccctggcttccagaggcagaggcagaggcagaggcgggctgcaggcggcatcctacacctggagctgctggtggccgtgggccccgatgtcttccaggctcaccaggaggacacagagcgctatgtgctcaccaacctcaacatcggggcagaactgcttcgggacccgtccctgggggctcagtttcgggtgcacctggtgaagatggtcattctgacagagcctgagggtgctccaaatatcacagccaacctcacctcgtccctgctgagcgtctgtgggtggagccagaccatcaaccctgaggacgacacggatcctggccatgctgacctggtcctctatatcactaggtttgacctggagttgcctgatggtaaccggcaggtgcggggcgtcacccagctgggcggtgcctgctccccaacctggagctgcctcattaccgaggacactggcttcgacctgggagtcaccattgcccatgagattgggcacagcttcggcctggagcacgacggcgcgcccggcagcggctgcggccccagcggacacgtgatggcttcggacggcgccgcgccccgcgccggcctcgcctggtccccctgcagccgccggcagctgctgagcctgctcagcgccaacgagcagtgccgcgtggccttcggccccaaggctgtcgcctgcaccttcgccagggagcacctggatatgtgccaggccctctcctgccacacagacccgctggaccaaagcagctgcagccgcctcctcgttcctctcctggatgggacagaatgtggcgtggagaagtggtgctccaagggtcgctgccgctccctggtggagctgacccccatagcagcagtgcatgggcgctggtctagctggggtccccgaagtccttgctcccgctcctgcggaggaggtgtggtcaccaggaggcggcagtgcaacaaccccagacctgcctttggggggcgtgcatgtgttggtgctgacctccaggccgagatgtgcaacactcaggcctgcgagaagacccagctggagttcatgtcgcaacagtgcgccaggaccgacggccagccgctgcgctcctcccctggcggcgcctccttctaccactggggtgctgctgtaccacacagccaaggggatgctctgtgcagacacatgtgccgggccattggcgagagcttcatcatgaagcgtggagacagcttcctcgatgggacccggtgtatgccaagtggcccccgggaggacgggaccctgagcctgtgtgtgtcgggcagctgcaggacatttggctgtgatggtaggatggactcccagcaggtatgggacaggtgccaggtgtgtggtggggacaacagcacgtgcagcccacggaagggctctttcacagctggcagagcgagagaatatgtcacgtttctgacagttacccccaacctgaccagtgtctacattgccaaccacaggcctctcttcacacacttggcggtgaggatcggagggcgctatgtcgtggctgggaagatgagcatctcccctaacaccacctacccctccctcctggaggatggtcgtgtcgagtacagagtggccctcaccgaggaccggctgccccgcctggaggagatccgcatctggggacccctccaggaagatgctgacatccaggtttacaggcggtatggcgaggagtatggcaacctcacccgcccagacatcaccttcacctacttccagcctaagccacggcaggcctgggtgtgggccgctgtgcgtgggccctgctcggtgagctgtggggcagggctgcgctgggtaaactacagctgcctggaccaggccaggaaggagttggtggagactgtccagtgccaagggagccagcagccaccagcgtggccagaggcctgcgtgctcgaaccctgccctccctactgggcggtgggagacttcggcccatgcagcgcctcctgtgggggtggcctgcgggagcggccagtgcgctgcgtggaggcccagggcagcctcctgaagacattgcccccagcccggtgcagagcaggggcccagcagccagctgtggcgctggaaacctgcaacccccagccctgccctgccaggtgggaggtgtcagagcccagctcatgcacatcagctggtggagcaggcctggccttggagaacgagacctgtgtgccaggggcagatggcctggaggctccagtgactgaggggcctggctccgtagatgagaagctgcctgcccctgagccctgtgtcgggatgtcatgtcctccaggctggggccatctggatgccacctctgcaggggagaaggctccctccccatggggcagcatcaggacgggggctcaagctgcacacgtgtggacccctgcggcagggtcgtgctccgtctcctgcgggcgaggtctgatggagctgcgtttcctgtgcatggactctgccctcagggtgcctgtccaggaagagctgtgtggcctggcaagcaagcctgggagccggcgggaggtctgccaggctgtcccgtgccctgctcggtggcagtacaagctggcggcctgcagcgtgagctgtgggagaggggtcgtgcggaggatcctgtattgtgcccgggcccatggggaggacgatggtgaggagatcctgttggacacccagtgccaggggctgcctcgcccggaaccccaggaggcctgcagcctggagccctgcccacctaggtggaaagtcatgtcccttggcccatgttcggccagctgtggccttggcactgctagacgctcggtggcctgtgtgcagctcgaccaaggccaggacgtggaggtggacgaggcggcctgtgcggcgctggtgcggcccgaggccagtgtcccctgtctcattgccgactgcacctaccgctggcatgttggcacctggatggagtgctctgtttcctgtggggatggcatccagcgccggcgtgacacctgcctcggaccccaggcccaggcgcctgtgccagctgatttctgccagcacttgcccaagccggtgactgtgcgtggctgctgggctgggccctgtgtgggacagggtgcctgtggcaggcagcaccttgagccaacaggaaccattgacatgcgaggcccagggcaggcagactgtgcagtggccattgggcggcccctcggggaggtggtgaccctccgcgtccttgagagttctctcaactgcagtgcgggggacatgttgctgctttggggccggctcacctggaggaagatgtgcaggaagctgttggacatgactttcagctccaagaccaacacgctggtggtgaggcagcgctgcgggcggccaggaggtggggtgctgctgcggtatgggagccagcttgctcctgaaaccttctacagagaatgtgacatgcagctctttgggccctggggtgaaatcgtgagcccctcgctgagtccagccacgagtaatgcagggggctgccggctcttcattaatgtggctccgcacgcacggattgccatccatgccctggccaccaacatgggcgctgggaccgagggagccaatgccagctacatcttgatccgggacacccacagcttgaggaccacagcgttccatgggcagcaggtgctctactgggagtcagagagcagccaggctgagatggagttcagcgagggcttcctgaaggctcaggccagcctgcggggccagtactggaccctccaatcatgggtaccggagatgcaggaccctcagtcctggaagggaaaggaaggaacctgagggtcattgaacatttgttccgtgtctggccagccctggagggttgacccctggtctcagtgctttccaattcgaactttttccaatcttaggtatctactttagagtcttctccaatgtccaaaaggctagggggttggaggtggggactctggaaaagcagcccccatttcctcgggtaccaataaataaaacatgcaggctga

SEQ ID NO: 104701 - DNA, 1155 bp, Homo sapiens
  Payload ID: 556
  Gene Symbol: ADAMTS13
  Gene Name: ADAM metallopeptidase with thrombospondin type 1 motif 13
  ENST ID: ENST00000630700
  CDS Start-End: 121-1155
acactgcctaatcgtcccgcccagtagtgagcaggcctgtcccattccatactgaccagattcccagtcaccaaggccccctctcactccgctccactcctcgggctggctctcctgaggatgcaccagcgtcacccccgggcaagatgccctcccctctgtgtggccggaatccttgcctgtggctttctcctgggctgctggggaccctcccatttccagcagagttgtcttcaggctttggagccacaggccgtgtcttcttacttgagccctggtgctcccttaaaaggccgccctccttcccctggcttccagaggcagaggcagaggcagaggcgggctgcaggcggcatcctacacctggagctgctggtggccgtgggccccgatgtcttccaggctcaccaggaggacacagagcgctatgtgctcaccaacctcaacatcggggcagaactgcttcgggacccgtccctgggggctcagtttcgggtgcacctggtgaagatggtcattctgacagagcctgagggtgctccaaatatcacagccaacctcacctcgtccctgctgagcgtctgtgggtggagccagaccatcaaccctgaggacgacacggatcctggccatgctgacctggtcctctatatcactaggtttgacctggagttgcctgatggtaaccggcaggtgcggggcgtcacccagctgggcggtgcctgctccccaacctggagctgcctcattaccgaggacactggcttcgacctgggagtcaccattgcccatgagattgggcacagcttcggcctggagcacgacggcgcgcccggcagcggctgcggccccagcggacacgtgatggcttcggacggcgccgcgccccgcgccggcctcgcctggtccccctgcagccgccggcagctgctgagcctgctcagacccgtccctccgtcgccgctccctctgctggccacccacctctgcgccggcaggagccttagtcttggtcccagccaagagccggctcctggtggggggcgcgggccgagaactcctgttcccactcacaaaaggccacgcttccaaacgcttccatcctcgtgcccactcctccgtcccgcctcctcccggtgtacaccccgggactga

SEQ ID NO: 104702 - DNA, 4934 bp, Homo sapiens
  Payload ID: 556
  Gene Symbol: ADAMTS13
  Gene Name: ADAM metallopeptidase with thrombospondin type 1 motif 13
  ENST ID: ENST00000626597
  CDS Start-End: 445-4728
aaccacgatgtctttggcacagcctctcatctgtcagatgggagcggggaccccggagagggagtcagccgaggtcctggcattccttgtgaacccccgtctgtgggtttctggtccagtgtcccttctccagattagatggcttaggcctcctctaagggggtgggcgtgcacatccggagagctgtctggtgtgcaggactgggctgcaggttaccctgaactgcaaccatcttagagcaaggcccagcttgcagcaggaggagctgcaggccgcccaccctagccacggcccctgccctggcaggaagcttccaagagtaaacactgcctaatcgtcccgcccagtagtgagcaggcctgtcccattccatactgaccagattcccagtcaccaaggccccctctcactccgctccactcctcgggctggctctcctgaggatgcaccagcgtcacccccgggcaagatgccctcccctctgtgtggccggaatccttgcctgtggctttctcctgggctgctggggaccctcccatttccagcagagttgtcttcaggctttggagccacaggccgtgtcttcttacttgagccctggtgctcccttaaaaggccgccctccttcccctggcttccagaggcagaggcagaggcagaggcgggctgcaggcggcatcctacacctggagctgctggtggccgtgggccccgatgtcttccaggctcaccaggaggacacagagcgctatgtgctcaccaacctcaacatcggggcagaactgcttcgggacccgtccctgggggctcagtttcgggtgcacctggtgaagatggtcattctgacagagcctgagggtgctccaaatatcacagccaacctcacctcgtccctgctgagcgtctgtgggtggagccagaccatcaaccctgaggacgacacggatcctggccatgctgacctggtcctctatatcactaggtttgacctggagttgcctgatggtaaccggcaggtgcggggcgtcacccagctgggcggtgcctgctccccaacctggagctgcctcattaccgaggacactggcttcgacctgggagtcaccattgcccatgagattgggcacagcttcggcctggagcacgacggcgcgcccggcagcggctgcggccccagcggacacgtgatggcttcggacggcgccgcgccccgcgccggcctcgcctggtccccctgcagccgccggcagctgctgagcctgctcagcgcaggacgggcgcgctgcgtgtgggacccgccgcggcctcaacccgggtccgcggggcacccgccggatgcgcagcctggcctctactacagcgccaacgagcagtgccgcgtggccttcggccccaaggctgtcgcctgcaccttcgccagggagcacctggatatgtgccaggccctctcctgccacacagacccgctggaccaaagcagctgcagccgcctcctcgttcctctcctggatgggacagaatgtggcgtggagaagtggtgctccaagggtcgctgccgctccctggtggagctgacccccatagcagcagtgcatgggcgctggtctagctggggtccccgaagtccttgctcccgctcctgcggaggaggtgtggtcaccaggaggcggcagtgcaacaaccccagacctgcctttggggggcgtgcatgtgttggtgctgacctccaggccgagatgtgcaacactcaggcctgcgagaagacccagctggagttcatgtcgcaacagtgcgccaggaccgacggccagccgctgcgctcctcccctggcggcgcctccttctaccactggggtgctgctgtaccacacagccaaggggatgctctgtgcagacacatgtgccgggccattggcgagagcttcatcatgaagcgtggagacagcttcctcgatgggacccggtgtatgccaagtggcccccgggaggacgggaccctgagcctgtgtgtgtcgggcagctgcaggacatttggctgtgatggtaggatggactcccagcaggtatgggacaggtgccaggtgtgtggtggggacaacagcacgtgcagcccacggaagggctctttcacagctggcagagcgagagaatatgtcacgtttctgacagttacccccaacctgaccagtgtctacattgccaaccacaggcctctcttcacacacttggcggtgaggatcggagggcgctatgtcgtggctgggaagatgagcatctcccctaacaccacctacccctccctcctggaggatggtcgtgtcgagtacagagtggccctcaccgaggaccggctgccccgcctggaggagatccgcatctggggacccctccaggaagatgctgacatccaggtttacaggcggtatggcgaggagtatggcaacctcacccgcccagacatcaccttcacctacttccagcctaagccacggcaggcctgggtgtgggccgctgtgcgtgggccctgctcggtgagctgtggggcagggctgcgctgggtaaactacagctgcctggaccaggccaggaaggagttggtggagactgtccagtgccaagggagccagcagccaccagcgtggccagaggcctgcgtgctcgaaccctgccctccctactgggcggtgggagacttcggcccatgcagcgcctcctgtgggggtggcctgcgggagcggccagtgcgctgcgtggaggcccagggcagcctcctgaagacattgcccccagcccggtgcagagcaggggcccagcagccagctgtggcgctggaaacctgcaacccccagccctgccctgccaggtgggaggtgtcagagcccagctcatgcacatcagctggtggagcaggcctggccttggagaacgagacctgtgtgccaggggcagatggcctggaggctccagtgactgaggggcctggctccgtagatgagaagctgcctgcccctgagccctgtgtcgggatgtcatgtcctccaggctggggccatctggatgccacctctgcaggggagaaggctccctccccatggggcagcatcaggacgggggctcaagctgcacacgtgtggacccctgcggcagggtcgtgctccgtctcctgcgggcgaggtctgatggagctgcgtttcctgtgcatggactctgccctcagggtgcctgtccaggaagagctgtgtggcctggcaagcaagcctgggagccggcgggaggtctgccaggctgtcccgtgccctgctcggtggcagtacaagctggcggcctgcagcgtgagctgtgggagaggggtcgtgcggaggatcctgtattgtgcccgggcccatggggaggacgatggtgaggagatcctgttggacacccagtgccaggggctgcctcgcccggaaccccaggaggcctgcagcctggagccctgcccacctaggtggaaagtcatgtcccttggcccatgttcggccagctgtggccttggcactgctagacgctcggtggcctgtgtgcagctcgaccaaggccaggacgtggaggtggacgaggcggcctgtgcggcgctggtgcggcccgaggccagtgtcccctgtctcattgccgactgcacctaccgctggcatgttggcacctggatggagtgctctgtttcctgtggggatggcatccagcgccggcgtgacacctgcctcggaccccaggcccaggcgcctgtgccagctgatttctgccagcacttgcccaagccggtgactgtgcgtggctgctgggctgggccctgtgtgggacagggtacgcccagcctggtgccccacgaagaagccgctgctccaggacggaccacagccacccctgctggtgcctccctggagtggtcccaggcccggggcctgctcttctccccggctccccagcctcggcggctcctgcccgggccccaggaaaactcagtgcagtccagtgcctgtggcaggcagcaccttgagccaacaggaaccattgacatgcgaggcccagggcaggcagactgtgcagtggccattgggcggcccctcggggaggtggtgaccctccgcgtccttgagagttctctcaactgcagtgcgggggacatgttgctgctttggggccggctcacctggaggaagatgtgcaggaagctgttggacatgactttcagctccaagaccaacacgctggtggtgaggcagcgctgcgggcggccaggaggtggggtgctgctgcggtatgggagccagcttgctcctgaaaccttctacagagaatgtgacatgcagctctttgggccctggggtgaaatcgtgagcccctcgctgagtccagccacgagtaatgcagggggctgccggctcttcattaatgtggctccgcacgcacggattgccatccatgccctggccaccaacatgggcgctgggaccgagggagccaatgccagctacatcttgatccgggacacccacagcttgaggaccacagcgttccatgggcagcaggtgctctactgggagtcagagagcagccaggctgagatggagttcagcgagggcttcctgaaggctcaggccagcctgcggggccagtactggaccctccaatcatgggtaccggagatgcaggaccctcagtcctggaagggaaaggaaggaacctgagggtcattgaacatttgttccgtgtctggccagccctggagggttgacccctggtctcagtgctttccaattcgaactttttccaatcttaggtatctactttagagtcttctccaatgtccaaaaggctagggggttggaggtggggactctggaaaagcagcccccatttcctcgggtaccaataaataaaacatgcaggctga

SEQ ID NO: 104703 - DNA, 2230 bp, Homo sapiens
  Payload ID: 556
  Gene Symbol: ADAMTS13
  Gene Name: ADAM metallopeptidase with thrombospondin type 1 motif 13
  ENST ID: ENST00000626661
  CDS Start-End: 120-950
cactgcctaatcgtcccgcccagtagtgagcaggcctgtcccattccatactgaccagattcccagtcaccaaggccccctctcactccgctccactcctcgggctggctctcctgaggatgcaccagcgtcacccccgggcaagatgccctcccctctgtgtggccggaatccttgcctgtggctttctcctgggctgctggggaccctcccatttccagcagagttgtcttcaggctttggagccacaggccgtgtcttcttacttgagccctggtgctcccttaaaaggccgccctccttcccctggcttccagaggcagaggcagaggcagaggcgggctgcaggcggcatcctacacctggagctgctggtggccgtgggccccgatgtcttccaggctcaccaggaggacacagagcgctatgtgctcaccaacctcaacatcggggcagaactgcttcgggacccgtccctgggggctcagtttcgggtgcacctggtgaagatggtcattctgacagagcctgagggtgctccaaatatcacagccaacctcacctcgtccctgctgagcgtctgtgggtggagccagaccatcaaccctgaggacgacacggatcctggccatgctgacctggtcctctatatcactaggtttgacctggagttgcctgatggtaaccggcaggtgcggggcgtcacccagctgggcggtgcctgctccccaacctggagctgcctcattaccgaggacactggcttcgacctgggagtcaccattgcccatgagattgggcacaggatatgtgccaggccctctcctgccacacagacccgctggaccaaagcagctgcagccgcctcctcgttcctctcctggatgggacagaatgtggcgtggagaagtggtgctccaagggtcgctgccgctccctggtggagctgacccccatagcagcagtgcatgggcgctggtctagctggggtccccgaagtccttgctcccgctcctgcggaggaggtgtggtcaccaggaggcggcagtgcaacaaccccaggcctgcgagaagacccagctggagttcatgtcgcaacagtgcgccaggaccgacggccagccgctgcgctcctcccctggcggcgcctccttctaccactggggtgctgctgtaccacacagccaaggggatgctctgtgcagacacatgtgccgggccattggcgagagcttcatcatgaagcgtggagacagcttcctcgatgggacccggtgtatgccaagtggcccccgggaggacgggaccctgagcctgtgtgtgtcgggcagctgcaggacatttggctgtgatggtaggatggactcccagcaggtatgggacaggtgccaggtgtgtggtggggacaacagcacgtgcagcccacggaagggctctttcacagctggcagagcgagagaatatgtcacgtttctgacagttacccccaacctgaccagtgtctacattgccaaccacaggcctctcttcacacacttggcggtgaggatcggagggcgctatgtcgtggctgggaagatgagcatctcccctaacaccacctacccctccctcctggaggatggtcgtgtcgagtacagagtggccctcaccgaggaccggctgccccgcctggaggagatccgcatctggggacccctccaggaagatgctgacatccagctgggcggtgggagacttcggcccatgcagcgcctcctgtgggggtggcctgcgggagcggccagtgcgctgcgtggaggcccagggcagcctcctgaagacattgcccccagcccggtgcagagcaggggcccagcagccagctgtggcgctggaaacctgcaacccccagccctgccctgccaggtgggaggtgtcagagcccagctcatgcacatcagctggtggagcaggcctggccttggagaacgagacctgtgtgccaggggcagatggcctggaggctccagtgactgaggggcctggctccgtagatgagaagctgcctgcccctgagccctgtgtcgggatgtcatgtcctccaggctggggccatctggatgccacctctgcaggggagaaggctccctccccatggggcagcatcaggacgggggctcaagctgcacacgtgtggacccctgcggcagggtcgtgctccgtctcctgcgggcgaggtctgatggag

SEQ ID NO: 104704 - DNA, 4442 bp, Homo sapiens
  Payload ID: 556
  Gene Symbol: ADAMTS13
  Gene Name: ADAM metallopeptidase with thrombospondin type 1 motif 13
  ENST ID: ENST00000626744
  CDS Start-End: 121-4236
acactgcctaatcgtcccgcccagtagtgagcaggcctgtcccattccatactgaccagattcccagtcaccaaggccccctctcactccgctccactcctcgggctggctctcctgaggatgcaccagcgtcacccccgggcaagatgccctcccctctgtgtggccggaatccttgcctgtggctttctcctgggctgctggggaccctcccatttccagcagagttgtcttcaggctttggagccacaggccgtgtcttcttacttgagccctggtgctcccttaaaaggccgccctccttcccctggcttccagaggcagaggcagaggcagaggcgggctgcaggcggcatcctacacctggagctgctggtggccgtgggccccgatgtcttccaggctcaccaggaggacacagagcgctatgtgctcaccaacctcaacatcggggcagaactgcttcgggacccgtccctgggggctcagtttcgggtgcacctggtgaagatggtcattctgacagagcctgagggtgctccaaatatcacagccaacctcacctcgtccctgctgagcgtctgtgggtggagccagaccatcaaccctgaggacgacacggatcctggccatgctgacctggtcctctatatcactaggtttgacctggagttgcctgatggtaaccggcaggtgcggggcgtcacccagctgggcggtgcctgctccccaacctggagctgcctcattaccgaggacactggcttcgacctgggagtcaccattgcccatgagattgggcacagcttcggcctggagcacgacggcgcgcccggcagcggctgcggccccagcggacacgtgatggcttcggacggcgccgcgccccgcgccggcctcgcctggtccccctgcagccgccggcagctgctgagcctgctcagcgcaggacgggcgcgctgcgtgtgggacccgccgcggcctcaacccgggtccgcggggcacccgccggatgcgcagcctggcctctactacagcgccaacgagcagtgccgcgtggccttcggccccaaggctgtcgcctgcaccttcgccagggagcacctggatatgtgccaggccctctcctgccacacagacccgctggaccaaagcagctgcagccgcctcctcgttcctctcctggatgggacagaatgtggcgtggagaagtggtgctccaagggtcgctgccgctccctggtggagctgacccccatagcagcagtgcatgggcgctggtctagctggggtccccgaagtccttgctcccgctcctgcggaggaggtgtggtcaccaggaggcggcagtgcaacaaccccagacctgcctttggggggcgtgcatgtgttggtgctgacctccaggccgagatgtgcaacactcaggcctgcgagaagacccagctggagttcatgtcgcaacagtgcgccaggaccgacggccagccgctgcgctcctcccctggcggcgcctccttctaccactggggtgctgctgtaccacacagccaaggggatgctctgtgcagacacatgtgccgggccattggcgagagcttcatcatgaagcgtggagacagcttcctcgatgggacccggtgtatgccaagtggcccccgggaggacgggaccctgagcctgtgtgtgtcgggcagctgcaggacatttggctgtgatggtaggatggactcccagcaggtatgggacaggtgccaggtgtgtggtggggacaacagcacgtgcagcccacggaagggctctttcacagctggcagagcgagagaatatgtcacgtttctgacagttacccccaacctgaccagtgtctacattgccaaccacaggcctctcttcacacacttggcggtgaggatcggagggcgctatgtcgtggctgggaagatgagcatctcccctaacaccacctacccctccctcctggaggatggtcgtgtcgagtacagagtggccctcaccgaggaccggctgccccgcctggaggagatccgcatctggggacccctccaggaagatgctgacatccaggtttacaggcggtatggcgaggagtatggcaacctcacccgcccagacatcaccttcacctacttccagcctaagccacggcaggcctgggtgtgggccgctgtgcgtgggccctgctcggtgagctgtggggcagggctgcgctgggtaaactacagctgcctggaccaggccaggaaggagttggtggagactgtccagtgccaagggagccagcagccaccagcgtggccagaggcctgcgtgctcgaaccctgccctccctactgggcggtgggagacttcggcccatgcagcgcctcctgtgggggtggcctgcgggagcggccagtgcgctgcgtggaggcccagggcagcctcctgaagacattgcccccagcccggtgcagagcaggggcccagcagccagctgtggcgctggaaacctgcaacccccagccctgccctgccaggtgggaggtgtcagagcccagctcatgcacatcagctggtggagcaggcctggccttggagaacgagacctgtgtgccaggggcagatggcctggaggctccagtgactgaggggcctggctccgtagatgagaagctgcctgcccctgagccctgtgtcgggatgtcatgtcctccaggctggggccatctggatgccacctctgcaggggagaaggctccctccccatggggcagcatcaggacgggggctcaagctgcacacgtgtggacccctgcggcagggtcgtgctccgtctcctgcgggcgaggtctgatggagctgcgtttcctgtgcatggactctgccctcagggtgcctgtccaggaagagctgtgtggcctggcaagcaagcctgggagccggcgggaggtctgccaggctgtcccgtgccctgctcggtggcagtacaagctggcggcctgcagcgtgagctgtgggagaggggtcgtgcggaggatcctgtattgtgcccgggcccatggggaggacgatggtgaggagatcctgttggacacccagtgccaggggctgcctcgcccggaaccccaggaggcctgcagcctggagccctgcccacctaggtggaaagtcatgtcccttggcccatgttcggccagctgtggccttggcactgctagacgctcggtggcctgtgtgcagctcgaccaaggccaggacgtggaggtggacgaggcggcctgtgcggcgctggtgcggcccgaggccagtgtcccctgtctcattgccgactgcacctaccgctggcatgttggcacctggatggagtgctctgtttcctgtggggatggcatccagcgccggcgtgacacctgcctcggaccccaggcccaggcgcctgtgccagctgatttctgccagcacttgcccaagccggtgactgtgcgtggctgctgggctgggccctgtgtgggacagggtgcctgtggcaggcagcaccttgagccaacaggaaccattgacatgcgaggcccagggcaggcagactgtgcagtggccattgggcggcccctcggggaggtggtgaccctccgcgtccttgagagttctctcaactgcagtgcgggggacatgttgctgctttggggccggctcacctggaggaagatgtgcaggaagctgttggacatgactttcagctccaagaccaacacgctggtggtgaggcagcgctgcgggcggccaggaggtggggtgctgctgcggtatgggagccagcttgctcctgaaaccttctacagagaatgtgacatgcagctctttgggccctggggtgaaatcgtgagcccctcgctgagtccagccacgagtaatgcagggggctgccggctcttcattaatgtggctccgcacgcacggattgccatccatgccctggccaccaacatgggcgctgggaccgagggagccaatgccagctacatcttgatccgggacacccacagcttgaggaccacagcgttccatgggcagcaggtgctctactgggagtcagagagcagccaggctgagatggagttcagcgagggcttcctgaaggctcaggccagcctgcggggccagtactggaccctccaatcatgggtaccggagatgcaggaccctcagtcctggaagggaaaggaaggaacctgagggtcattgaacatttgttccgtgtctggccagccctggagggttgacccctggtctcagtgctttccaattcgaactttttccaatcttaggtatctactttagagtcttctccaatgtccaaaaggctagggggttggaggtggggactctggaaaagcagcccccatttcctcgggtaccaataaataaaacatgcaggctga

SEQ ID NO: 104705 - DNA, 4330 bp, Homo sapiens
  Payload ID: 556
  Gene Symbol: ADAMTS13
  Gene Name: ADAM metallopeptidase with thrombospondin type 1 motif 13
  ENST ID: ENST00000630344
  CDS Start-End: 1189-2523
aaccacgatgtctttggcacagcctctcatctgtcagatgggagcggggaccccggagagggagtcagccgaggtcctggcattccttgtgaacccccgtctgtgggtttctggtccagtgtcccttctccagattagatggcttaggcctcctctaagggggtgggcgtgcacatccggagagctgtctggtgtgcaggactgggctgcaggttaccctgaactgcaaccatcttagagcaaggcccagcttgcagcaggaggagctgcaggccgcccaccctagccacggcccctgccctggcaggaagcttccaagagtaaacactgcctaatcgtcccgcccagtagtgagcaggcctgtcccattccatactgaccagattcccagtcaccaaggccccctctcactccgctccactcctcgggctggctctcctgaggatgcaccagcgtcacccccgggcaagatgccctcccctctgtgtggccggaatccttgcctgtggctttctcctgggctgctggggaccctcccatttccagcagagttgtcttcaggctttggagccacaggccgtgtcttcttacttgagccctggtgctcccttaaaaggccgccctccttcccctggcttccagaggcagaggcagaggcagaggcgggctgcaggcggcatcctacacctggagctgctggtggccgtgggccccgatgtcttccaggctcaccaggaggacacagagcgctatgtgctcaccaacctcaacatcggggcagaactgcttcgggacccgtccctgggggctcagtttcgggtgcacctggtgaagatggtcattctgacagagcctgagggtgctccaaatatcacagccaacctcacctcgtccctgctgagcgtctgtgggtggagccagaccatcaaccctgaggacgacacggatcctggccatgctgacctggtcctctatatcactaggtttgacctggagttgcctgatggtaaccggcaggtgcggggcgtcacccagctgggcggtgcctgctccccaacctggagctgcctcattaccgaggacactggcttcgacctgggagtcaccattgcccatgagattgggcacagcttcggcctggagcacgacggcgcgcccggcagcggctgcggccccagcggacacgtgatggcttcggacggcgccgcgccccgcgccggcctcgcctggtccccctgcagccgccggcagctgctgagcctgctcagcgcaggacgggcgcgctgcgtgtgggacccgccgcggcctcaacccgggtccgcggggcacccgccggatgcgcagcctggcctctactacagcgccaacgagcagtgccgcgtggccttcggccccaaggctgtcgcctgcaccttcgccagggagcacctggatatgtgccaggccctctcctgccacacagacccgctggaccaaagcagctgcagccgcctcctcgttcctctcctggatgggacagaatgtggcgtggagaagtggtgctccaagggtcgctgccgctccctggtggagctgacccccatagcagcagtgcatgggcgctggtctagctggggtccccgaagtccttgctcccgctcctgcggaggaggtgtggtcaccaggaggcggcagtgcaacaaccccagacctgcctttggggggcgtgcatgtgttggtgctgacctccaggccgagatgtgcaacactcaggcctgcgagaagacccagctggagttcatgtcgcaacagtgcgccaggaccgacggccagccgctgcgctcctcccctggcggcgcctccttctaccactggggtgctgctgtaccacacagccaaggggatgctctgtgcagacacatgtgccgggccattggcgagagcttcatcatgaagcgtggagacagcttcctcgatgggacccggtgtatgccaagtggcccccgggaggacgggaccctgagcctgtgtgtgtcgggcagctgcaggacatttggctgtgatggtaggatggactcccagcaggtatgggacaggtgccaggtgtgtggtggggacaacagcacgtgcagcccacggaagggctctttcacagctggcagagcgagagaatatgtcacgtttctgacagttacccccaacctgaccagtgtctacattgccaaccacaggcctctcttcacacacttggcggtgaggatcggagggcgctatgtcgtggctgggaagatgagcatctcccctaacaccacctacccctccctcctggaggatggtcgtgtcgagtacagagtggccctcaccgaggaccggctgccccgcctggaggagatccgcatctggggacccctccaggaagatgctgacatccaggtgggaggtgtcagagcccagctcatgcacatcagctggtggagcaggcctggccttggagaacgagacctgtgtgccaggggcagatggcctggaggctccagtgactgaggggcctggctccgtagatgagaagctgcctgcccctgagccctgtgtcgggatgtcatgtcctccaggctggggccatctggatgccacctctgcaggggagaaggctccctccccatggggcagcatcaggacgggggctcaagctgcacacgtgtggacccctgcggcagggtcgtgctccgtctcctgcgggcgaggtctgatggagctgcgtttcctgtgcatggactctgccctcagggtgcctgtccaggaagagctgtgtggcctggcaagcaagcctgggagccggcgggaggtctgccaggctgtcccgtgccctgctcggtggcagtacaagctggcggcctgcagcgtgagctgtgggagaggggtcgtgcggaggatcctgtattgtgcccgggcccatggggaggacgatggtgaggagatcctgttggacacccagtgccaggggctgcctcgcccggaaccccaggaggcctgcagcctggagccctgcccacctaggtggaaagtcatgtcccttggcccatgttcggccagctgtggccttggcactgctagacgctcggtggcctgtgtgcagctcgaccaaggccaggacgtggaggtggacgaggcggcctgtgcggcgctggtgcggcccgaggccagtgtcccctgtctcattgccgactgcacctaccgctggcatgttggcacctggatggagtgctctgtttcctgtggggatggcatccagcgccggcgtgacacctgcctcggaccccaggcccaggcgcctgtgccagctgatttctgccagcacttgcccaagccggtgactgtgcgtggctgctgggctgggccctgtgtgggacagggtgcctgtggcaggcagcaccttgagccaacaggaaccattgacatgcgaggcccagggcaggcagactgtgcagtggccattgggcggcccctcggggaggtggtgaccctccgcgtccttgagagttctctcaactgcagtgcgggggacatgttgctgctttggggccggctcacctggaggaagatgtgcaggaagctgttggacatgactttcagctccaagaccaacacgctggtggtgaggcagcgctgcgggcggccaggaggtggggtgctgctgcggtatgggagccagcttgctcctgaaaccttctacagagaatgtgacatgcagctctttgggccctggggtgaaatcgtgagcccctcgctgagtccagccacgagtaatgcagggggctgccggctcttcattaatgtggctccgcacgcacggattgccatccatgccctggccaccaacatgggcgctgggaccgagggagccaatgccagctacatcttgatccgggacacccacagcttgaggaccacagcgttccatgggcagcaggtgctctactgggagtcagagagcagccaggctgagatggagttcagcgagggcttcctgaaggctcaggccagcctgcggggccagtactggaccctccaatcatgggtaccggagatgcaggaccctcagtcctggaagggaaaggaaggaacctgagggtcattgaacatttgttccgtgtctggccagccctggagggttgacccctggtctcagtgctttccaattcgaactttttccaatcttaggtatctactttagagtcttctccaatgtccaaaaggctagggggttggaggtggggactctggaaaagcagcccccatttcctcgggtaccaataaataaaacatgcaggctgaccggcgtttttttctt

SEQ ID NO: 104706 - DNA, 1074 bp, Homo sapiens
  Payload ID: 556
  Gene Symbol: ADAMTS13
  Gene Name: ADAM metallopeptidase with thrombospondin type 1 motif 13
  ENST ID: ENST00000629604
  CDS Start-End: 197-868
ggtgggcaaaggcatcttcctctgggaaggactggcacaagcacttggtccctgggttgtgtgcctgggaggccgggatcagggctggccctctttctccctggcaaagcaaaacctcccttttactactatcaaggggaagtaacttgaaggtgcctgtggcaggcagcaccttgagccaacaggaaccattgacatgcgaggcccagggcaggcagactgtgcagtggccattgggcggcccctcggggaggtggtgaccctccgcgtccttgagagttctctcaactgcagtgcgggggacatgttgctgctttggggccggctcacctggaggaagatgtgcaggaagctgttggacatgactttcagctccaagaccaacacgctggtggtgaggcagcgctgcgggcggccaggaggtggggtgctgctgcggtatgggagccagcttgctcctgaaaccttctacagagaatgtgacatgcagctctttgggccctggggtgaaatcgtgagcccctcgctgagtccagccacgagtaatgcagggggctgccggctcttcattaatgtggctccgcacgcacggattgccatccatgccctggccaccaacatgggcgctgggaccgagggagccaatgccagctacatcttgatccgggacacccacagcttgaggaccacagcgttccatgggcagcaggtgctctactgggagtcagagagcagccaggctgagatggagttcagcgagggcttcctgaaggctcaggccagcctgcggggccagtactggaccctccaatcatgggtaccggagatgcaggaccctcagtcctggaagggaaaggaaggaacctgagggtcattgaacatttgttccgtgtctggccagccctggagggttgacccctggtctcagtgctttccaattcgaactttttccaatcttaggtatctactttagagtcttctccaatgtccaaaaggctagggggttggaggtggggactctggaaaagcagcccccatttcctcgggtaccaataaataaaacatgcaggctga

SEQ ID NO: 104707 - DNA, 5191 bp, Homo sapiens
  Payload ID: 557
  Gene Symbol: ADAMTS1
  Gene Name: ADAM metallopeptidase with thrombospondin type 1 motif, 1
  Uniprot ID: Q9UHI8
  ENST ID: ENST00000284984
  CDS Start-End: 456-3359
gcactcgctggaaagcggctccgagccaggggctattgcaaagccagggtgcgctaccggacggagaggggagagccctgagcagagtgagcaacatcgcagccaaggcggaggccgaagaggggcgccaggcaccaatctccgcgttgcctcagccccggaggcgccccagagcgcttcttgtcccagcagagccactctgcctgcgcctgcctctcagtgtctccaactttgcgctggaagaaaaacttcccgcgcgccggcagaactgcagcgcctccttttagtgactccgggagcttcggctgtagccggctctgcgcgcccttccaacgaataatagaaattgttaattttaacaatccagagcaggccaacgaggctttgctctcccgacccgaactaaaggtccctcgctccgtgcgctgctacgagcggtgtctcctggggctccaatgcagcgagctgtgcccgaggggttcggaaggcgcaagctgggcagcgacatggggaacgcggagcgggctccggggtctcggagctttgggccagtacccacgctgctgctgctcgccgcggcgctactggccgtgtcggacgcactcgggcgcccctccgaggaggacgaggagctagtggtgccggagctggagcgcgccccgggacacgggaccacgcgcctccgcctgcacgcctttgaccagcagctggatctggagctgcggcccgacagcagctttttggcgcccggcttcacgctccagaacgtggggcgcaaatccgggtccgagacgccgcttccggaaaccgacctggcgcactgcttctactccggcaccgtgaatggcgatcccagctcggctgccgccctcagcctctgcgagggcgtgcgcggcgccttctacctgctgggggaggcgtatttcatccagccgctgcccgccgccagcgagcgcctcgccaccgccgccccaggggagaagccgccggcaccactacagttccacctcctgcggcggaatcggcagggcgacgtcggcggcacgtgcggggtcgtggacgacgagccccggccgactgggaaagcggagaccgaagacgaggacgaagggactgagggcgaggacgaaggggctcagtggtcgccgcaggacccggcactgcaaggcgtaggacagcccacaggaactggaagcataagaaagaagcgatttgtgtccagtcaccgctatgtggaaaccatgcttgtggcagaccagtcgatggcagaattccacggcagtggtctaaagcattaccttctcacgttgttttcggtggcagccagattgtacaaacaccccagcattcgtaattcagttagcctggtggtggtgaagatcttggtcatccacgatgaacagaaggggccggaagtgacctccaatgctgccctcactctgcggaacttttgcaactggcagaagcagcacaacccacccagtgaccgggatgcagagcactatgacacagcaattcttttcaccagacaggacttgtgtgggtcccagacatgtgatactcttgggatggctgatgttggaactgtgtgtgatccgagcagaagctgctccgtcatagaagatgatggtttacaagctgccttcaccacagcccatgaattaggccacgtgtttaacatgccacatgatgatgcaaagcagtgtgccagccttaatggtgtgaaccaggattcccacatgatggcgtcaatgctttccaacctggaccacagccagccttggtctccttgcagtgcctacatgattacatcatttctggataatggtcatggggaatgtttgatggacaagcctcagaatcccatacagctcccaggcgatctccctggcacctcgtacgatgccaaccggcagtgccagtttacatttggggaggactccaaacactgccccgatgcagccagcacatgtagcaccttgtggtgtaccggcacctctggtggggtgctggtgtgtcaaaccaaacacttcccgtgggcggatggcaccagctgtggagaagggaaatggtgtatcaacggcaagtgtgtgaacaaaaccgacagaaagcattttgatacgccttttcatggaagctggggaatgtgggggccttggggagactgttcgagaacgtgcggtggaggagtccagtacacgatgagggaatgtgacaacccagtcccaaagaatggagggaagtactgtgaaggcaaacgagtgcgctacagatcctgtaaccttgaggactgtccagacaataatggaaaaacctttagagaggaacaatgtgaagcacacaacgagttttcaaaagcttcctttgggagtgggcctgcggtggaatggattcccaagtacgctggcgtctcaccaaaggacaggtgcaagctcatctgccaagccaaaggcattggctacttcttcgttttgcagcccaaggttgtagatggtactccatgtagcccagattccacctctgtctgtgtgcaaggacagtgtgtaaaagctggttgtgatcgcatcatagactccaaaaagaagtttgataaatgtggtgtttgcgggggaaatggatctacttgtaaaaaaatatcaggatcagttactagtgcaaaacctggatatcatgatatcatcacaattccaactggagccaccaacatcgaagtgaaacagcggaaccagaggggatccaggaacaatggcagctttcttgccatcaaagctgctgatggcacatatattcttaatggtgactacactttgtccaccttagagcaagacattatgtacaaaggtgttgtcttgaggtacagcggctcctctgcggcattggaaagaattcgcagctttagccctctcaaagagcccttgaccatccaggttcttactgtgggcaatgcccttcgacctaaaattaaatacacctacttcgtaaagaagaagaaggaatctttcaatgctatccccactttttcagcatgggtcattgaagagtggggcgaatgttctaagtcatgtgaattgggttggcagagaagactggtagaatgccgagacattaatggacagcctgcttccgagtgtgcaaaggaagtgaagccagccagcaccagaccttgtgcagaccatccctgcccccagtggcagctgggggagtggtcatcatgttctaagacctgtgggaagggttacaaaaaaagaagcttgaagtgtctgtcccatgatggaggggtgttatctcatgagagctgtgatcctttaaagaaacctaaacatttcatagacttttgcacaatggcagaatgcagttaagtggtttaagtggtgttagctttgagggcaaggcaaagtgaggaagggctggtgcagggaaagcaagaaggctggagggatccagcgtatcttgccagtaaccagtgaggtgtatcagtaaggtgggattatgggggtagatagaaaaggagttgaatcatcagagtaaactgccagttgcaaatttgataggatagttagtgaggattattaacctctgagcagtgatatagcataataaagccccgggcattattattattatttcttttgttacatctattacaagtttagaaaaaacaaagcaattgtcaaaaaaagttagaactattacaacccctgtttcctggtacttatcaaatacttagtatcatgggggttgggaaatgaaaagtaggagaaaagtgagattttactaagacctgttttactttacctcactaacaatggggggagaaaggagtacaaataggatctttgaccagcactgtttatggctgctatggtttcagagaatgtttatacattatttctaccgagaattaaaacttcagattgttcaacatgagagaaaggctcagcaacgtgaaataacgcaaatggcttcctctttccttttttggaccatctcagtctttatttgtgtaattcattttgaggaaaaaacaactccatgtatttattcaagtgcattaaagtctacaatggaaaaaaagcagtgaagcattagatgctggtaaaagctagaggagacacaatgagcttagtacctccaacttcctttctttcctaccatgtaaccctgctttgggaatatggatgtaaagaagtaacttgtgtctcatgaaaatcagtacaatcacacaaggaggatgaaacgccggaacaaaaatgaggtgtgtagaacagggtcccacaggtttggggacattgagatcacttgtcttgtggtggggaggctgctgaggggtagcaggtccatctccagcagctggtccaacagtcgtatcctggtgaatgtctgttcagctcttctgtgagaatatgattttttccatatgtatatagtaaaatatgttactataaattacatgtactttataagtattggtttgggtgttccttccaagaaggactatagttagtaataaatgcctataataacatatttatttttatacatttatttctaatgaaaaaaacttttaaattatatcgcttttgtggaagtgcatataaaatagagtatttatacaatatatgttactagaaataaaagaacacttttggaatgtgtgtgtctgttttttgaagtgggaattcattcctaggaaggaaacctgaggcacaaatattgaatctgaagaccgaattattttcttaaattatttggcaataagattttgttctagaggaaggtgaagcaagacggctgaatagaagatttttttctaatgagatgtatttcttatatccttggtatacatgattgctaaaaagaaagaaatttatgatgtcatttgttactaatgtatctaataatatacatcagtggttggcaaacttcttttgtaaaaagccaaatggtaaatatttgcaactttgtcaatcctgtcaataactatcctgtcaataccatctatgtcacaactgctcaactgtgctgttgtagcacaaaactagccataaagaatgagtaagtgaatggacatggctgtgttctaaaaaaactacttgcaaaaacaaataatgggtcagatttgttctgcagattcagtttgccaaccctggtatataccataaattaaatggaaagagctttcagttctgga

SEQ ID NO: 104708 - DNA, 601 bp, Homo sapiens
  Payload ID: 557
  Gene Symbol: ADAMTS1
  Gene Name: ADAM metallopeptidase with thrombospondin type 1 motif, 1
  ENST ID: ENST00000451462
  CDS Start-End: 1-601
actgccggtccttcctgctacggccttctctctgtgcagtgcttattctccagttctttttgtttcatcactttggaactggaagcataagaaagaagcgatttgtgtccagtcaccgctatgtggaaaccatgcttgtggcagaccagtcgatggcagaattccacggcagtggtctaaagcattaccttctcacgttgttttcggtggcagccagattgtacaaacaccccagcattcgtaattcagttagcctggtggtggtgaagatcttggtcatccacgatgaacagaaggggccggaagtgacctccaatgctgccctcactctgcggaacttttgcaactggcagaagcagcacaacccacccagtgaccgggatgcagagcactatgacacagcaattcttttcaccagacaggacttgtgtgggtcccagacatgtgatactcttgggatggctgatgttggaactgtgtgtgatccgagcagaagctgctccgtcatagaagatgatggtttacaagctgccttcaccacagcccatgaattaggccacgtgtttaacatgccacatgatgatgcaaagcagtgtgccag

SEQ ID NO: 104709 - DNA, 598 bp, Homo sapiens
  Payload ID: 557
  Gene Symbol: ADAMTS1
  Gene Name: ADAM metallopeptidase with thrombospondin type 1 motif, 1
  ENST ID: ENST00000517777
  CDS Start-End: 86-598
ctcttgctccaagattttactacaattgggaactggaagcataagaaagaagcgatttgtgtccagtcaccgctatgtggaaaccatgcttgtggcagaccagtcgatggcagaattccacggcagtggtctaaagcattaccttctcacgttgttttcggtggcagccagattgtacaaacaccccagcattcgtaattcagttagcctggtggtggtgaagatcttggtcatccacgatgaacagaaggggccggaagtgacctccaatgctgccctcactctgcggaacttttgcaactggcagaagcagcacaacccacccagtgaccgggatgcagagcactatgacacagcaattcttttcaccagacaggacttgtgtgggtcccagacatgtgatactcttgggatggctgatgttggaactgtgtgtgatccgagcagaagctgctccgtcatagaagatgatggtttacaagctgccttcaccacagcccatgaattaggccacgtgtttaacatgccacatgatgatgcaaagcagtgtgccagccttaatggtgtgaaccaggattcccacatgatggcgtcaatg

SEQ ID NO: 104710 - DNA, 405 bp, Homo sapiens
  Payload ID: 557
  Gene Symbol: ADAMTS1
  Gene Name: ADAM metallopeptidase with thrombospondin type 1 motif, 1
  ENST ID: ENST00000517452
  CDS Start-End: 21-405
gtggagagggcagaggagcaatggtgacctgggaaggaactggaagcataagaaagaagcgatttgtgtccagtcaccgctatgtggaaaccatgcttgtggcagaccagtcgatggcagaattccacggcagtggtctaaagcattaccttctcacgttgttttcggtggcagccagattgtacaaacaccccagcattcgtaattcagttagcctggtggtggtgaagatcttggtcatccacgatgaacagaaggggccggaagtgacctccaatgctgccctcactctgcggaacttttgcaactggcagaagcagcacaacccacccagtgaccgggatgcagagcactatgacacagcaattcttttcaccagacaggacttgtgtgggtcccagacat

SEQ ID NO: 104711 - DNA, 4194 bp, Homo sapiens
  Payload ID: 558
  Gene Symbol: ADAMTS10
  Gene Name: ADAM metallopeptidase with thrombospondin type 1 motif, 10
  ENST ID: ENST00000270328
  CDS Start-End: 232-3543
gacccctccctgcccaggctccaaagaagaagaaaccaaggcccagagagggaggcccaggtgcagggagcaggcgagggaaggatccgtacaggggcccaacactactccaccaaccgaagcccccaaaaggagcccggtgatgctgcgaaggctgtgaacaggggaggcggcactgtgggggctgccggcagccggggctggggagagacatgtggacacgtggcctctatggctcccgcctgccagatcctccgctgggccctcgccctggggctgggcctcatgttcgaggtcacgcacgccttccggtctcaagatgagttcctgtccagtctggagagctatgagatcgccttccccacccgcgtggaccacaacggggcactgctggccttctcgccacctcctccccggaggcagcgccgcggcacgggggccacagccgagtcccgcctcttctacaaagtggcctcgcccagcacccacttcctgctgaacctgacccgcagctcccgtctactggcagggcacgtctccgtggagtactggacacgggagggcctggcctggcagagggcggcccggccccactgcctctacgctggtcacctgcagggccaggccagcagctcccatgtggccatcagcacctgtggaggcctgcacggcctgatcgtggcagacgaggaagagtacctgattgagcccctgcacggtgggcccaagggttctcggagcccggaggaaagtggaccacatgtggtgtacaagcgttcctctctgcgtcacccccacctggacacagcctgtggagtgagagatgagaaaccgtggaaagggcggccatggtggctgcggaccttgaagccaccgcctgccaggcccctggggaatgaaacagagcgtggccagccaggcctgaagcgatcggtcagccgagagcgctacgtggagaccctggtggtggctgacaagatgatggtggcctatcacgggcgccgggatgtggagcagtatgtcctggccatcatgaacattgttgccaaacttttccaggactcgagtctgggaagcaccgttaacatcctcgtaactcgcctcatcctgctcacggaggaccagcccactctggagatcacccaccatgccgggaagtccctggacagcttctgtaagtggcagaaatccatcgtgaaccacagcggccatggcaatgccattccagagaacggtgtggctaaccatgacacagcagtgctcatcacacgctatgacatctgcatctacaagaacaaaccctgcggcacactaggcctggccccggtgggcggaatgtgtgagcgcgagagaagctgcagcgtcaatgaggacattggcctggccacagcgttcaccattgcccacgagatcgggcacacattcggcatgaaccatgacggcgtgggaaacagctgtggggcccgtggtcaggacccagccaagctcatggctgcccacattaccatgaagaccaacccattcgtgtggtcatcctgcagccgtgactacatcaccagctttctagactcgggcctggggctctgcctgaacaaccggccccccagacaggactttgtgtacccgacagtggcaccgggccaagcctacgatgcagatgagcaatgccgctttcagcatggagtcaaatcgcgtcagtgtaaatacggggaggtctgcagcgagctgtggtgtctgagcaagagcaaccggtgcatcaccaacagcatcccggccgccgagggcacgctgtgccagacgcacaccatcgacaaggggtggtgctacaaacgggtctgtgtcccctttgggtcgcgcccagagggtgtggacggagcctgggggccgtggactccatggggcgactgcagccggacctgtggcggcggcgtgtcctcttctagccgtcactgcgacagccccaggccaaccatcgggggcaagtactgtctgggtgagagaaggcggcaccgctcctgcaacacggatgactgtccccctggctcccaggacttcagagaagtgcagtgttctgaatttgacagcatccctttccgtgggaaattctacaagtggaaaacgtaccggggagggggcgtgaaggcctgctcgctcacgtgcctagcggaaggcttcaacttctacacggagagggcggcagccgtggtggacgggacaccctgccgtccagacacggtggacatttgcgtcagtggcgaatgcaagcacgtgggctgcgaccgagtcctgggctccgacctgcgggaggacaagtgccgagtgtgtggcggtgacggcagtgcctgcgagaccatcgagggcgtcttcagcccagcctcacctggggccgggtacgaggatgtcgtctggattcccaaaggctccgtccacatcttcatccaggatctgaacctctctctcagtcacttggccctgaagggagaccaggagtccctgctgctggaggggctgcctgggaccccccagccccaccgtctgcctctagctgggaccacctttcaactgcgacaggggccagaccaggtccagagcctcgaagccctgggaccgattaatgcatctctcatcgtcatggtgctggcccggaccgagctgcctgccctccgctaccgcttcaatgcccccatcgcccgtgactcgctgcccccctactcctggcactatgcgccctggaccaagtgctcggcccagtgtgcaggcggtagccaggtgcaggcggtggagtgccgcaaccagctggacagctccgcggtcgccccccactactgcagtgcccacagcaagctgcccaaaaggcagcgcgcctgcaacacggagccttgccctccagactgggttgtagggaactggtcgctctgcagccgcagctgcgatgcaggcgtgcgcagccgctcggtcgtgtgccagcgccgcgtctctgccgcggaggagaaggcgctggacgacagcgcatgcccgcagccgcgcccacctgtactggaggcctgccacggccccacttgccctccggagtgggcggccctcgactggtctgagtgcacccccagctgcgggccgggcctccgccaccgcgtggtcctttgcaagagcgcagaccaccgcgccacgctgcccccggcgcactgctcacccgccgccaagccaccggccaccatgcgctgcaacttgcgccgctgccccccggcccgctgggtggctggcgagtggggtgagtgctctgcacagtgcggcgtcgggcagcggcagcgctcggtgcgctgcaccagccacacgggccaggcgtcgcacgagtgcacggaggccctgcggccgcccaccacgcagcagtgtgaggccaagtgcgacagcccaacccccggggacggccctgaagagtgcaaggatgtgaacaaggtcgcctactgccccctggtgctcaaatttcagttctgcagccgagcctacttccgccagatgtgctgcaaaacctgccatggccactagggggcgcgcggcacccggagccacagctggcggggtctccgccgccagccctgcagcgggccggccagagggggccccgggggggcgggaactgggagggaagggtgagacggagccggaagttatttattgggaacccctgcagggccctggctggggggatggagaggggctggctatccccccagagcccctcttcagcatccgccccttccagttcacatagtgagaccccccctccagggtgggtctggggaggggacagctgttcaccccagcaccctttgaacccacccttagggagtccccaacactccccccctcctttgatcggaatatgtactgtgaagagtaggggtggggaggtggtctgccggtgccctgccccccagcactgccctacccctccactccgagctgggggggaatctgtgtctgctatgggaggggggggggtagcaccacctccctgacaccctcccctgacctgactagggggaggatccaccccaacctctgccctgcccgccccaggggcaccccgacatccaggccaccccctcatggtgctacagaccctgccctggggcccacacactcctgccaggaagccctacatcaataaagttctgtcttgtgtagatttctacg

SEQ ID NO: 104712 - DNA, 831 bp, Homo sapiens
  Payload ID: 558
  Gene Symbol: ADAMTS10
  Gene Name: ADAM metallopeptidase with thrombospondin type 1 motif, 10
  ENST ID: ENST00000593826
  CDS Start-End: 55-435
cccatcccggagaggctgatatctctggctggggcctggagtggggaacggtgcatggggccgacgagtgtcctccgggctggactcactccttcctgtctccccccacccagtggtgctacaaacgggtctgtgtcccctttgggtcgcgcccagagggtgtggacggagcctgggggccgtggactccatggggcgactgcagccggacctgtggcggcggcgtgtcctcttctagccgtcactgcgacagccccaggccaaccatcgggggcaagtactgtctgggtgagagaaggcggcaccgctcctgcaacacggatgactgtccccctggctcccaggacttcagagaagtgcagtgttctgaatttgacagcatccctttccgtgggaaattctacaagtggaaaacgtaccggggagggggcgtgaaggcctgctcgctcacgtgcctagcggaaggcttcaacttctacacggagagggcggcagccgtggtggacgggacaccctgccgtccagacacggtggacatttgcgtcagtggcgaatgcaagcacgtgggctgcgaccgagtcctgggctccgacctgcgggaggacaagtgccgagtgtgtggcggtgacggcagtgcctgcgagaccatcgagggcgtcttcagcccagcctcacctggggccgggtacgaggatgtcgtctggattcccaaaggctccgtccacatcttcatccaggatctgaacctctctctcagtcacttggccctgaagggagaccaggagtccctgctgctggaggggctgcctgggaccccccagccccaccgtc

SEQ ID NO: 104713 - DNA, 3423 bp, Homo sapiens
  Payload ID: 558
  Gene Symbol: ADAMTS10
  Gene Name: ADAM metallopeptidase with thrombospondin type 1 motif, 10
  ENST ID: ENST00000596851
  CDS Start-End: 138-1007
gcggcggcgacggcgcggaggccccgggcgcggcgcaggagcccggtgatgctgcgaaggctgtgaacaggggaggcggcactgtgggggctgccggcagccggggctggggagagacatgtggacacgtggcctctatggctcccgcctgccagatcctccgctgggccctcgccctggggctgggcctcatgttcgaggtcacgcacgccttccggtctcaagatgagttcctgtccagtctggagagctatgagatcgccttccccacccgcgtggaccacaacggggcactgctggccttctcgccacctcctccccggaggcagcgccgcggcacgggggccacagccgagtcccgcctcttctacaaagtggcctcgcccagcacccacttcctgctgaacctgacccgcagctcccgtctactggcagggcacgtctccgtggagtactggacacgggagggcctggcctggcagagggcggcccggccccactgcctctacgctggtcacctgcagggccaggccagcagctcccatgtggccatcagcacctgtggaggcctgcacggcctgatcgtggcagacgaggaagagtacctgattgagcccctgcacggtgggcccaagggttctcggagcccggaggaaagtggaccacatgtggtgtacaagcgttcctctctgcgtcacccccacctggacacagcctgtggagtgagagatgagaaaccgtggaaagggcggccatggtggctgcggaccttgaagccaccgcctgccaggcccctggggaatgaaacagagcgtggccagccaggcctgaagcgatcggtcagccgagagcgctacgtggagaccctggtggtggctgacaagatgatggtggcctatcacgggcgccgggatgtggagcagtatgtcctggccatcatgaacattgtcaggttgccaaacttttccaggactcgagtctgggaagcaccgttaacatcctcgtaactcgcctcatcctgctcacggaggaccagcccactctggagatcacccaccatgccgggaagtccctggacagcttctgtaagtggcagaaatccatcgtgaaccacagcggccatggcaatgccattccagagaacggtgtggctaaccatgacacagcagtgctcatcacacgctatgacatctgcatctacaagaacaaaccctgcggcacactaggcctggccccggtgggcggaatgtgtgagcgcgagagaagctgcagcgtcaatgaggacattggcctggccacagcgttcaccattgcccacgagatcgggcacacattcggcatgaaccatgacggcgtgggaaacagctgtggggcccgtggtcaggacccagccaagctcatggctgcccacattaccatgaagaccaacccattcgtgtggtcatcctgcagccgtgactacatcaccagctttctagactcgggcctggggctctgcctgaacaaccggccccccagacaggactttgtgtacccgacagtggcaccgggccaagcctacgatgcagatgagcaatgccgctttcagcatggagtcaaatcgcgtcagtgtaaatacggggaggtctgcagcgagctgtggtgtctgagcaagagcaaccggtgcatcaccaacagcatcccggccgccgagggcacgctgtgccagacgcacaccatcgacaaggggtggtgctacaaacgggtctgtgtcccctttgggtcgcgcccagagggtgtggacggagcctgggggccgtggactccatggggcgactgcagccggacctgtggcggcggcgtgtcctcttctagccgtcactgcgacagccccaggccaaccatcgggggcaagtactgtctgggtgagagaaggcggcaccgctcctgcaacacggatgactgtccccctggctcccaggacttcagagaagtgcagtgttctgaatttgacagcatccctttccgtgggaaattctacaagtggaaaacgtaccggggagggggcgtgaaggcctgctcgctcacgtgcctagcggaaggcttcaacttctacacggagagggcggcagccgtggtggacgggacaccctgccgtccagacacggtggacatttgcgtcagtggcgaatgcaagcacgtgggctgcgaccgagtcctgggctccgacctgcgggaggacaagtgccgagtgtgtggcggtgacggcagtgcctgcgagaccatcgagggcgtcttcagcccagcctcacctggggccgggtacgaggatgtcgtctggattcccaaaggctccgtccacatcttcatccaggatctgaacctctctctcagtcacttggccctgaagggagaccaggagtccctgctgctggaggggctgcctgggaccccccagccccaccgtctgcctctagctgggaccacctttcaactgcgacaggggccagaccaggtccagagcctcgaagccctgggaccgattaatgcatctctcatcgtcatggtgctggcccggaccgagctgcctgccctccgctaccgcttcaatgcccccatcgcccgtgactcgctgcccccctactcctggcactatgcgccctggaccaagtgctcggcccagtgtgcaggcggtagccaggtgcaggcggtggagtgccgcaaccagctggacagctccgcggtcgccccccactactgcagtgcccacagcaagctgcccaaaaggcagcgcgcctgcaacacggagccttgccctccagactgggttgtagggaactggtcgctctgcagccgcagctgcgatgcaggcgtgcgcagccgctcggtcgtgtgccagcgccgcgtctctgccgcggaggagaaggcgctggacgacagcgcatgcccgcagccgcgcccacctgtactggaggcctgccacggccccacttgccctccggagtgggcggccctcgactggtctgaggtcagccgcccccttccttcgcgcccactgggatgcccaggtggggtgtccacggagacgcctctgcgcggtctccaggttagctgtcccctcctcacttcgcactggggcagcaccctgagcacgaaacgccccttccaactgcagtgcacccccagctgcgggccgggcctccgccaccgcgtggtcctttgcaagagcgcagaccaccgcgccacgctgcccccggcgcactgctcacccgccgccaagccaccggccaccatgcgctgcaacttgcgccgctgccccccggcccgctgggtggctggcgagtggggtgagtgctctgcacagtgcggcgtcgggcagcggcagcgctcggtgcgctgcaccagccacacgggccaggcgtcgcacgagtgcacggaggccct

SEQ ID NO: 104714 - DNA, 3333 bp, Homo sapiens
  Payload ID: 558
  Gene Symbol: ADAMTS10
  Gene Name: ADAM metallopeptidase with thrombospondin type 1 motif, 10
  ENST ID: ENST00000593913
  CDS Start-End: 70-939
aggggaggcggcactgtgggggctgccggcagccggggctggggagagacatgtggacacgtggcctctatggctcccgcctgccagatcctccgctgggccctcgccctggggctgggcctcatgttcgaggtcacgcacgccttccggtctcaagatgagttcctgtccagtctggagagctatgagatcgccttccccacccgcgtggaccacaacggggcactgctggccttctcgccacctcctccccggaggcagcgccgcggcacgggggccacagccgagtcccgcctcttctacaaagtggcctcgcccagcacccacttcctgctgaacctgacccgcagctcccgtctactggcagggcacgtctccgtggagtactggacacgggagggcctggcctggcagagggcggcccggccccactgcctctacgctggtcacctgcagggccaggccagcagctcccatgtggccatcagcacctgtggaggcctgcacggcctgatcgtggcagacgaggaagagtacctgattgagcccctgcacggtgggcccaagggttctcggagcccggaggaaagtggaccacatgtggtgtacaagcgttcctctctgcgtcacccccacctggacacagcctgtggagtgagagatgagaaaccgtggaaagggcggccatggtggctgcggaccttgaagccaccgcctgccaggcccctggggaatgaaacagagcgtggccagccaggcctgaagcgatcggtcagccgagagcgctacgtggagaccctggtggtggctgacaagatgatggtggcctatcacgggcgccgggatgtggagcagtatgtcctggccatcatgaacattgtcaggttgccaaacttttccaggactcgagtctgggaagcaccgttaacatcctcgtaactcgcctcatcctgctcacggaggaccagcccactctggagatcacccaccatgccgggaagtccctggacagcttctattcggcatgaaccatgacggcgtgggaaacagctgtggggcccgtggtcaggacccagccaagctcatggctgcccacattaccatgaagaccaacccattcgtgtggtcatcctgcagccgtgactacatcaccagctttctagactcgggcctggggctctgcctgaacaaccggccccccagacaggactttgtgtacccgacagtggcaccgggccaagcctacgatgcagatgagcaatgccgctttcagcatggagtcaaatcgcgtcagtgaggtctgcagcgagctgtggtgtctgagcaagagcaaccggtgcatcaccaacagcatcccggccgccgagggcacgctgtgccagacgcacaccatcgacaaggggtggtgctacaaacgggtctgtgtcccctttgggtcgcgcccagagggtgtggacggagcctgggggccgtggactccatggggcgactgcagccggacctgtggcggcggcgtgtcctcttctagccgtcactgcgacagccccaggccaaccatcgggggcaagtactgtctgggtgagagaaggcggcaccgctcctgcaacacggatgactgtccccctggctcccaggacttcagagaagtgcagtgttctgaatttgacagcatccctttccgtgggaaattctacaagtggaaaacgtaccggggagggggcgtgaaggcctgctcgctcacgtgcctagcggaaggcttcaacttctacacggagagggcggcagccgtggtggacgggacaccctgccgtccagacacggtggacatttgcgtcagtggcgaatgcaagcacgtgggctgcgaccgagtcctgggctccgacctgcgggaggacaagtgccgagtgtgtggcggtgacggcagtgcctgcgagaccatcgagggcgtcttcagcccagcctcacctggggccgggtacgaggatgtcgtctggattcccaaaggctccgtccacatcttcatccaggatctgaacctctctctcagtcacttggccctgaagggagaccaggagtccctgctgctggaggggctgcctgggaccccccagccccaccgtctgcctctagctgggaccacctttcaactgcgacaggggccagaccaggtccagagcctcgaagccctgggaccgattaatgcatctctcatcgtcatggtgctggcccggaccgagctgcctgccctccgctaccgcttcaatgcccccatcgcccgtgactcgctgcccccctactcctggcactatgcgccctggaccaagtgctcggcccagtgtgcaggcggtagccaggtgcaggcggtggagtgccgcaaccagctggacagctccgcggtcgccccccactactgcagtgcccacagcaagctgcccaaaaggcagcgcgcctgcaacacggagccttgccctccagactgggttgtagggaactggtcgctctgcagccgcagctgcgatgcaggcgtgcgcagccgctcggtcgtgtgccagcgccgcgtctctgccgcggaggagaaggcgctggacgacagcgcatgcccgcagccgcgcccacctgtactggaggcctgccacggccccacttgccctccggagtgggcggccctcgactggtctgagtgcacccccagctgcgggccgggcctccgccaccgcgtggtcctttgcaagagcgcagaccaccgcgccacgctgcccccggcgcactgctcacccgccgccaagccaccggccaccatgcgctgcaacttgcgccgctgccccccggcccgctgggtggctggcgagtggggtgagtgctctgcacagtgcggcgtcgggcagcggcagcgctcggtgcgctgcaccagccacacgggccaggcgtcgcacgagtgcacggaggccctgcggccgcccaccacgcagcagtgtgaggccaagtgcgacagcccaacccccggggacggccctgaagagtgcaaggatgtgaacaaggtcgcctactgccccctggtgctcaaatttcagttctgcagccgagcctacttccgccagatgtgctgcaaaacctgccatggccactagggggcgcgcggcacccggagccacagctggcggggtctccgccgccagccctgcagcgggccggccagagggggccccgggggggcgggaactgggagggaagggtgagacggagccggaagttatttattgggaacccctgcagggccctggctggggggatggagaggggctggctatccccccagagcccctcttcagcatc

SEQ ID NO: 104715 - DNA, 2458 bp, Homo sapiens
  Payload ID: 558
  Gene Symbol: ADAMTS10
  Gene Name: ADAM metallopeptidase with thrombospondin type 1 motif, 10
  Uniprot ID: Q9H324
  ENST ID: ENST00000595838
  CDS Start-End: 35-1807
atctctggctggggcctggagtggggaacggtgcatggggccgacgagtgtcctccgggctggactcactccttcctgtctccccccacccagtggtgctacaaacgggtctgtgtcccctttgggtcgcgcccagagggtgtggacggagcctgggggccgtggactccatggggcgactgcagccggacctgtggcggcggcgtgtcctcttctagccgtcactgcgacagccccaggccaaccatcgggggcaagtactgtctgggtgagagaaggcggcaccgctcctgcaacacggatgactgtccccctggctcccaggacttcagagaagtgcagtgttctgaatttgacagcatccctttccgtgggaaattctacaagtggaaaacgtaccggggaggcctgctcgctcacgtgcctagcggaaggcttcaacttctacacggagagggcggcagccgtggtggacgggacaccctgccgtccagacacggtggacatttgcgtcagtggcgaatgcaagcacgtgggctgcgaccgagtcctgggctccgacctgcgggaggacaagtgccgagtgtgtggcggtgacggcagtgcctgcgagaccatcgagggcgtcttcagcccagcctcacctggggccgggtacgaggatgtcgtctggattcccaaaggctccgtccacatcttcatccaggatctgaacctctctctcagtcacttggccctgaagggagaccaggagtccctgctgctggaggggctgcctgggaccccccagccccaccgtctgcctctagctgggaccacctttcaactgcgacaggggccagaccaggtccagagcctcgaagccctgggaccgattaatgcatctctcatcgtcatggtgctggcccggaccgagctgcctgccctccgctaccgcttcaatgcccccatcgcccgtgactcgctgcccccctactcctggcactatgcgccctggaccaagtgctcggcccagtgtgcaggcggtagccaggtgcaggcggtggagtgccgcaaccagctggacagctccgcggtcgccccccactactgcagtgcccacagcaagctgcccaaaaggcagcgcgcctgcaacacggagccttgccctccagactgggttgtagggaactggtcgctctgcagccgcagctgcgatgcaggcgtgcgcagccgctcggtcgtgtgccagcgccgcgtctctgccgcggaggagaaggcgctggacgacagcgcatgcccgcagccgcgcccacctgtactggaggcctgccacggccccacttgccctccggagtgggcggccctcgactggtctgagtgcacccccagctgcgggccgggcctccgccaccgcgtggtcctttgcaagagcgcagaccaccgcgccacgctgcccccggcgcactgctcacccgccgccaagccaccggccaccatgcgctgcaacttgcgccgctgccccccggcccgctgggtggctggcgagtggggtgagtgctctgcacagtgcggcgtcgggcagcggcagcgctcggtgcgctgcaccagccacacgggccaggcgtcgcacgagtgcacggaggccctgcggccgcccaccacgcagcagtgtgaggccaagtgcgacagcccaacccccggggacggccctgaagagtgcaaggatgtgaacaaggtcgcctactgccccctggtgctcaaatttcagttctgcagccgagcctacttccgccagatgtgctgcaaaacctgccatggccactagggggcgcgcggcacccggagccacagctggcggggtctccgccgccagccctgcagcgggccggccagagggggccccgggggggcgggaactgggagggaagggtgagacggagccggaagttatttattgggaacccctgcagggccctggctggggggatggagaggggctggctatccccccagagcccctcttcagcatccgccccttccagttcacatagtgagaccccccctccagggtgggtctggggaggggacagctgttcaccccagcaccctttgaacccacccttagggagtccccaacactccccccctcctttgatcggaatatgtactgtgaagagtaggggtggggaggtggtctgccggtgccctgccccccagcactgccctacccctccactccgagctgggggggaatctgtgtctgctatgggaggggggggggtagcaccacctccctgacaccctcccctgacctgactagggggaggatccaccccaacctctgccctgcccgccccaggggcaccccgacatccaggccaccccctcatggtgctacagaccctgccctggggcccacacactcctgccaggaagccctacatcaataaagttctgtcttgtgtagatttctacg

SEQ ID NO: 104716 - DNA, 3749 bp, Homo sapiens
  Payload ID: 558
  Gene Symbol: ADAMTS10
  Gene Name: ADAM metallopeptidase with thrombospondin type 1 motif, 10
  ENST ID: ENST00000597188
  CDS Start-End: 272-3583
cgcgcggggcggcgagacagcggcggcgacggcgcggaggccccgggcgcggcgcaggctccaaagaagaagaaaccaaggcccagagagggaggcccaggtgcagggagcaggcgagggaaggatccgtacaggggcccaacactactccaccaaccgaagcccccaaaaggagcccggtgatgctgcgaaggctgtgaacaggggaggcggcactgtgggggctgccggcagccggggctggggagagacatgtggacacgtggcctctatggctcccgcctgccagatcctccgctgggccctcgccctggggctgggcctcatgttcgaggtcacgcacgccttccggtctcaagatgagttcctgtccagtctggagagctatgagatcgccttccccacccgcgtggaccacaacggggcactgctggccttctcgccacctcctccccggaggcagcgccgcggcacgggggccacagccgagtcccgcctcttctacaaagtggcctcgcccagcacccacttcctgctgaacctgacccgcagctcccgtctactggcagggcacgtctccgtggagtactggacacgggagggcctggcctggcagagggcggcccggccccactgcctctacgctggtcacctgcagggccaggccagcagctcccatgtggccatcagcacctgtggaggcctgcacggcctgatcgtggcagacgaggaagagtacctgattgagcccctgcacggtgggcccaagggttctcggagcccggaggaaagtggaccacatgtggtgtacaagcgttcctctctgcgtcacccccacctggacacagcctgtggagtgagagatgagaaaccgtggaaagggcggccatggtggctgcggaccttgaagccaccgcctgccaggcccctggggaatgaaacagagcgtggccagccaggcctgaagcgatcggtcagccgagagcgctacgtggagaccctggtggtggctgacaagatgatggtggcctatcacgggcgccgggatgtggagcagtatgtcctggccatcatgaacattgttgccaaacttttccaggactcgagtctgggaagcaccgttaacatcctcgtaactcgcctcatcctgctcacggaggaccagcccactctggagatcacccaccatgccgggaagtccctggacagcttctgtaagtggcagaaatccatcgtgaaccacagcggccatggcaatgccattccagagaacggtgtggctaaccatgacacagcagtgctcatcacacgctatgacatctgcatctacaagaacaaaccctgcggcacactaggcctggccccggtgggcggaatgtgtgagcgcgagagaagctgcagcgtcaatgaggacattggcctggccacagcgttcaccattgcccacgagatcgggcacacattcggcatgaaccatgacggcgtgggaaacagctgtggggcccgtggtcaggacccagccaagctcatggctgcccacattaccatgaagaccaacccattcgtgtggtcatcctgcagccgtgactacatcaccagctttctagactcgggcctggggctctgcctgaacaaccggccccccagacaggactttgtgtacccgacagtggcaccgggccaagcctacgatgcagatgagcaatgccgctttcagcatggagtcaaatcgcgtcagtgtaaatacggggaggtctgcagcgagctgtggtgtctgagcaagagcaaccggtgcatcaccaacagcatcccggccgccgagggcacgctgtgccagacgcacaccatcgacaaggggtggtgctacaaacgggtctgtgtcccctttgggtcgcgcccagagggtgtggacggagcctgggggccgtggactccatggggcgactgcagccggacctgtggcggcggcgtgtcctcttctagccgtcactgcgacagccccaggccaaccatcgggggcaagtactgtctgggtgagagaaggcggcaccgctcctgcaacacggatgactgtccccctggctcccaggacttcagagaagtgcagtgttctgaatttgacagcatccctttccgtgggaaattctacaagtggaaaacgtaccggggagggggcgtgaaggcctgctcgctcacgtgcctagcggaaggcttcaacttctacacggagagggcggcagccgtggtggacgggacaccctgccgtccagacacggtggacatttgcgtcagtggcgaatgcaagcacgtgggctgcgaccgagtcctgggctccgacctgcgggaggacaagtgccgagtgtgtggcggtgacggcagtgcctgcgagaccatcgagggcgtcttcagcccagcctcacctggggccgggtacgaggatgtcgtctggattcccaaaggctccgtccacatcttcatccaggatctgaacctctctctcagtcacttggccctgaagggagaccaggagtccctgctgctggaggggctgcctgggaccccccagccccaccgtctgcctctagctgggaccacctttcaactgcgacaggggccagaccaggtccagagcctcgaagccctgggaccgattaatgcatctctcatcgtcatggtgctggcccggaccgagctgcctgccctccgctaccgcttcaatgcccccatcgcccgtgactcgctgcccccctactcctggcactatgcgccctggaccaagtgctcggcccagtgtgcaggcggtagccaggtgcaggcggtggagtgccgcaaccagctggacagctccgcggtcgccccccactactgcagtgcccacagcaagctgcccaaaaggcagcgcgcctgcaacacggagccttgccctccagactgggttgtagggaactggtcgctctgcagccgcagctgcgatgcaggcgtgcgcagccgctcggtcgtgtgccagcgccgcgtctctgccgcggaggagaaggcgctggacgacagcgcatgcccgcagccgcgcccacctgtactggaggcctgccacggccccacttgccctccggagtgggcggccctcgactggtctgagtgcacccccagctgcgggccgggcctccgccaccgcgtggtcctttgcaagagcgcagaccaccgcgccacgctgcccccggcgcactgctcacccgccgccaagccaccggccaccatgcgctgcaacttgcgccgctgccccccggcccgctgggtggctggcgagtggggtgagtgctctgcacagtgcggcgtcgggcagcggcagcgctcggtgcgctgcaccagccacacgggccaggcgtcgcacgagtgcacggaggccctgcggccgcccaccacgcagcagtgtgaggccaagtgcgacagcccaacccccggggacggccctgaagagtgcaaggatgtgaacaaggtcgcctactgccccctggtgctcaaatttcagttctgcagccgagcctacttccgccagatgtgctgcaaaacctgccatggccactagggggcgcgcggcacccggagccacagctggcggggtctccgccgccagccctgcagcgggccggccagagggggccccgggggggcgggaactgggagggaagggtgagacggagccggaagttatttattgggaacccctgcagggccctggctggggggatgga

SEQ ID NO: 104717 - DNA, 4622 bp, Homo sapiens
  Payload ID: 559
  Gene Symbol: ADAMTS12
  Gene Name: ADAM metallopeptidase with thrombospondin type 1 motif, 12
  Uniprot ID: P58397
  ENST ID: ENST00000352040
  CDS Start-End: 86-4615
tcctgctgggccacaggcgagcgctttatttctggagctgagggctaaaacttttttgacttttcttctcctcaacatctgaatcatgccatgtgcccagaggagctggcttgcaaacctttccgtggtggctcagctccttaactttggggcgctttgctatgggagacagcctcagccaggcccggttcgcttcccggacaggaggcaagagcattttatcaagggcctgccagaataccacgtggtgggtccagtccgagtagatgccagtgggcattttttgtcatatggcttgcactatcccatcacgagcagcaggaggaagagagatttggatggctcagaggactgggtgtactacagaatttctcacgaggagaaggacctgttttttaacttgacggtcaatcaaggatttctttccaatagctacatcatggagaagagatatgggaacctctcccatgttaagatgatggcttcctctgcccccctctgccatctcagtggcacggttctacagcagggcaccagagttgggacggcagccctcagtgcctgccatggactgactggatttttccaactaccacatggagactttttcattgaacccgtgaagaagcatccactggttgagggagggtaccacccgcacatcgtttacaggaggcagaaagttccagaaaccaaggagccaacctgtggattaaaggacagtgttaacatctcccagaagcaagagctatggcgggagaagtgggagaggcacaacttgccaagcagaagcctctctcggcgttccatcagcaaggagagatgggtggagacactggtggtggccgacacaaagatgattgaataccatgggagtgagaatgtggagtcctacatcctcaccatcatgaacatggtcactgggttgttccataacccaagcattggcaatgcaattcacattgttgtggttcggctcattctactcgaagaagaagagcaaggactgaaaatagttcaccatgcagaaaagacactgtctagcttctgcaagtggcagaagagtatcaatcccaagagtgacctcaatcctgttcatcacgacgtggctgtccttctcaccagaaaggacatctgtgctggtttcaatcgcccctgcgagaccctgggcctgtctcacctttcaggaatgtgtcagcctcaccgcagttgtaacatcaatgaagattcgggactccctctggctttcacaattgcccatgagctaggacacagcttcggcatccagcatgatgggaaagaaaatgactgtgagcctgtgggcagacatccgtacatcatgtcccgccagctccagtacgatcccactccgctgacatggtccaagtgcagcgaggagtacatcacccgcttcttggaccgaggctgggggttctgtcttgatgacatacctaaaaagaaaggcttgaagtccaaggtcattgcccccggagtgatctatgatgttcaccaccagtgccagctacaatatggacccaatgctaccttctgccaggaagtagaaaacgtctgccagacactgtggtgctccgtgaagggcttttgtcgctctaagctggacgctgctgcagatggaactcaatgtggtgagaagaagtggtgtatggcaggcaagtgcatcacagtggggaagaaaccagagagcattcctggaggctggggccgctggtcaccctggtcccactgttccaggacctgtggggctggagtccagagcgcagagaggctctgcaacaaccccgagccaaagtttggagggaaatattgcactggagaaagaaaacgctatcgcttgtgcaacgtccacccctgtcgctcagaggcaccaacatttcggcagatgcagtgcagtgaatttgacactgttccctacaagaatgaactctaccactggtttcccatttttaacccaggttatgttgacattgggctcattccaaaaggagcaagggacataagagtgatggaaattgagggagctggaaacttcctggccatcaggagtgaagatcctgaaaaatattacctgaatggagggtttattatccagtggaacgggaactataagctggcagggactgtctttcagtatgacaggaaaggagacctggaaaagctgatggccacaggtcccaccaatgagtctgtgtggatccagcttctattccaggtgactaaccctggcatcaagtatgagtacacaatccagaaagatggccttgacaatgatgttgagcagcagatgtacttctggcagtacggccactggacagagtgcagtgtgacctgcgggacaggtatccgccgccaaactgcccattgcataaagaagggccgcgggatggtgaaagctacattctgtgacccagaaacacagcccaatgggagacagaagaagtgccatgaaaaggcttgtccacccaggtggtgggcaggggagtgggaagcatgctcggcgacatgcgggccccacggggagaagaagcgaaccgtgctgtgcatccagaccatggtctctgacgagcaggctctcccgcccacagactgccagcacctgctgaagcccaagaccctcctttcctgcaacagagacatcctgtgcccctcggactggacagtgggcaactggagtgagtgttctgtttcctgtggtggtggagtgcggattcgcagtgtcacatgtgccaagaaccatgatgaaccttgcgatgtgacaaggaaacccaacagccgagctctgtgtggcctccagcaatgcccttctagccggagagttctgaaaccaaacaaaggcactatttccaatggaaaaaacccaccaacactaaagcccgtccctccacctacatccaggcccagaatgctgaccacacccacagggcctgagtctatgagcacaagcactccagcaatcagcagccctagtcctaccacagcctccaaagaaggagacctgggtgggaaacagtggcaagatagctcaacccaacctgagctgagctctcgctatctcatttccactggaagcacttcccagcccatcctcacttcccaatccttgagcattcagccaagtgaggaaaatgtttccagttcagatactggtcctacctcggagggaggccttgtagctacaacaacaagtggttctggcttgtcatcttcccgcaaccctatcacttggcctgtgactccattttacaataccttgaccaaaggtccagaaatggagattcacagtggctcaggggaagaaagagaacagcctgaggacaaagatgaaagcaatcctgtaatatggaccaagatcagagtacctggaaatgacgctccagtggaaagtacagaaatgccacttgcacctccactaacaccagatctcagcagggagtcctggtggccacccttcagcacagtaatggaaggactgctccccagccaaaggcccactacttccgaaactgggacacccagagttgaggggatggttactgaaaagccagccaacactctgctccctctgggaggagaccaccagccagaaccctcaggaaagacggcaaaccgtaaccacctgaaacttccaaacaacatgaaccaaacaaaaagttctgaaccagtcctgactgaggaggatgcaacaagtctgattactgagggctttttgctaaatgcctccaattacaagcagctcacaaacggccacggctctgcacactggatcgtcggaaactggagcgagtgctccaccacatgtggcctgggggcctactggagaagggtggagtgcagcacccagatggattctgactgtgcggccatccagagacctgaccctgcaaaaagatgccacctccgtccctgtgctggctggaaagtgggaaactggagcaagtgctccagaaactgcagtgggggcttcaagatacgcgagattcagtgcgtggacagccgggaccaccggaacctgaggccatttcactgccagttcctggccggcattcctcccccattgagcatgagctgtaacccggagccctgtgaggcgtggcaggtggagccttggagccagtgctccaggtcctgtggaggtggagttcaggagagaggagtgttctgtccaggaggcctctgtgattggacaaaaagacccacatccaccatgtcttgcaatgagcacctgtgctgtcactgggccactgggaactgggacctgtgttccacttcctgtggaggtggctttcagaagaggactgtccaatgtgtgccctcagagggcaataaaactgaagaccaagaccaatgtctatgtgatcacaaacccagacctccagaattcaaaaaatgcaaccagcaggcctgcaagaaaagtgccgatttactttgcactaaggacaaactgtcagccagtttctgccagacactgaaagccatgaagaaatgttctgtgcccaccgtgagggctgagtgctgcttctcgtgtccccagacacacatcacacacacccaaaggcaaagaaggcaacggttgctccaaaagtcaaaagaactctaagcccaaa

SEQ ID NO: 104718 - DNA, 1003 bp, Homo sapiens
  Payload ID: 559
  Gene Symbol: ADAMTS12
  Gene Name: ADAM metallopeptidase with thrombospondin type 1 motif, 12
  ENST ID: ENST00000515401
  CDS Start-End: 164-862
gcttaaaaaagcacagggagatcgcgggcagctttgcagtcgctgccttctcgcgcctgaccatgcacccctgcatcttcctgctgggccacaggcgagcgctttatttctggagctgagggctaaaacttttttgacttttcttctcctcaacatctgaatcatgccatgtgcccagaggagctggcttgcaaacctttccgtggtggctcagctccttaactttggggcgctttgctatgggagacagcctcagccaggcccggttcgcttcccggacaggaggcaagagcattttatcaagggcctgccagaataccacgtggtgggtccagtccgagtagatgccagtgggcattttttgtcatatggcttgcactatcccatcacgagcagcaggaggaagagagatttggatggctcagaggactgggtgtactacagaatttctcacgaggagaaggacctgttttttaacttgacggtcaatcaaggatttctttccaatagctacatcatggagaagagatatgggaacctctcccatgttaagatgatggcttcctctgcccccctctgccatctcagtggcacggttctacagcagggcaccagagttgggacggcagccctcagtgcctgccatggactgactggatttttccaactaccacatggagactttttcattgaacccgtgaagaagcatccactggttgagggagggtaccacccgcacatcgtttacaggaggcagaaagttccagaaaccaaggagccaacctgtggattaaagggtattgtgactcacatgtcctcctgggttgaagaatctgttttgttcttttggttgttttattaaaacatgacctattcttactcaagtctcttatctcctctgtattcttttttttttaatatcttcatgacattcaaatctcttctgtattctcttgccagaaagtgtacattctttttgcttgtataaaccctttcacttgtc

SEQ ID NO: 104719 - DNA, 8774 bp, Homo sapiens
  Payload ID: 559
  Gene Symbol: ADAMTS12
  Gene Name: ADAM metallopeptidase with thrombospondin type 1 motif, 12
  Uniprot ID: P58397
  ENST ID: ENST00000504830
  CDS Start-End: 337-5121
gagcgggcgggctgcgaggccgcggggcatgcgggaggcggaggggtggggaccggggtgggctgcgccctcccgctctggcccattccacaccccgccgaaagcggacactgtcagctgaatcactccccttttaggaggagggaggggaaaaaggtgtctagctcctttctgcttaaaaaagcacagggagatcgcgggcagctttgcagtcgctgccttctcgcgcctgaccatgcacccctgcatcttcctgctgggccacaggcgagcgctttatttctggagctgagggctaaaacttttttgacttttcttctcctcaacatctgaatcatgccatgtgcccagaggagctggcttgcaaacctttccgtggtggctcagctccttaactttggggcgctttgctatgggagacagcctcagccaggcccggttcgcttcccggacaggaggcaagagcattttatcaagggcctgccagaataccacgtggtgggtccagtccgagtagatgccagtgggcattttttgtcatatggcttgcactatcccatcacgagcagcaggaggaagagagatttggatggctcagaggactgggtgtactacagaatttctcacgaggagaaggacctgttttttaacttgacggtcaatcaaggatttctttccaatagctacatcatggagaagagatatgggaacctctcccatgttaagatgatggcttcctctgcccccctctgccatctcagtggcacggttctacagcagggcaccagagttgggacggcagccctcagtgcctgccatggactgactggatttttccaactaccacatggagactttttcattgaacccgtgaagaagcatccactggttgagggagggtaccacccgcacatcgtttacaggaggcagaaagttccagaaaccaaggagccaacctgtggattaaaggacagtgttaacatctcccagaagcaagagctatggcgggagaagtgggagaggcacaacttgccaagcagaagcctctctcggcgttccatcagcaaggagagatgggtggagacactggtggtggccgacacaaagatgattgaataccatgggagtgagaatgtggagtcctacatcctcaccatcatgaacatggtcactgggttgttccataacccaagcattggcaatgcaattcacattgttgtggttcggctcattctactcgaagaagaagagcaaggactgaaaatagttcaccatgcagaaaagacactgtctagcttctgcaagtggcagaagagtatcaatcccaagagtgacctcaatcctgttcatcacgacgtggctgtccttctcaccagaaaggacatctgtgctggtttcaatcgcccctgcgagaccctgggcctgtctcacctttcaggaatgtgtcagcctcaccgcagttgtaacatcaatgaagattcgggactccctctggctttcacaattgcccatgagctaggacacagcttcggcatccagcatgatgggaaagaaaatgactgtgagcctgtgggcagacatccgtacatcatgtcccgccagctccagtacgatcccactccgctgacatggtccaagtgcagcgaggagtacatcacccgcttcttggaccgaggctgggggttctgtcttgatgacatacctaaaaagaaaggcttgaagtccaaggtcattgcccccggagtgatctatgatgttcaccaccagtgccagctacaatatggacccaatgctaccttctgccaggaagtagaaaacgtctgccagacactgtggtgctccgtgaagggcttttgtcgctctaagctggacgctgctgcagatggaactcaatgtggtgagaagaagtggtgtatggcaggcaagtgcatcacagtggggaagaaaccagagagcattcctggaggctggggccgctggtcaccctggtcccactgttccaggacctgtggggctggagtccagagcgcagagaggctctgcaacaaccccgagccaaagtttggagggaaatattgcactggagaaagaaaacgctatcgcttgtgcaacgtccacccctgtcgctcagaggcaccaacatttcggcagatgcagtgcagtgaatttgacactgttccctacaagaatgaactctaccactggtttcccatttttaacccagcacatccttgtgagctctactgccgacccatagatggccagttttctgagaaaatgctggatgctgtcattgatggtaccccttgctttgaaggcggcaacagcagaaatgtctgtattaatggcatatgtaagatggttggctgtgactatgagatcgattccaatgccaccgaggatcgctgcggtgtgtgcctgggagatggctcttcctgccagactgtgagaaagatgtttaagcagaaggaaggatctggttatgttgacattgggctcattccaaaaggagcaagggacataagagtgatggaaattgagggagctggaaacttcctggccatcaggagtgaagatcctgaaaaatattacctgaatggagggtttattatccagtggaacgggaactataagctggcagggactgtctttcagtatgacaggaaaggagacctggaaaagctgatggccacaggtcccaccaatgagtctgtgtggatccagcttctattccaggtgactaaccctggcatcaagtatgagtacacaatccagaaagatggccttgacaatgatgttgagcagcagatgtacttctggcagtacggccactggacagagtgcagtgtgacctgcgggacaggtatccgccgccaaactgcccattgcataaagaagggccgcgggatggtgaaagctacattctgtgacccagaaacacagcccaatgggagacagaagaagtgccatgaaaaggcttgtccacccaggtggtgggcaggggagtgggaagcatgctcggcgacatgcgggccccacggggagaagaagcgaaccgtgctgtgcatccagaccatggtctctgacgagcaggctctcccgcccacagactgccagcacctgctgaagcccaagaccctcctttcctgcaacagagacatcctgtgcccctcggactggacagtgggcaactggagtgagtgttctgtttcctgtggtggtggagtgcggattcgcagtgtcacatgtgccaagaaccatgatgaaccttgcgatgtgacaaggaaacccaacagccgagctctgtgtggcctccagcaatgcccttctagccggagagttctgaaaccaaacaaaggcactatttccaatggaaaaaacccaccaacactaaagcccgtccctccacctacatccaggcccagaatgctgaccacacccacagggcctgagtctatgagcacaagcactccagcaatcagcagccctagtcctaccacagcctccaaagaaggagacctgggtgggaaacagtggcaagatagctcaacccaacctgagctgagctctcgctatctcatttccactggaagcacttcccagcccatcctcacttcccaatccttgagcattcagccaagtgaggaaaatgtttccagttcagatactggtcctacctcggagggaggccttgtagctacaacaacaagtggttctggcttgtcatcttcccgcaaccctatcacttggcctgtgactccattttacaataccttgaccaaaggtccagaaatggagattcacagtggctcaggggaagaaagagaacagcctgaggacaaagatgaaagcaatcctgtaatatggaccaagatcagagtacctggaaatgacgctccagtggaaagtacagaaatgccacttgcacctccactaacaccagatctcagcagggagtcctggtggccacccttcagcacagtaatggaaggactgctccccagccaaaggcccactacttccgaaactgggacacccagagttgaggggatggttactgaaaagccagccaacactctgctccctctgggaggagaccaccagccagaaccctcaggaaagacggcaaaccgtaaccacctgaaacttccaaacaacatgaaccaaacaaaaagttctgaaccagtcctgactgaggaggatgcaacaagtctgattactgagggctttttgctaaatgcctccaattacaagcagctcacaaacggccacggctctgcacactggatcgtcggaaactggagcgagtgctccaccacatgtggcctgggggcctactggagaagggtggagtgcagcacccagatggattctgactgtgcggccatccagagacctgaccctgcaaaaagatgccacctccgtccctgtgctggctggaaagtgggaaactggagcaagtgctccagaaactgcagtgggggcttcaagatacgcgagattcagtgcgtggacagccgggaccaccggaacctgaggccatttcactgccagttcctggccggcattcctcccccattgagcatgagctgtaacccggagccctgtgaggcgtggcaggtggagccttggagccagtgctccaggtcctgtggaggtggagttcaggagagaggagtgttctgtccaggaggcctctgtgattggacaaaaagacccacatccaccatgtcttgcaatgagcacctgtgctgtcactgggccactgggaactgggacctgtgttccacttcctgtggaggtggctttcagaagaggactgtccaatgtgtgccctcagagggcaataaaactgaagaccaagaccaatgtctatgtgatcacaaacccagacctccagaattcaaaaaatgcaaccagcaggcctgcaagaaaagtgccgatttactttgcactaaggacaaactgtcagccagtttctgccagacactgaaagccatgaagaaatgttctgtgcccaccgtgagggctgagtgctgcttctcgtgtccccagacacacatcacacacacccaaaggcaaagaaggcaacggttgctccaaaagtcaaaagaactctaagcccaaaaggaagccagcttccaccagactgcagcagcctgctgaccatgacatgctttagccctgggagctgcttcgttgaggttttgcttcatatatttcagattcagctttgggtcatgatgaaacaaaatccattgtgttcctctagccaccgaatgtccctcacaggaggcctaggctgccgtacttgctgctccctgataggaaggtgaaatagctaggagaatcaggcagcacctggtatcggctcctgggaaaggtgccaggttagacagatttgtgaaatactgtatttttgttctcccttaaagataaaaacaaagagaccagctatttccctgactacctcaagagtatcaggcaacacttacccaggggacaaataatcttcttaatttatcttgatgaatacctttcttttttttttcttgcctccctgcctggggcagctgctatttaaaatgtcacagcggagctttaggaacattcctttaattcatccaggcagaggactgctttcttcaccccatgttcaactagggcaggaagtgctggttacatccctcagtctcttcctccatccctgtagggctccatatctgggctgcttagagtctcctgccaaccttgggacactagactaagaggaaacaggcataagaaacacagcctaaggggtttaggtcacttacacagaaaacacttctggtttgaagagcatttctatgaaaactcgtaaaatgcaaatgagcagaaatcaatttcttaatattacagaaaaggaactgtgggcctttattcttcccactttcctggcaaatacacactcctttgcagaagggaaaatgtgtcttcctggctgacttcctcccatcctccagtccccacaggaggcctgagctcaggtcccaccatcgtcttgctgcaggggctgtatatgcaaagaccactatgaccagctctagggctgccacctgtcctcacctcttctcaggttggaaaatggaggttccatattaaaatatttcaaagaaccaggtaaattgtactaagtacaagaacatagtgcaaacttctaatctagagaaaaaacatttctaaaaagtaaggtaaaggggatctactcctcagtgtacccaatatgtagttagtcttaaagatcttttactttggggagaacaggtgaatcagggagtccaaagaaactgaaatgaaagttagaatgcttgttctggatgttcctacctcccaccagaagtcaaagtaggcttggtctcaaattcagagcaaatttctagacaaagtgatttctaagggaaggtacttacatgaactgaacccagagaaagagggtaagtgggtgggtggaggggcataagcttcaaatgaaagaagatatcagaaccaattcttgacagggagaaaggcaaggatgtggccttcatgtgatgggcagcatattttctgactcatgcacagatacacttaatactcctcatggaacacaatatcccacgtctccctttacctatccgttcagcagaatggtgctattaaaaaaatggtgctaatatctagatggtggcagaattaatgtaaacatagataggcatacaaatgggtaagtgtatgtgaaactctccatatacatcttctgttaaacatgtaacggtgttgctgaccaatgccagttttattgcttgggtaccttgaatttaagatttaatattatgtgctttttatttttttccaagccattaacgtgtattactctcatgaattcctgtgaaaaataaaacagtgggattgggatgaaattcaagatagaccagaaacaggaggaaagtacaaatgtttacctaaagccagagaatttatttctagatgataattacattattgtattctctgcctttaaacataaacattgctggccgatagcaatctctggtgaataatggttttcgaggagaggagacacttaaattgttagtgacatgagtggaggagaatctgatatttactaatgaggcagtttgcaaagactgtccctgaagtgtagtgtagtctttcagggggattcatttagtaagctagattgatttaacctggtactgtactagcatagggtcaaatacgtgtcatcagagacctgggtatgaccaggcttacaaaactcaggaacaaactcagattcctactgacctcaaccaactaaactaggccaaatttctccgtgtacaaaatggaccacgttatttacaatccacgtggtggagaagatggtagacatgtggagagagtttggccaggtgctccattctaggtctttttccagtttctcaaaggcagaacattggctcctaattatttgccatggatatttgcttcctgttctggagctatgttgtaagacagctgtgtgatgtccatcattcttgactccagaatgaagacagggcttgctgttttctgtcctgttggtatcatctgttgccttggcgatcactcagtgatgagtcgtcagtattttgacatgtcccagtgcttgctgtacaagaggggactcagatcaacaggaagactctgaagacaggaacctgcatggtatcttacatctttgatacttgggtgctgatatgaagcagagttgttgatttactttatctaggcccttctttcttctcacctggatcaagcaactgagaagtgtatcaggagacactggatacatatctctatgaaatagagagggccatcgcagggcctggtacttaactacattaacgttctaaaacccagtttggtttacgttgtctttcacagtagtatatttagctcttctctggaaagttgtgggttaatataattcttaaacatgaaaatgtaattaaacacaccacgagagaacaatattccaggagacttaatagtgattactttcttcaatcaggaaatcgtttcagtgcctcctttgtaggaatgctttgttttgtgatgggttttcttaaagaagagcacacctccgtccaatctcctgagacagccacgtctccgctgacatcccactgtgatgctttcagatagtcagtgaatgtttctgataaccttcatccagtatctgaaacacaatgtgagagattatattgttttagataataacatcccatttagttgactaaaatcttccaaactctgaaagctgcacactgctactccagagagtgcaggtcttagctcttctcctttctgacttcaagatgaatctttgggacgatgtttctggtgcttggtccacagtgattcacttttgaaggagaggccacatgacatgaactgcctggtgttacaacctagctaacatatttgatgctactcctgttgtctgtactgcttattcaagtagtattctaagttatgttactaaaaaacatggtgggtaaagcacaatcctacccatcattgtcctccaaaataattgtatgacatacacggcccagcccattgccctccctgcatctctgtgctgctttgccatttccccttctacccagcctcctcaaggggtaccttggtggatatttcagtacttaaaaccagactgtaatcataacctccctctgtgtggcatcaataaatagccaaactca

SEQ ID NO: 104720 - DNA, 825 bp, Homo sapiens
  Payload ID: 559
  Gene Symbol: ADAMTS12
  Gene Name: ADAM metallopeptidase with thrombospondin type 1 motif, 12
  ENST ID: ENST00000630002
  CDS Start-End: 337-825
gagcgggcgggctgcgaggccgcggggcatgcgggaggcggaggggtggggaccggggtgggctgcgccctcccgctctggcccattccacaccccgccgaaagcggacactgtcagctgaatcactccccttttaggaggagggaggggaaaaaggtgtctagctcctttctgcttaaaaaagcacagggagatcgcgggcagctttgcagtcgctgccttctcgcgcctgaccatgcacccctgcatcttcctgctgggccacaggcgagcgctttatttctggagctgagggctaaaacttttttgacttttcttctcctcaacatctgaatcatgccatgtgcccagaggagctggcttgcaaacctttccgtggtggctcagctccttaactttggggcgctttgctatgggagacagcctcagccaggcccggttcgcttcccggacaggaggcaagagcattttatcaagggcctgccagaataccacgtggtgggtccagtccgagtagatgccagtgggcattttttgtcatatggcttgcactatcccatcacgagcagcaggaggaagagagatttggatggctcagaggactgggtgtactacagaatttctcacgaggagaaggacctgttttttaacttgacggtcaatcaaggatttctttccaatagctacatcatggagaagagatatgggaacctctcccatgttaagatgatggcttcctctgcccccctctgccatctcagtggcacggttctacagcagggcaccagagttgggacggcagccctcagtgcctgccatggactg

SEQ ID NO: 104721 - DNA, 574 bp, Homo sapiens
  Payload ID: 559
  Gene Symbol: ADAMTS12
  Gene Name: ADAM metallopeptidase with thrombospondin type 1 motif, 12
  ENST ID: ENST00000630537
  CDS Start-End: 86-574
tcctgctgggccacaggcgagcgctttatttctggagctgagggctaaaacttttttgacttttcttctcctcaacatctgaatcatgccatgtgcccagaggagctggcttgcaaacctttccgtggtggctcagctccttaactttggggcgctttgctatgggagacagcctcagccaggcccggttcgcttcccggacaggaggcaagagcattttatcaagggcctgccagaataccacgtggtgggtccagtccgagtagatgccagtgggcattttttgtcatatggcttgcactatcccatcacgagcagcaggaggaagagagatttggatggctcagaggactgggtgtactacagaatttctcacgaggagaaggacctgttttttaacttgacggtcaatcaaggatttctttccaatagctacatcatggagaagagatatgggaacctctcccatgttaagatgatggcttcctctgcccccctctgccatctcagtggcacggttctacagcagggcaccagagttgggacggcagccctcagtgcctgccatggactg

SEQ ID NO: 104722 - DNA, 4442 bp, Homo sapiens; identical to SEQ ID NO: 104704
  Payload ID: 560
  Gene Symbol: ADAMTS13
  Gene Name: ADAM metallopeptidase with thrombospondin type 1 motif, 13
  Uniprot ID: Q76LX8
  ENST ID: ENST00000355699
  CDS Start-End: 121-4236

SEQ ID NO: 104723 - DNA, 4349 bp, Homo sapiens; identical to SEQ ID NO: 104700
  Payload ID: 560
  Gene Symbol: ADAMTS13
  Gene Name: ADAM metallopeptidase with thrombospondin type 1 motif, 13
  Uniprot ID: Q76LX8
  ENST ID: ENST00000356589
  CDS Start-End: 121-4143

SEQ ID NO: 104724 - DNA, 1074 bp, Homo sapiens; identical to SEQ ID NO: 104706
  Payload ID: 560
  Gene Symbol: ADAMTS13
  Gene Name: ADAM metallopeptidase with thrombospondin type 1 motif, 13
  ENST ID: ENST00000371910
  CDS Start-End: 197-868

SEQ ID NO: 104725 - DNA, 1155 bp, Homo sapiens; identical to SEQ ID NO: 104701
  Payload ID: 560
  Gene Symbol: ADAMTS13
  Gene Name: ADAM metallopeptidase with thrombospondin type 1 motif, 13
  ENST ID: ENST00000371911
  CDS Start-End: 121-1155

SEQ ID NO: 104726 - DNA, 4330 bp, Homo sapiens; identical to SEQ ID NO: 104705
  Payload ID: 560
  Gene Symbol: ADAMTS13
  Gene Name: ADAM metallopeptidase with thrombospondin type 1 motif, 13
  ENST ID: ENST00000371916
  CDS Start-End: 1189-2523

SEQ ID NO: 104727 - DNA, 4934 bp, Homo sapiens; identical to SEQ ID NO: 104702
  Payload ID: 560
  Gene Symbol: ADAMTS13
  Gene Name: ADAM metallopeptidase with thrombospondin type 1 motif, 13
  Uniprot ID: Q76LX8
  ENST ID: ENST00000371929
  CDS Start-End: 445-4728

SEQ ID NO: 104728 - DNA, 3022 bp, Homo sapiens; identical to SEQ ID NO: 104699
  Payload ID: 560
  Gene Symbol: ADAMTS13
  Gene Name: ADAM metallopeptidase with thrombospondin type 1 motif, 13
  ENST ID: ENST00000495234
  CDS Start-End: 121-1155

SEQ ID NO: 104729 - DNA, 2230 bp, Homo sapiens; identical to SEQ ID NO: 104703
  Payload ID: 560
  Gene Symbol: ADAMTS13
  Gene Name: ADAM metallopeptidase with thrombospondin type 1 motif, 13
  ENST ID: ENST00000474918
  CDS Start-End: 120-950

SEQ ID NO: 104730 - DNA, 5260 bp, Homo sapiens
  Payload ID: 561
  Gene Symbol: ADAMTS14
  Gene Name: ADAM metallopeptidase with thrombospondin type 1 motif, 14
  Uniprot ID: Q8WXS8
  ENST ID: ENST00000373207
  CDS Start-End: 1-3672
atggctccactccgcgcgctgctgtcctacctgctgcctttgcactgtgcgctctgcgccgccgcgggcagccggaccccagagctgcacctctctggaaagctcagtgactatggtgtgacagtgccctgcagcacagactttcggggacgcttcctctcccacgtggtgtctggcccagcagcagcctctgcagggagcatggtagtggacacgccacccacactaccacgacactccagtcacctccgggtggctcgcagccctctgcacccaggagggaccctgtggcctggcagggtggggcgccactccctctacttcaatgtcactgttttcgggaaggaactgcacttgcgcctgcggcccaatcggaggttggtagtgccaggatcctcagtggagtggcaggaggattttcgggagctgttccggcagcccttacggcaggagtgtgtgtacactggaggtgtcactggaatgcctggggcagctgttgccatcagcaactgtgacggattggcgggcctcatccgcacagacagcaccgacttcttcattgagcctctggagcggggccagcaggagaaggaggccagcgggaggacacatgtggtgtaccgccgggaggccgtccagcaggagtgggcagaacctgacggggacctgcacaatgaagcctttggcctgggagaccttcccaacctgctgggcctggtgggggaccagctgggcgacacagagcggaagcggcggcatgccaagccaggcagctacagcatcgaggtgctgctggtggtggacgactcggtggttcgcttccatggcaaggagcatgtgcagaactatgtcctcaccctcatgaatatcgtagatgagatttaccacgatgagtccctgggggttcatataaatattgccctcgtccgcttgatcatggttggctaccgacagtccctgagcctgatcgagcgcgggaacccctcacgcagcctggagcaggtgtgtcgctgggcacactcccagcagcgccaggaccccagccacgctgagcaccatgaccacgttgtgttcctcacccggcaggactttgggccctcagggtatgcacccgtcactggcatgtgtcaccccctgaggagctgtgccctcaaccatgaggatggcttctcctcagccttcgtgatagctcatgagaccggccacgtgctcggcatggagcatgacggtcaggggaatggctgtgcagatgagaccagcctgggcagcgtcatggcgcccctggtgcaggctgccttccaccgcttccattggtcccgctgcagcaagctggagctcagccgctacctcccctcctacgactgcctcctcgatgacccctttgatcctgcctggccccagcccccagagctgcctgggatcaactactcaatggatgagcagtgccgctttgactttggcagtggctaccagacctgcttggcattcaggacctttgagccctgcaagcagctgtggtgcagccatcctgacaacccgtacttctgcaagaccaagaaggggcccccgctggatgggactgagtgtgcacccggcaagtggtgcttcaaaggtcactgcatctggaagtcgccggagcagacatatggccaggatggaggctggagctcctggaccaagtttgggtcatgttcgcggtcatgtgggggcggggtgcgatcccgcagccggagctgcaacaacccctccccagcctatggaggccgcctgtgcttagggcccatgttcgagtaccaggtctgcaacagcgaggagtgccctgggacctacgaggacttccgggcccagcagtgtgccaagcgcaactcctactatgtgcaccagaatgccaagcacagctgggtgccctacgagcctgacgatgacgcccagaagtgtgagctgatctgccagtcggcggacacgggggacgtggtgttcatgaaccaggtggttcacgatgggacacgctgcagctaccgggacccatacagcgtctgtgcgcgtggcgagtgtgtgcctgtcggctgtgacaaggaggtggggtccatgaaggcggatgacaagtgtggagtctgcgggggtgacaactcccactgcaggactgtgaaggggacgctgggcaaggcctccaagcaggcaggagctctcaagctggtgcagatcccagcaggtgccaggcacatccagattgaggcactggagaagtccccccaccgcattgtggtgaagaaccaggtcaccggcagcttcatcctcaaccccaagggcaaggaagccacaagccggaccttcaccgccatgggcctggagtgggaggatgcggtggaggatgccaaggaaagcctcaagaccagcgggcccctgcctgaagccattgccatcctggctctccccccaactgagggtggcccccgcagcagcctggcctacaagtacgtcatccatgaggacctgctgccccttatcgggagcaacaatgtgctcctggaggagatggacacctatgagtgggcgctcaagagctgggccccctgcagcaaggcctgtggaggagggatccagttcaccaaatacggctgccggcgcagacgagaccaccacatggtgcagcgacacctgtgtgaccacaagaagaggcccaagcccatccgccggcgctgcaaccagcacccgtgctctcagcctgtgtgggtgacggaggagtggggtgcctgcagccggagctgtgggaagctgggggtgcagacacgggggatacagtgcctgctgcccctctccaatggaacccacaaggtcatgccggccaaagcctgcgccggggaccggcctgaggcccgacggccctgtctccgagtgccctgcccagcccagtggaggctgggagcctggtcccagtgctctgccacctgtggagagggcatccagcagcggcaggtggtgtgcaggaccaacgccaacagcctcgggcattgcgagggggataggccagacactgtccaggtctgcagcctgcccgcctgtggaggaaatcaccagaactccacggtgagggccgatgtctgggaacttgggacgccagaggggcagtgggtgccacaatctgaacccctacatcccattaacaagatatcatcaacggagccctgcacgggagacaggtctgtcttctgccagatggaagtgctcgatcgctactgctccattcccggctaccaccggctctgctgtgtgtcctgcatcaagaaggcctcgggccccaaccctggcccagaccctggcccaacctcactgccccccttctccactcctggaagccccttaccaggaccccaggaccctgcagatgctgcagagcctcctggaaagccaacgggatcagaggaccatcagcatggccgagccacacagctcccaggagctctggatacaagctccccagggacccagcatccctttgcccctgagacaccaatccctggagcatcctggagcatctcccctaccacccccggggggctgccttggggctggactcagacacctacgccagtccctgaggacaaagggcaacctggagaagacctgagacatcccggcaccagcctccctgctgcctccccggtgacatgagctgtgccctgccatcccactggcacgtttacactctgtgtactgccccgtgactcccagctcagaggacacacatagcagggcaggcgcaagcacagacttcattttaaatcattcgccttcttctcgtttggggctgtgatgctctttaccccacaaagcggggtgggaggaagacaaagatcagggaaagccctaatcggagatacctcagcaagctgcccccggcgggactgaccctctcagggcccctgttggtctcccctgccaagaccagggtcaactattgctccctcctcacagaccctgggcctgggcaggtctgaatcccggctggtctgtagctagaagctgtcagggctgcctgccttcccggaactgtgaggacccctgtggaggccctgcatatttggcccctctccccagaaaggcaaagcagggccagggtaggtgggggactgttcacagccaggccgagaggaggggggcctgggaatgtggcatgaggcttcccagctgcagggctggagggggtggaacacaaggtgatcgcaggcccagctcctggaagccaagagctccatgcagttccaccagctgaggccaggcagcagaggccagtttgtctttgctggccagaagatggtgctcatggccatactctggccttgcagatgtcactagtgttacttctagtgactccagattacagactggccccccaatctcaccccagcccaccagagaagggggctcaggacaccctggaccccaagtcctcagcatccagggatttccaaactggcgctcactccctgactccaccaggatggcaacttcaattatcactctcagcctggaaggggactctgtgggacacagagggaacacgatttctcaggctgtcccttcaatcattgcccttctccgaagatcgctcctgctggagtcggacatcttcatcttctacctggctcaagctgggccagagtgtgtggttctcccaggggtggttggaccccaggactgaggaccagagtccactcatagcctggccctggagatgacaagggccacccaggccaagtgccccagggcagggtgccagcccctggcctggtgctggagtggggaagacacactcacccacggtgctgtaagggcctgagctgtgctcagctgccggccatgctacctccaagggacaggtaacagtcttagatcctctggctctcaggaagtggcagggggtcccaggacacctccggggtcttggaggatgtctcctaaactcctgccaggtgatagaggtgcttctcacttcttccttccccaaggcaaaggggctgttctgagccagcctggaggaacatgagtagtgggcccctggcctgcaacccctttggagagtggaggtcctggggggctccccgccctccccctgttgccctcccctccctgggatgctggggcacacgcggagtcattcctgtgagaaccagcctggcctgtgttaaactcttgtgccttggaaatccagatctttaaaattttatgtatttattaacatcgccattggaccccaaaa

SEQ ID NO: 104731 - DNA, 5269 bp, Homo sapiens
  Payload ID: 561
  Gene Symbol: ADAMTS14
  Gene Name: ADAM metallopeptidase with thrombospondin type 1 motif, 14
  Uniprot ID: Q8WXS8
  ENST ID: ENST00000373208
  CDS Start-End: 1-3681
atggctccactccgcgcgctgctgtcctacctgctgcctttgcactgtgcgctctgcgccgccgcgggcagccggaccccagagctgcacctctctggaaagctcagtgactatggtgtgacagtgccctgcagcacagactttcggggacgcttcctctcccacgtggtgtctggcccagcagcagcctctgcagggagcatggtagtggacacgccacccacactaccacgacactccagtcacctccgggtggctcgcagccctctgcacccaggagggaccctgtggcctggcagggtggggcgccactccctctacttcaatgtcactgttttcgggaaggaactgcacttgcgcctgcggcccaatcggaggttggtagtgccaggatcctcagtggagtggcaggaggattttcgggagctgttccggcagcccttacggcaggagtgtgtgtacactggaggtgtcactggaatgcctggggcagctgttgccatcagcaactgtgacggattggcgggcctcatccgcacagacagcaccgacttcttcattgagcctctggagcggggccagcaggagaaggaggccagcgggaggacacatgtggtgtaccgccgggaggccgtccagcaggagtgggcagaacctgacggggacctgcacaatgaagcctttggcctgggagaccttcccaacctgctgggcctggtgggggaccagctgggcgacacagagcggaagcggcggcatgccaagccaggcagctacagcatcgaggtgctgctggtggtggacgactcggtggttcgcttccatggcaaggagcatgtgcagaactatgtcctcaccctcatgaatatcgtagatgagatttaccacgatgagtccctgggggttcatataaatattgccctcgtccgcttgatcatggttggctaccgacagtccctgagcctgatcgagcgcgggaacccctcacgcagcctggagcaggtgtgtcgctgggcacactcccagcagcgccaggaccccagccacgctgagcaccatgaccacgttgtgttcctcacccggcaggactttgggccctcaggtatgcaagggtatgcacccgtcactggcatgtgtcaccccctgaggagctgtgccctcaaccatgaggatggcttctcctcagccttcgtgatagctcatgagaccggccacgtgctcggcatggagcatgacggtcaggggaatggctgtgcagatgagaccagcctgggcagcgtcatggcgcccctggtgcaggctgccttccaccgcttccattggtcccgctgcagcaagctggagctcagccgctacctcccctcctacgactgcctcctcgatgacccctttgatcctgcctggccccagcccccagagctgcctgggatcaactactcaatggatgagcagtgccgctttgactttggcagtggctaccagacctgcttggcattcaggacctttgagccctgcaagcagctgtggtgcagccatcctgacaacccgtacttctgcaagaccaagaaggggcccccgctggatgggactgagtgtgcacccggcaagtggtgcttcaaaggtcactgcatctggaagtcgccggagcagacatatggccaggatggaggctggagctcctggaccaagtttgggtcatgttcgcggtcatgtgggggcggggtgcgatcccgcagccggagctgcaacaacccctccccagcctatggaggccgcctgtgcttagggcccatgttcgagtaccaggtctgcaacagcgaggagtgccctgggacctacgaggacttccgggcccagcagtgtgccaagcgcaactcctactatgtgcaccagaatgccaagcacagctgggtgccctacgagcctgacgatgacgcccagaagtgtgagctgatctgccagtcggcggacacgggggacgtggtgttcatgaaccaggtggttcacgatgggacacgctgcagctaccgggacccatacagcgtctgtgcgcgtggcgagtgtgtgcctgtcggctgtgacaaggaggtggggtccatgaaggcggatgacaagtgtggagtctgcgggggtgacaactcccactgcaggactgtgaaggggacgctgggcaaggcctccaagcaggcaggagctctcaagctggtgcagatcccagcaggtgccaggcacatccagattgaggcactggagaagtccccccaccgcattgtggtgaagaaccaggtcaccggcagcttcatcctcaaccccaagggcaaggaagccacaagccggaccttcaccgccatgggcctggagtgggaggatgcggtggaggatgccaaggaaagcctcaagaccagcgggcccctgcctgaagccattgccatcctggctctccccccaactgagggtggcccccgcagcagcctggcctacaagtacgtcatccatgaggacctgctgccccttatcgggagcaacaatgtgctcctggaggagatggacacctatgagtgggcgctcaagagctgggccccctgcagcaaggcctgtggaggagggatccagttcaccaaatacggctgccggcgcagacgagaccaccacatggtgcagcgacacctgtgtgaccacaagaagaggcccaagcccatccgccggcgctgcaaccagcacccgtgctctcagcctgtgtgggtgacggaggagtggggtgcctgcagccggagctgtgggaagctgggggtgcagacacgggggatacagtgcctgctgcccctctccaatggaacccacaaggtcatgccggccaaagcctgcgccggggaccggcctgaggcccgacggccctgtctccgagtgccctgcccagcccagtggaggctgggagcctggtcccagtgctctgccacctgtggagagggcatccagcagcggcaggtggtgtgcaggaccaacgccaacagcctcgggcattgcgagggggataggccagacactgtccaggtctgcagcctgcccgcctgtggaggaaatcaccagaactccacggtgagggccgatgtctgggaacttgggacgccagaggggcagtgggtgccacaatctgaacccctacatcccattaacaagatatcatcaacggagccctgcacgggagacaggtctgtcttctgccagatggaagtgctcgatcgctactgctccattcccggctaccaccggctctgctgtgtgtcctgcatcaagaaggcctcgggccccaaccctggcccagaccctggcccaacctcactgccccccttctccactcctggaagccccttaccaggaccccaggaccctgcagatgctgcagagcctcctggaaagccaacgggatcagaggaccatcagcatggccgagccacacagctcccaggagctctggatacaagctccccagggacccagcatccctttgcccctgagacaccaatccctggagcatcctggagcatctcccctaccacccccggggggctgccttggggctggactcagacacctacgccagtccctgaggacaaagggcaacctggagaagacctgagacatcccggcaccagcctccctgctgcctccccggtgacatgagctgtgccctgccatcccactggcacgtttacactctgtgtactgccccgtgactcccagctcagaggacacacatagcagggcaggcgcaagcacagacttcattttaaatcattcgccttcttctcgtttggggctgtgatgctctttaccccacaaagcggggtgggaggaagacaaagatcagggaaagccctaatcggagatacctcagcaagctgcccccggcgggactgaccctctcagggcccctgttggtctcccctgccaagaccagggtcaactattgctccctcctcacagaccctgggcctgggcaggtctgaatcccggctggtctgtagctagaagctgtcagggctgcctgccttcccggaactgtgaggacccctgtggaggccctgcatatttggcccctctccccagaaaggcaaagcagggccagggtaggtgggggactgttcacagccaggccgagaggaggggggcctgggaatgtggcatgaggcttcccagctgcagggctggagggggtggaacacaaggtgatcgcaggcccagctcctggaagccaagagctccatgcagttccaccagctgaggccaggcagcagaggccagtttgtctttgctggccagaagatggtgctcatggccatactctggccttgcagatgtcactagtgttacttctagtgactccagattacagactggccccccaatctcaccccagcccaccagagaagggggctcaggacaccctggaccccaagtcctcagcatccagggatttccaaactggcgctcactccctgactccaccaggatggcaacttcaattatcactctcagcctggaaggggactctgtgggacacagagggaacacgatttctcaggctgtcccttcaatcattgcccttctccgaagatcgctcctgctggagtcggacatcttcatcttctacctggctcaagctgggccagagtgtgtggttctcccaggggtggttggaccccaggactgaggaccagagtccactcatagcctggccctggagatgacaagggccacccaggccaagtgccccagggcagggtgccagcccctggcctggtgctggagtggggaagacacactcacccacggtgctgtaagggcctgagctgtgctcagctgccggccatgctacctccaagggacaggtaacagtcttagatcctctggctctcaggaagtggcagggggtcccaggacacctccggggtcttggaggatgtctcctaaactcctgccaggtgatagaggtgcttctcacttcttccttccccaaggcaaaggggctgttctgagccagcctggaggaacatgagtagtgggcccctggcctgcaacccctttggagagtggaggtcctggggggctccccgccctccccctgttgccctcccctccctgggatgctggggcacacgcggagtcattcctgtgagaaccagcctggcctgtgttaaactcttgtgccttggaaatccagatctttaaaattttatgtatttattaacatcgccattggaccccaaaa

SEQ ID NO: 104732 - DNA, 5673 bp, Homo sapiens
  Payload ID: 562
  Gene Symbol: ADAMTS15
  Gene Name: ADAM metallopeptidase with thrombospondin type 1 motif, 15
  Uniprot ID: Q8TE58
  ENST ID: ENST00000299164
  CDS Start-End: 1-2853
atgcttctgctgggcatcctaaccctggctttcgccgggcgaaccgctggaggctctgagccagagcgggaggtagtcgttcccatccgactggacccggacattaacggccgccgctactactggcggggtcccgaggactccggggatcagggactcatttttcagatcacagcatttcaggaggacttttacctacacctgacgccggatgctcagttcttggctcccgccttctccactgagcatctgggcgtccccctccaggggctcaccgggggctcttcagacctgcgacgctgcttctattctggggacgtgaacgccgagccggactcgttcgctgctgtgagcctgtgcggggggctccgcggagcctttggctaccgaggcgccgagtatgtcattagcccgctgcccaatgctagcgcgccggcggcgcagcgcaacagccagggcgcacaccttctccagcgccggggtgttccgggcgggccttccggagaccccacctctcgctgcggggtggcctcgggctggaaccccgccatcctacgggccctggacccttacaagccgcggcgggcgggcttcggggagagtcgtagccggcgcaggtctgggcgcgccaagcgtttcgtgtctatcccgcggtacgtggagacgctggtggtcgcggacgagtcaatggtcaagttccacggcgcggacctggaacattatctgctgacgctgctggcaacggcggcgcgactctaccgccatcccagcatcctcaaccccatcaacatcgttgtggtcaaggtgctgcttcttagagatcgtgactccgggcccaaggtcaccggcaatgcggccctgacgctgcgcaacttctgtgcctggcagaagaagctgaacaaagtgagtgacaagcaccccgagtactgggacactgccatcctcttcaccaggcaggacctgtgtggagccaccacctgtgacaccctgggcatggctgatgtgggtaccatgtgtgaccccaagagaagctgctctgtcattgaggacgatgggcttccatcagccttcaccactgcccacgagctgggccacgtgttcaacatgccccatgacaatgtgaaagtctgtgaggaggtgtttgggaagctccgagccaaccacatgatgtccccgaccctcatccagatcgaccgtgccaacccctggtcagcctgcagtgctgccatcatcaccgacttcctggacagcgggcacggtgactgcctcctggaccaacccagcaagcccatctccctgcccgaggatctgccgggcgccagctacaccctgagccagcagtgcgagctggcttttggcgtgggctccaagccctgtccttacatgcagtactgcaccaagctgtggtgcaccgggaaggccaagggacagatggtgtgccagacccgccacttcccctgggccgatggcaccagctgtggcgagggcaagctctgcctcaaaggggcctgcgtggagagacacaacctcaacaagcacagggtggatggttcctgggccaaatgggatccctatggcccctgctcgcgcacatgtggtgggggcgtgcagctggccaggaggcagtgcaccaaccccacccctgccaacgggggcaagtactgcgagggagtgagggtgaaataccgatcctgcaatctggagccctgccccagctcagcctccggaaagagcttccgggaggagcagtgtgaggctttcaacggctacaaccacagcaccaaccggctcactctcgccgtggcatgggtgcccaagtactccggcgtgtctccccgggacaagtgcaagctcatctgccgagccaatggcactggctacttctatgtgctggcacccaaggtggtggacggcacgctgtgctctcctgactccacctccgtctgtgtccaaggcaagtgcatcaaggctggctgtgatgggaacctgggctccaagaagagattcgacaagtgtggggtgtgtgggggagacaataagagctgcaagaaggtgactggactcttcaccaagcccatgcatggctacaatttcgtggtggccatccccgcaggcgcctcaagcatcgacatccgccagcgcggttacaaagggctgatcggggatgacaactacctggctctgaagaacagccaaggcaagtacctgctcaacgggcatttcgtggtgtcggcggtggagcgggacctggtggtgaagggcagtctgctgcggtacagcggcacgggcacagcggtggagagcctgcaggcttcccggcccatcctggagccgctgaccgtggaggtcctctccgtggggaagatgacaccgccccgggtccgctactccttctatctgcccaaagagcctcgggaggacaagtcctctcatcccaaggacccccggggaccctctgtcttgcacaacagcgtcctcagcctctccaaccaggtggagcagccggacgacaggccccctgcacgctgggtggctggcagctgggggccgtgctccgcgagctgcggcagtggcctgcagaagcgggcggtggactgccggggctccgccgggcagcgcacggtccctgcctgtgatgcagcccatcggcccgtggagacacaagcctgcggggagccctgccccacctgggagctcagcgcctggtcaccctgctccaagagctgcggccggggatttcagaggcgctcactcaagtgtgtgggccacggaggccggctgctggcccgggaccagtgcaacttgcaccgcaagccccaggagctggacttctgcgtcctgaggccgtgctgagtggggtcatcgctttctccccctcactctccaccccactgatatgccagcgttctgccagctggagtagcgggcagaggacggtggccaggggctcacgccacgatgtcacccacatccggggacaaggaccatgggctggggcgagaggttccctcctcctccctggactgggcagagggaagcccaggaactcccgcacagtctacctcaggccccgctcctcgggccggttgcggggagaggctttgaggtgcagggcagaaggtgctgaggcccagtttccaaggaacttggaggatgggcaccttccaggcagaacttcagggaccccggcccccagaacggaggccacaggctgctggaagagccatgtcccagcagcttggcaccctcaggtggccccatgggctctgagccgtgtctgaacgaggcagggttttcacggtgcttttagcccactttcctttttgaactgacatggactaagcaataaaagctggctggggctgggcagaagccacggggagagtgagattagggcccctggagcctggcactccaccttggaagacgtggacgtgcacagggagtcccgaggtttctcatcctgcactcttggccctcctataaagaagcagcctctccttcctctgatgtgcagggtgtaggactagtggtagggctgccacggaagtgtcctctgaggctctgcaggtagcggggaaagccagtagggagtctgctgtcttcttcaagatggagccggccattacagaaagatgttgacatttgctaggggctatgcagtctgtggctgatgcagggagttttcagaaagttctggagggttctgctgtcactggactggggttggtgctgagctctgggcctggctttgggagatgtcaccctgggatagggaggaggaagctgcatttctaatggcttcctcctccagagaggcacgtatatgcaggctgacatccgagggtctgtgtcgcctcagacagccctgacagtggccacagtcccgtacccattgtgaggggctggggcatgcctaggagggctaggtgctgaacatctatgtgcctataaactcgtcttcgttccaaacagctactgctgtctgccctgggcacgtcacgttgcatcctaggccttagcttctccactgtttgctacctcagattatgccctctgggaacccagccgtatccctcccctaggacagtggtgacctggtccttccaccacactcagtctttggagagcgagctgtccagccacagaaatgagggtgtggtgcgtggcttcctgctccccacagcccagccccctgttggggctccaaagccgaagacagggcctcttcagactccttgggagtaggtttcaggaggcaccaagaatcaatgactgacccagggggcctggcagccactagtatgaactgctggagacctgtctgtcttatagacatgtcaggaaaatagaaacaggcattttctctagctccaagtggggagatattttggggtcacagcttctttggctaagcagggtgtttcttgaaggttcagatgccccactgtgtacatgggatattctgcttctgagtgtaggtgatgaatccaggtcctcagtggagaattttctggagctaagatcaaagcatgtgtcttcctgggagagaagagttccgttcttttatgtgggtttccctaatagtcagaatccacaaaccagccagccagccagccaagcctctgcgatgatgttctcatccggtctaacgctgggctggaaaccttggacagagttcatgcgggggcagagggggtgccagtctctgaggcagggctgcagtcacccctgaagaactaagtgaacaggaacccctctgtgccagtgaccactgtggggctaaagggacaaaaaggaccagggtaccaggcagaagcagatccttgatagctgacgacagcactgcgccctgtgcttggtgcactccctccttcaggaggagagggtggcatggggtctgtgcgggatggcagggggattgggtgggtgggaagagaggtgccatcggtaggaggctggcctccagtagaggagagcagcttttgccatcagtcactttacaaaccatttcaaggaaggacaacctctctggctcctgacacaagccaggcctcggtgcttttatctgttgtggtggtttttcttctttccctttttaaaagacgcatgaccaagacaacctagggagtttgtcttgcttgcctttgactatttccttaatccaaccatgctctcgagggctgagcagagactagactcaaggcacaggtttctggtgatggagtaaagttacagcggtatctcatgtctacacaagaagaggaacgttctgaaagctccaacaacttcttgagggggatggaccaatacagctttgggctcaggattccctagcctcctctgcccatcgcgtgcactgattggaggagtctggcccaaacactctcatatgaacctcgacatgctggagtggggtctggcaggagctgatgacagtttgagggacttgagtgtccctagcctggcagttggctcccggaagcactagacactgacactcattggtagaccctccctccccgccgttgtgtttggttcttttgcactccatgtactgcagaaggatggaaggacctgggtgctggctgggctgtgtatactgtgtatacaagggagctggctgctgaggtgaccacagccttctcctaataaagctgtaagtatttaaaa

SEQ ID NO: 104733 - DNA, 4979 bp, Homo sapiens
  Payload ID: 563
  Gene Symbol: ADAMTS16
  Gene Name: ADAM metallopeptidase with thrombospondin type 1 motif, 16
  Uniprot ID: Q8TE57
  ENST ID: ENST00000274181
  CDS Start-End: 139-3813
agtaataaccccggcgcggcggcggagtcgctgtggggaatcctcccgcgctctgcctgggtcgggtcctccctgcccgctcgcacgctgccggccggggaccctccggtggcccctagcccctcggagcgctcctggatgaagccccgcgcgcgcggatggcggggcttggcggcgctgtggatgctgttggcgcaggtggccgagcaggcacctgcgtgcgccatgggacccgcagcggcagcgcctgggagcccgagcgtcccgcgtcctcctccacccgcggagcggccgggctggatggaaaagggcgaatatgacctggtctctgcctacgaggttgaccacaggggcgattacgtgtcccatgaaatcatgcaccatcagcggcggagaagagcagtgcccgtgtccgaggttgagtctcttcaccttcggctgaaaggctccaggcacgacttccacatggatctgaggacttccagcagcctagtggctcctggctttattgtgcagacgttgggaaagacaggcactaagtctgtgcagactttaccgccagaggacttctgtttctatcaaggctctttgcgatcacacagaaactcctcagtggccctttcaacctgccaaggcttgtcaggcatgatacgaacagaagaggcagattacttcctaaggccacttccttcacacctctcatggaaactcggcagagctgcccaaggcagctcgccatcccacgtactgtacaagagatccacagagccccatgctcctggggccagtgaggtcctggtgacctcaaggacatgggagctggcacatcaacccctgcacagcagcgaccttcgcctgggactgccacaaaagcagcatttctgtggaagacgcaagaaatacatgccccagcctcccaaggaagacctcttcatcttgccagatgagtataagtcttgcttacggcataagcgctctcttctgaggtcccatagaaatgaagaactgaacgtggagaccttggtggtggtcgacaaaaagatgatgcaaaaccatggccatgaaaatatcaccacctacgtgctcacgatactcaacatggtatctgctttattcaaagatggaacaataggaggaaacatcaacattgcaattgtaggtctgattcttctagaagatgaacagccaggactggtgataagtcaccacgcagaccacaccttaagtagcttctgccagtggcagtctggattgatggggaaagatgggactcgtcatgaccacgccatcttactgactggtctggatatatgttcctggaagaatgagccctgtgacactttgggatttgcacccataagtggaatgtgtagtaaatatcgcagctgcacgattaatgaagatacaggtcttggactggccttcaccattgcccatgagtctggacacaactttggcatgattcatgatggagaagggaacatgtgcaaaaagtccgagggcaacatcatgtcccctacattggcaggacgcaatggagtcttctcctggtcaccctgcagccgccagtatctacacaaatttctaagcaccgctcaagctatctgccttgctgatcagccaaagcctgtgaaggaatacaagtatcctgagaaattgccaggagaattatatgatgcaaacacacagtgcaagtggcagttcggagagaaagccaagctctgcatgctggactttaaaaaggacatctgtaaagccctgtggtgccatcgtattggaaggaaatgtgagactaaatttatgccagcagcagaaggcacaatttgtgggcatgacatgtggtgccggggaggacagtgtgtgaaatatggtgatgaaggccccaagcccacccatggccactggtcggactggtcttcttggtccccatgctccaggacctgcggagggggagtatctcataggagtcgcctctgcaccaaccccaagccatcgcatggagggaagttctgtgagggctccactcgcactctgaagctctgcaacagtcagaaatgtccccgggacagtgttgacttccgtgctgctcagtgtgccgagcacaacagcagacgattcagagggcggcactacaagtggaagccttacactcaagtagaagatcaggacttatgcaaactctactgtatcgcagaaggatttgatttcttcttttctttgtcaaataaagtcaaagatgggactccatgctcggaggatagccgtaatgtttgtatagatgggatatgtgagagagttggatgtgacaatgtccttggatctgatgctgttgaagacgtctgtggggtgtgtaacgggaataactcagcctgcacgattcacaggggtctctacaccaagcaccaccacaccaaccagtattatcacatggtcaccattccttctggagcccggagtatccgcatctatgaaatgaacgtctctacctcctacatttctgtgcgcaatgccctcagaaggtactacctgaatgggcactggaccgtggactggcccggccggtacaaattttcgggcactactttcgactacagacggtcctataatgagcccgagaacttaatcgctactggaccaaccaacgagacactgattgtggagctgctgtttcagggaaggaacccgggtgttgcctgggaatactccatgcctcgcttggggaccgagaagcagccccctgcccagcccagctacacttgggccatcgtgcgctctgagtgctccgtgtcctgcggagggggacagatgaccgtgagagagggctgctacagagacctgaagtttcaagtaaatatgtccttctgcaatcccaagacacgacctgtcacggggctggtgccttgcaaagtatctgcctgtcctcccagctggtccgtggggaactggagtgcctgcagtcggacgtgtggcgggggtgcccagagccgccccgtgcagtgcacacggcgggtgcactatgactcggagccagtcccggccagcctgtgccctcagcctgctccctccagcaggcaggcctgcaactctcagagctgcccacctgcatggagcgccgggccctgggcagagtgctcacacacctgtgggaaggggtggaggaagcgggcagtggcctgtaagagcaccaacccctcggccagagcgcagctgctgcccgacgctgtctgcacctccgagcccaagcccaggatgcatgaagcctgtctgcttcagcgctgccacaagcccaagaagctgcagtggctggtgtccgcctggtcccagtgctctgtgacatgtgaaagaggaacacagaaaagattcttaaaatgtgctgaaaagtatgtttctggaaagtatcgagagctggcctcaaagaagtgctcacatttgccgaagcccagcctggagctggaacgtgcctgcgccccgcttccatgccccaggcaccccccatttgctgctgcgggaccctcgaggggcagctggtttgcctcaccctggtctcagtgcacggccagctgtgggggaggcgttcagacgaggtccgtgcagtgcctggctgggggccggccggcctcaggctgcctcctgcaccagaagccttcggcctccctggcctgcaacactcacttctgccccattgcagagaagaaagatgccttctgcaaagactacttccactggtgctacctggtaccccagcacgggatgtgcagccacaagttctacggcaagcagtgctgcaagacttgctctaagtccaacttgtgagttgggaccgctctccgtagcagagaaagtgcctgcgtggcacagaaatttcccacaaatgagctgtgcaatctacgtcggaatacatccaaggaagagcaaagccaaaagaagaaaaccgtgttaggctctttgaccaggagtgtatgtatgtgtttcactgtgagcctgggtgcagacctgtgtccccatgcacacagtgtctcctgtcaggctgaaatgtggcaccctggcagacagagctgtggctcgtgaggcagaaggcaggcaccacaacgggagaggcagcactcacccctgcctgttgcagctaaatcaagtcaaaaagacaggcgaggctgaacttgctaaatgtctggtgccttagaaaaagaaggaaaggccatgaaataaggaaaacatacaaaatatgtaccccctagttcaccagcctcccctcccactaggagggcccctcgagccatcaggagtgaccaacttcctgggtggaggtcaggggagctccaggaggctgcccaggctcctcctcctcctccccagcggccgagcatctcttaccaggaacctggagccaccgccggagccagcgtcatctctagggtcactggccaggggactgcattctggtttgggactttgcctatggaaatgggaaaaatgaaattcctgctaaggtgcttctatctctttcagattcatgcattgaaggagagattttttatactttatgttttatctttctcagttatttgcaagtgagtgtccttttaaaaacacacttcttcatgcttttctttgtaaatgacagatcgaagtataggttacatcaaaaccctaccatcctgagaagagttatggttctattatagcagacgtcagccacacagcctatgtgacaataaccttagagtcctgtgttttgtttttgtgtgttgtgagattttaatcttttttttttcggtgagtctggccatttctataatgccaggtgggaagccaggctgcgggtgttagggtgggaatctgcccggcgtctctggcaccctccctgccatcctcagtgcggctgctgttctcctgtccggtgctgtggctccattccaaaggggcacctggatatttatatttgctgaagttttataataaagtttatatggtacagtgtg

SEQ ID NO: 104734 - DNA, 2682 bp, Homo sapiens
  Payload ID: 563
  Gene Symbol: ADAMTS16
  Gene Name: ADAM metallopeptidase with thrombospondin type 1 motif, 16
  ENST ID: ENST00000511368
  CDS Start-End: 139-1851
agtaataaccccggcgcggcggcggagtcgctgtggggaatcctcccgcgctctgcctgggtcgggtcctccctgcccgctcgcacgctgccggccggggaccctccggtggcccctagcccctcggagcgctcctggatgaagccccgcgcgcgcggatggcggggcttggcggcgctgtggatgctgttggcgcaggtggccgagcaggcacctgcgtgcgccatgggacccgcagcggcagcgcctgggagcccgagcgtcccgcgtcctcctccacccgcggagcggccgggctggatggaaaagggcgaatatgacctggtctctgcctacgaggttgaccacaggggcgattacgtgtcccatgaaatcatgcaccatcagcggcggagaagagcagtgcccgtgtccgaggttgagtctcttcaccttcggctgaaaggctccaggcacgacttccacatggatctgaggacttccagcagcctagtggctcctggctttattgtgcagacgttgggaaagacaggcactaagtctgtgcagactttaccgccagaggacttctgtttctatcaaggctctttgcgatcacacagaaactcctcagtggccctttcaacctgccaaggcttgtcaggcatgatacgaacagaagaggcagattacttcctaaggccacttccttcacacctctcatggaaactcggcagagctgcccaaggcagctcgccatcccacgtactgtacaagagatccacagagccccatgctcctggggccagtgaggtcctggtgacctcaaggacatgggagctggcacatcaacccctgcacagcagcgaccttcgcctgggactgccacaaaagcagcatttctgtggaagacgcaagaaatacatgccccagcctcccaaggaagacctcttcatcttgccagatgagtataagtcttgcttacggcataagcgctctcttctgaggtcccatagaaatgaagaactgaacgtggagaccttggtggtggtcgacaaaaagatgatgcaaaaccatggccatgaaaatatcaccacctacgtgctcacgatactcaacatggtatctgctttattcaaagatggaacaataggaggaaacatcaacattgcaattgtaggtctgattcttctagaagatgaacagccaggactggtgataagtcaccacgcagaccacaccttaagtagcttctgccagtggcagtctggattgatggggaaagatgggactcgtcatgaccacgccatcttactgactggtctggatatatgttcctggaagaatgagccctgtgacactttgggatttgcacccataagtggaatgtgtagtaaatatcgcagctgcacgattaatgaagatacaggtcttggactggccttcaccattgcccatgagtctggacacaactttggcatgattcatgatggagaagggaacatgtgcaaaaagtccgagggcaacatcatgtcccctacattggcaggacgcaatggagtcttctcctggtcaccctgcagccgccagtatctacacaaatttctaagcaccgctcaagctatctgccttgctgatcagccaaagcctgtgaaggaatacaagtatcctgagaaattgccaggagaattatatgatgcaaacacacagtgcaagtggcagttcggagagaaagccaagctctgcatgctggactttaaaaaggacatctgtaaagccctgtggtgccatcgtattggaaggaaatgtgagactaaatttatgccagcagcagaaggcacaatttgtgggcatgacatggtaagaagctaactgtaggtacagcatcgtattcagatgctagtctttcaacccatgcatctttgctcctcttgcataggtatttttaaaacatgtatttctcatatacatatgcatacccatgctcctatcaaacactgtgtttattttatattgataatgtgaagaggaatccttttctcacttttgtgaaaataaaattgatgagctacctggaattcatagacatagaaatcagacaacaggtgatgacagattcagtctattgaggggaaacattaagccattgaccaccatttatcatggaaaggaccagcattaaacagtgctgtgaaagccacagaacatcggtttgaagaccctggagcacatcattttcacctattgttgcctctgtgagaagagagagagctatggtagagaaaagaagaagtatacaagatgttgcagcaatgtggacgtagttggaggccattcattatcctaggcaaactaatgcaggaacagaaaaccaaatactgcatgttgttacttataagcaggagctaaacactgagtacacatggacacaaagatgggaaccatagaccccggggactacttaaggggggatggtgggagggggcaagggttgaaacactatcccatattgtgcttgctgcatgggtgatgaggttattcgaatgccaaactttagtgacacgtaatctacccatgtaacaaatctgcacatgtacccctgaacctaaaacaaaagtcggaaaaaaaagaaatatacaagataacaagtttattactaaatggtaaagaatgacaatttcattattaaaactttaaaaaatt

SEQ ID NO: 104735 - DNA, 6207 bp, Homo sapiens
  Payload ID: 564
  Gene Symbol: ADAMTS17
  Gene Name: ADAM metallopeptidase with thrombospondin type 1 motif, 17
  Uniprot ID: Q8TE56
  ENST ID: ENST00000268070
  CDS Start-End: 107-3394
aattactttttccaaaggctggagggcttcactccggctggcgccgccgcctagcgcgctcctgcttcgccgccacggtccgggggggctgccggtcccgggtaccatgtgtgacggcgccctgctgcctccgctcgtcctgcccgtgctgctgctgctggtttggggactggacccgggcacagctgtcggcgacgcggcggccgacgtggaggtggtgctcccgtggcgggtgcgccccgacgacgtgcacctgccgccgctgcccgcagcccccgggccccgacggcggcgacgcccccgcacgcccccagccgccccgcgcgcccggcccggagagcgcgccctgctgctgcacctgccggccttcgggcgcgacctgtaccttcagctgcgccgcgacctgcgcttcctgtcccgaggcttcgaggtggaggaggcgggcgcggcccggcgccgcggccgccccgccgagctgtgcttctactcgggccgtgtgctcggccaccccggctccctcgtctcgctcagcgcctgcggcgccgccggcggcctggttggcctcattcagcttgggcaggagcaggtgctaatccagcccctcaacaactcccagggcccattcagtggacgagaacatctgatcaggcgcaaatggtccttgacccccagcccttctgctgaggcccagagacctgagcagctctgcaaggttctaacagaaaagaagaagccgacgtggggcaggccttcgcgggactggcgggagcggaggaacgctatccggctcaccagcgagcacacggtggagaccctggtggtggccgacgccgacatggtgcagtaccacggggccgaggccgcccagaggttcatcctgaccgtcatgaacatggtatacaatatgtttcagcaccagagcctggggattaaaattaacattcaagtgaccaagcttgtcctgctacgacaacgtcccgctaagttgtccattgggcaccatggtgagcggtccctggagagcttctgtcactggcagaacgaggagtatggaggagcgcgatacctcggcaataaccaggttcccggcgggaaggacgacccgcccctggtggatgctgccgtgtttgtgaccaggacagatttctgtgtacacaaggatgaaccgtgtgacactgttggaattgcttacttaggaggtgtgtgcagtgctaagaggaagtgtgtgcttgccgaagacaatggtctcaatttggcctttaccatcgcccatgagctgggccacaacttgggcatgaaccacgacgatgaccactcatcttgcgctggcaggtcccacatcatgtcaggagagtgggtgaaaggccggaacccaagtgacctctcttggtcctcctgcagccgagatgaccttgaaaacttcctcaagtcaaaagtcagcacctgcttgctagtcacggaccccagaagccagcacacagtacgcctcccgcacaagctgccgggcatgcactacagtgccaacgagcagtgccagatcctgtttggcatgaatgccaccttctgcagaaacatggagcatctaatgtgtgctggactgtggtgcctggtagaaggagacacatcctgcaagaccaagctggaccctcccctggatggcaccgagtgtggggcagacaagtggtgccgcgcgggggagtgcgtgagcaagacgcccatcccggagcatgtggacggagactggagcccgtggggcgcctggagcatgtgcagccgaacatgtgggacgggagcccgcttcaggcagaggaaatgtgacaaccccccccctgggcctggaggcacacactgcccgggtgccagtgtagaacatgcggtctgcgagaacctgccctgccccaagggtctgcccagcttccgggaccagcagtgccaggcacacgaccggctgagccccaagaagaaaggcctgctgacagccgtggtggttgacgataagccatgtgaactctactgctcgcccctcgggaaggagtccccactgctggtggccgacagggtcctggacggtacaccctgcgggccctacgagactgatctctgcgtgcacggcaagtgccagaaaatcggctgtgacggcatcatcgggtctgcagccaaagaggacagatgcggggtctgcagcggggacggcaagacctgccacttggtgaagggcgacttcagccacgcccgggggacagctctcaaagactcgggtaaggggtccatcaacagtgactggaagatagagctccccggagagttccagattgcaggcacaactgttcgctatgtgagaagggggctgtgggagaagatctctgccaagggaccaaccaaactaccgctgcacttgatggtgttgttatttcacgaccaagattatggaattcattatgaatacactgttcctgtaaaccgcactgcggaaaatcaaagcgaaccagaaaaaccgcaggactctttgttcatctggacccacagcggctgggaagggtgcagtgtgcagtgcggcggaggggagcgcagaaccatcgtctcgtgtacacggattgtcaacaagaccacaactctggtgaacgacagtgactgccctcaagcaagccgcccagagccccaggtccgaaggtgcaacttgcacccctgccagtcacggtgggtggcaggcccgtggagcccctgctcggcgacctgtgagaaaggcttccagcaccgggaggtgacctgcgtgtaccagctgcagaacggcacacacgtcgctacgcggcccctctactgcccgggcccccggccggcggcagtgcagagctgtgaaggccaggactgcctgtccatctgggaggcgtctgagtggtcacagtgctctgccagctgtggtaaaggggtgtggaaacggaccgtggcgtgcaccaactcacaagggaaatgcgacgcatccacgaggccgagagccgaggaggcctgcgaggactactcaggctgctacgagtggaaaactggggactggtctacgtgctcgtcgacctgcgggaagggcctgcagtcccgggtggtgcagtgcatgcacaaggtcacagggcgccacggcagcgagtgccccgccctctcgaagcctgccccctacagacagtgctaccaggaggtctgcaacgacaggatcaacgccaacaccatcacctccccccgccttgctgctctgacctacaaatgcacacgagaccagtggacggtatattgccgggtcatccgagaaaagaacctctgccaggacatgcggtggtaccagcgctgctgccagacctgcagggacttctatgcaaacaagatgcgccagccaccgccgaactcgtgacacgcagtcccaagggtcgctcaaagctcagactcaggtctgaaacccacccacccgcaagcctaccagccttgtggccacgcccccacccggctgccacaagaatccaactacatagaacatgagcgtggacttggcgtttgccattagtgcttccgtacttaatatattgttaacagccactggctggctttctacagtgaggagaaagtaggcatgagtcacaaagtaacttcaatttctaggatttcaggtacctcgaagggaagcacctctggcagacaaccgtcaagagagagacatcatttagtgttcttgtcttgactcgcttttgacatttgaatttccagtgcttggtatatcatggaggaaacatccccaaaacgagacatgctagaaaaggctttattctgaaagccggcgacaccatggagggaggggcaggtgttggtgagcctctgcccgtggcttctctggggagggccgggctgcttagcacacgtttctctccatctaccttcttgaccacatgagaaccaggacgttgcctccatgcccgtctctgagaacatagtctctaaatcctaggtgttgccttggaagtctcgtgcgtggagtgtaaatctatatatgccagcgaggacagcagtgccacgcagttcataccacccgcatgggaagaatgttccaagagagtctgggtttggggaagcatctaattttcagagctctgctgtccaccgtgtagggaaacagaagggcctctcttcaaggtgctgtgacataagaaacggtaattgcggtgatggggttgcttcctaaggcaaaggtaagcttgggccagcttcactggggcggatgggcacctgccccgccttccgggaacatccactctggcctgcacttcctaaagctttgtaccttagagatgctgtaccacatcccagtggctttctaccgaccgtggccatttatctgaaggtaagacgacatttgggacctctgaggacacaagcccaggcctaggatctgtagagcaaggcctgactgctctatcctggcacggagcagcctgatgtgccaggaccaggggaggaacgccatctggctggcactgctgcacacccgccgagccttcctgtagccccagactttgtggtacccattatcatcacgcctgtcatcattgacccatcttcttggtggggcaaggatgatgcatgatgaaggaaggtccttcccccctgcagcccccttacgcctggcagcagacaagcagagtggcctctttgagagcacagaggatggtagcaccctacctgcaaggaggccgggcagggaccctagatgccaggaggcctgttttgctcaccaacttggtgggcatttcatgggtgcttatgttctaggactttaccgtaaataacacctcctccctgatttcagacggaaggtctcacttggacttccatgggatcatctccctgtgcttcttgatttattggtgctgtgtttctgtgttttgttttgttacatgtcacaaccgtagagttagcttaaatcagaaagaagcctctctgccttctccaccctgtcttacgagctgtgtttttgtttttactaccctagaggcagagaagcggtagggatgtcagggaatttactcacttccacttgaatcaacgagaagtgttgagaaacttccgtgggtgctctgtggaaagaaccgagggtgtcaggatggagcggcccaccctcgccccgcggcctgcgcagactgctgtcctccccttcaggcctggccaccagcagactcccatgaattcccattttcacaaagccctcaaaattttgggggcgctgaggttcaattttcttcatccccaaatgaactgttaattcactgaaagacatttagacttttgcagccaaggagcagagccgggcaagctcactaaggaagccttagcttggtctcctgcatgggccccggggcctccagatatgcccactgtcaccctggcaagggccccacaccctcagaatgaaaaggattgattgggttattgtcagatacccccattagttcccctaaagtctgcatctgcagagctcttttagctcatctttttgttgtcggtgttgttttttgagacagagtctccctctgttgcccaggctggagtgcagtggcgcgatctcagctcattgaaagctccgcctcccgggttcaggccattcttctgcctcaccctccccagtagctgggactacaggcgcccaccaccacgcccacctacttttttgtatttttactagagacggggtttcaccatgttagccaggatggtctcgatctcctgacctcatgatccacccgcctcagccttccaaagtgctgggattacaggagtgagccaccgcgcccggccttttagcttatcttgaaatccaccagcctaccttctgttcatggcacgagcagtgatttcagtgaaaccatcataaacattcttgttccactagatgctgatcacagcagtgatgtttctgtgttaataccctgtactgtccctcgagtactgtacctttgtgcttgcacacgtgtcactaacgcacgtgttaccagagtctcacgaccctacggtgctatttttattggtgcaaaattaaaccctctcagctgaccgttgctggataggatcagaatgcaggaaaagagcctctatggcaatacgattgtccttttttcgtttcagagtcaaatgtatctattttccattcgttaacttgcattacatactgtacccatg

SEQ ID NO: 104736 - DNA, 571 bp, Homo sapiens
  Payload ID: 564
  Gene Symbol: ADAMTS17
  Gene Name: ADAM metallopeptidase with thrombospondin type 1 motif, 17
  ENST ID: ENST00000558960
  CDS Start-End: 107-313
aattactttttccaaaggctggagggcttcactccggctggcgccgccgcctagcgcgctcctgcttcgccgccacggtccgggggggctgccggtcccgggtaccatgtgtgacggcgccctgctgcctccgctcgtcctgcccgtgctgctgctgctggtttggggactggacccgggcacaggttggcctcattcagcttgggcaggagcaggtgctaatccagcccctcaacaactcccagggcccattcagtggacgagaacatctgatcaggcgcaaatggtccttgacccccagcccttctgctgaggcccagagacctgagcagctctgcaaggttctaacagaaaagaagaagccgacgtggggcaggccttcgcgggactggcgggagcggaggaacgctatccggctcaccagcgagcacacggtggagaccctggtggtggccgacgccgacatggtgcagtaccacggggccgaggccgcccagaggttcatcctgaccgtcatgaacatggtatacaatatgtttcagcaccagagcctggggattaaaattaacat

SEQ ID NO: 104737 - DNA, 643 bp, Homo sapiens
  Payload ID: 564
  Gene Symbol: ADAMTS17
  Gene Name: ADAM metallopeptidase with thrombospondin type 1 motif, 17
  ENST ID: ENST00000568565
  CDS Start-End: 1-643
gtgaactctactgctcgcccctcgggaaggagtccccactgctggtggccgacagggtcctggacggtacaccctgcgggccctacgagactgatctctgcgtgcacggcaagtgccagaaaatcggctgtgacggcatcatcgggtctgcagccaaagaggacagatgcggggtctgcagcggggacggcaagacctgccacttggtgaagggcgacttcagccacgcccgggggacaggttatatcgaagctgccgtcattcctgctggagctcggaggatccgtgtggtggaggataaacctgcccacagctttctggctctcaaagactcgggtaaggggtccatcaacagtgactggaagatagagctccccggagagttccagattgcaggcacaactgttcgctatgtgagaagggggctgtgggagaagatctctgccaagggaccaaccaaactaccgctgcacttgatggtgttgttatttcacgaccaagattatggaattcattatgaatacactgttcctgtaaaccgcactgcggaaaatcaaagcgaaccagaaaaaccgcaggactctttgttcatctggacccacagcggctgggaagggtgcagtgtgcagtgcggcggaggtga

SEQ ID NO: 104738 - DNA, 954 bp, Homo sapiens
  Payload ID: 564
  Gene Symbol: ADAMTS17
  Gene Name: ADAM metallopeptidase with thrombospondin type 1 motif, 17
  ENST ID: ENST00000561355
  CDS Start-End: 1-362
gcggccgccccgccgagctgtgcttctactcgggccgtgtgctcggccaccccggctccctcgtctcgctcagcgcctgcggcgccgccggcggcctggttggcctcattcagcttgggcaggagcaggtgctaatccagcccctcaacaactcccagggcccattcagtggacgagaacatctgatcaggcgcaaatggtccttgacccccagcccttctgctgaggcccagagacctgagcagctctgcaaggttctaacagttccacagtgtctgggcctcacctgggaggacttgaaatctggaggctggagtgatctggaggtgcctcattcatgtgtctggcctggaggtggatgacttgaagacaaggacaacaacgtggagcgtctacctgtggcctctgcagcttggcgtccataccttggtggcagacatacttcttctatggccaccagggctcccaatgcaagagttcccgcaagcccagcaggagctgtgctgcctttgaggatcagcctcagaaatcctagagcatcactctgaaggtactctgttggctgaagcggttagaaacctacccaggttcaagggcagagagatagaccccaccgctcaatgtcaaagaatttgggggccttatttaaaacctcttcacacctctataactgtaggtaggtgacaccgctagtgacaaagggctactgtgcagagggatcagagacagctcgaggagagagcatattccatagttcagagacagcataccgggtatggggctcttcagcccagctttggacattggtgtgcatcaactgtgggcattgggcctagagaaggctttggtgtcagagctgtggtgtagtcactctgagtgtccttggtcagttaattgattatagctttacggagataaaattaacatgcaataaactgaatatattcaaatgta
